United States Patent 11,931,406 (FLAVIVIRUS VACCINE) - sequence listing, part 41

SEQ ID NO: 15529 - RNA, 9873 nt, Artificial Sequence
  derived and/or modified CDS sequence (opt3) from DENV-3__FJ639803__SS-prME
accagccugugccucaugaugauccuucccgccgcucuggcauuccacuugacauccagagacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucaaucugaaggauaccuuaaagcguagaucuuggccacucaacgaaggggugauggccguuggacuggugagcauccuugcaucaagucuguugaggaacgacgucccuauggccggcccccucguggcuggugggcugcuaauugcauguuacguaaucacgggaacauccgccgaucugaccguggagaaagcggcugacgucacuugggaagaggaagccgagcagacaggcguuucucauaaucuuaugauaaccguggacgaugacggcacuaugcgcauuaaggaugacgagacagaaaacauccucaccgugcuguugaaaacggcauuacugaucgucagcgggauuuuuccauacuccauaccggccacucuccugguguggcacaccuggcagaagcagacacaacggucaggaguucuuugggauguaccuagcccaccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaauggaaagcgacuagagcccaacugggcaagugucaagaaggaccugaucucuuauggcggcggguggcgccucuccgcucaguggcaaaaaggagaagagguccaggugauugccguugaaccugguaagaaucccaagaauuuccagacaaugcccggcacuuuccagaccacaaccggggagaucggagcgauagcccuggauuuuaagccuggcacuagcgguucgccgaucauuaaucgggaggggaagguggucggacuuuacggcaacggcgugguuaccaaaaaugggggauaugugucagguaucgcacaaacaaacgcugaaccagacggccccacgccugaguuagaagaggaaauguucaagaaaagaaaucugacuauuauggaucuccacccagggucuggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaaagugaacauacgggucgggagaucguggacuugaugugccacgcaacuuuuacaaugcgccuacugucccccguuagagucccaaacuacaaucucauuaucauggaugaagcccauuucaccgacccugcuagcauagccgcaaggggguacauuucuacccgggugggaaugggcgaggccgcugcgaucuuuaugacugccacacccccaggcaccgcagaugcuuucccucagagcaacgcccccauucaggacgaggaacgagacaucccagagagauccuggaacucagggaacgaauggauaacagauuuugcaggaaagacugugugguucgucccgaguauuaaagccgguaacgacaucgcuaauuguuuacgcaagaacggcaaaaagguaauccaacugagcaggaagacguuugauaccgaguaucagaaaacaaaacuuaaugacugggauuucgugguuacuaccgacauuucugagaugggggccaacuuuaaagcggaucgugugaucgacccucggagaugccugaagcccgucauucucacagauggaccagaaagggugauauuggcaggccccaugccuguuaccgccgcuuccgccgcucagcgccgagguagaguggggcggaauccacagaaagagaacgaccaauacaucuucacuggccagccccugaauaacgaugaagaccacgcacauuggacggaggccaagaugcuccuggacaauauuaacaccccugaaggaaucaucccggcucuuuucgagccagagagggaaaagucagccgcaauugauggcgaguaucgccuaaaaggggaaagucguaagacauuugucgagcugaugagacggggagacuugcccgugugguuagcgcacaaaguagccagcgaagguauaaaguacacugauaggaaauggugcuucgacggccagcgcaauaaccagauccuggaggagaauauggauguggaaauuuggaccaaggagggggagaaaaagaagcuccgaccuagauggcuggacgcucggacauauuccgauccccuugcccugaaagaguuuaaggacuucgcagcuggaaggaaaucuaucgcccucgauuugguuaccgaaauuggccgcgucccaacucaccuggcacauagaacaaggaacgcccuagacaaucuggugaugcuccacacgucggagcauggugggaaggcuuaccggcacgcgguggaggaacuuccugagaccauggaaacucuguuauugcugggccucaugauccugcuuacaggaggcgccaugcuguuucucauaagcgggaaaggaaucgguaagaccucaauuggcuugaucugugucauuguuuccagugggaugcuguggauggcagagauccccuuacaauggauagcuucugccauugugcuagaguucuuuaugaugguacugcucaucccagaaccugagaagcagcguaccccgcaggauaaccaacuugccuauguggucauuggaauccugacauuggcagcuauaaucgccgcgaaugaaaugggccugcucgagacuacgaaacgcgaccuggguaugagcaaggaacccggggugguuuccccaaccucauaccuugauguggaccuccacccugcuucugccuggacacuguacgcagucgccacuaccguaauuacacccauguugcgacauaccaucgagaacagcacugcuaacgugagucuggcagccauugcgaaucaggcuguuguguuaaugggccuagacaaaggauggccaaucuccaagauggaucugggcgucccucuccuugcccuggggugcuauagccaggugaaccccuugacgcugacagcagccguccuccugcuuauaacccacuacgcuauuaucggaccgggcuuacaggccaaagcaacuagagaggcucaaaagaggaccgccgcggguaucaugaagaauccaacaguggacgggauuaugacuaucgaucuggacccuguuauauaugauucuaaauucgaaaagcagcucggacaggugauguugcugguacuaugugccgugcagcugcuccuuaugcggaccucaugggcacugugcgaggcuuugacacuggccacgggccccauuaccacucucugggaagguuccccaggcaaauuuuggaacacaaccaucgcagucaguauggcuaauauuuuccgcgggagcuaccuggccggagccggcuuagcguuuucgaucaugaagucuguugggacuggaaaaagaggcacagguucccaaggggagacccuuggagaaaaguggaagaaaaagcugaaccagcucagcaggaaagaguucgaccuauauaagaaaucaggcauaacggagguggaucggaccgaagcuaaggagggucugaaacgaggcgaaaucacacaucacgcagucaguagagggucugccaaguugcagugguuuguggagcgcaauaugguaauucccgaaggaagggugaucgaccugggcugugggcggggaggcugguccuacuauugcgcuggucucaagaaaguuacugaggugcguggguacaccaagggaggcccuggccaugaggaaccgguccccaugagcacauacggguggaacauugugaaacuuaugucaggaaaggaugucuucuaucugccaccugagaaaugugacacuuugcugugcgauaucggugaaaguagccccuccccuaccguggaggagucuagaacaauuaggguucucaagaugguagaaccaugguuaaagaauaaccaguucuguaucaaagugcugaaucccuacaugccuaccgucauagagcaccuugaacgccugcaacggaagcacggcgggaugcuagugcgaaacccacucagcagaaauuccacucaugagauguauuggauuucaaacggaucuggcaauaucguugccagugugaacauggucucgaggcuguugcugaaccgcuuuacgaugacacaccggagacccaccaucgaaaaagacguggaucucggugcagggacucgucauguaaaugccgagccggagaccccuaacauggacgugauuggagaaaggauaaagcggaucaaagaggaacacaauagcacauggcacuacgacgaugagaacccauauaagacgugggcuuaccauggcuccuaugaaguuaaggcgaccggcucugccucaagcaugauuaauggggucgugaaacuucugacuaagcccugggacguggucccuaugguuacacagauggcaaugaccgauacuacaccauucggacagcaacgcguguuuaaagagaagguagacacccgaacacccagauccaugccggguacuaggcgggugaugggcaucaccgcugagugguuauggcgcacgcuggggagaaacaaaaagccuagguugugcacccgagaagaguucacaaagaaaguccggacuaaugccgcaaugggagccguguuuaccgaagagaaccagugggauagugcuaaggccgcgguugaagacgaggauuucuggaaacucguggaccgugagagagaacugcacaagcuaggcaaaugugguucuugcgucuacaauaugauggggaagcgcgagaagaaacuuggagaauuuggcaaagcaaaaggcagcagggccauuugguacauguggcugggggcucgguaucucgaguucgaggcccugggauuuuugaacgaagaucauugguucucaagagaaaauuccuacagugguguggagggcgaggggcugcacaagcucggauauauccuucgcgacauaagcaaaauccccggcggugcaauguacgcugaugacacagccgggugggacacuaggauuaccgaagaugaccugcauaacgaggagaagaucacgcagcagauggauccagaacaccgacaauuagcuaaugccauuuuuaaacugacauaucagaacaagguaguuaaggugcagcggccuacccccacuggaacagucauggacaucauaucuagaaaagaucagaggggcuccggccaaguggggaccuacggauugaauacuuucaccaacauggaggcacagcucauucgccagauggaaggugagggcgugcugucaaaggcggaccuagaaaacccacaccuucccgagaaaaagaucacacaguggcuggagacgaaaggggucgaacgucucaagcggauggccaucagcggagaugacugcguugugaagccuauugaugacagauuugcuaaugcccuguuggcauuaaacgauaugggcaaaguaaggaaggacauaccacaauggcagccgucgaaagguuggcaugauuggcaacaggugcccuucuguucucaccauuuccacgagcugaucaugaaggacgggcgcaaacucgucgugccuugccgaccacaagacgaacuuauuggacgggcuagaaucagucagggcgccggcuggucccugagggagaccgcaugucuagggaaggccuaugcgcagauguggagccugauguacuuucaccgcagagaucuccgguuggcuucaaaugccauuugcuccgcaguucccgugcauugggucccuacuucuaggacaaccuggagcauccacgcccaucaccaauggaugacuacagaagacaugcugaccguguggaaccguguauggauagaggauaauccauggauggaggacaagacgcccguuacaaccugggaaaacgugccuuaccuuggaaaacgagaggaucaguggugugguagucugaucggccucacuucccgcgcuaccugggcccagaauauuccgacagcaauccagcaagucaggagcuuaauugggaacgaagaguuccuggacuauaugccaucuaugaagcgguuuaggaaagaggaagagucagaaggagcuaucugguga

SEQ ID NO: 15530 - RNA, 9873 nt, Artificial Sequence
  derived and/or modified CDS sequence (opt3) from DENV-3__FJ639804__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaucucaagucggagugggcguucagaaggaagguguguuucauacaauguggcacgucacuaggggggccguguugaccuacaacggaaagcgacuagagcccaauugggcauccguaaaaaaggaccugaucagcuauggcggcggguggcgccucucggcucaguggcaaaaaggagaagagguccaggugauugccguugaaccugguaagaacccaaaaaauuuccagacgaugcccggcacauuccagacuaccacaggggagaucggagcgauagcccuggauuuuaagccuggcaccucagguucuccgaucauuaaccgggaggggaagaucgugggacuuuacggcaauggcgucgugacuaaaaacgggggauauguuagugguauugcacaaaccaaugcugaaccagacggccccacaccugaguuagaagaggaaauguucaagaaaagaaaccugacgaucauggaucuccacccaggguccggaaagacuaggaaauacuugcccgccauagugcgugaggcuauuaagcgccggcugagaacccucauccuggcaccuacaagggucguggccgccgagauggaagaggcucuuaagggccugccgauccgauaucagaccacugcgacaaaaagcgaacauaccggucgggagauuguagacuugaugugccacgcaacguuuacuaugcgccuacugucucccgugagaguuccaaauuacaaccucaucauaauggaugaagcccauuucacagacccugcuagcauugccgcaaggggguacaucuccacccgggucggaaugggcgaggccgcugcgauuuuuaugaccgccacucccccaggcacagcagaugcuuucccucagucaaaugcccccauccaggacgaggaacgagacauaccagagagaaguuggaacagcgggaaugaauggauuaccgauuuugcaggaaagacagugugguucgugccgucuaucaaagccgguaacgacaucgcuaacuguuuacgcaagaauggcaaaaaggucauucaacuguccaggaagacuuuugauacggaguaucagaaaaccaagcuuaacgacugggauuucguagugacaacugacaucucagagaugggggccaauuuuaaagcggaucguguuauugacccucggagaugccugaagcccgugauacucaccgauggaccagaaagggucaucuuggcaggccccaugccugugacagccgcuagugccgcucagcgccgagguagaguugggcggaacccacagaaagagaaugaccaauacauuuucaccggccagccccugaacaaugaugaagaccacgcacauuggacugaggccaagaugcuccuggacaacaucaauacgccugaaggaaucauuccggcucuuuucgagccagagagggaaaagagcgccgcaauagauggcgaguaucgccuaaaaggggaaucccguaagaccuuuguggagcugaugagacggggagacuugcccgucugguuagcgcacaaaguggccucugaagguaucaaguacacagauaggaaauggugcuucgacggccagcgcaacaaucagauucuggaggagaacauggauguagaaaucuggacuaaggagggggaaaaaaagaagcuccgaccuagauggcuggacgcucggaccuauucggauccccuugcccugaaagaguuuaaggacuucgcagcuggaaggaaaagcauugcccucgauuuggugacagaaaucggccgcguuccaacccaccuggcacauagaacuaggaaugcccuagacaaccuggucaugcuccacacaucagagcauggugggaaggcuuaccggcacgcgguggaggaacuuccugagacgauggaaacccuguuauugcugggccucaugauacugcuuacuggaggcgccaugcuguuucucaucuccgggaaaggaauugguaagacaaguaucggcuugauuugugugaucgcaucuagcgggaugcuguggauggcugagauacccuuacaauggauugccuccgccaucguccuagaguucuuuaugaugguucugcucauuccagaaccugagaagcagcguaccccgcaggauaaucaacuugcauaugugguaaucggaauacugaccuuggcugccacaaucgcggcuaacgaaaugggccugcucgagacuacgaaacgcgaccuggguaugucaaaggaacccgggguggucucuccaaccagcuaccuugauguggaccuccacccugccagugcauggacacuguacgccguugcuacuaccgugauuacacccauguugcgacauaccaucgagaauuccacugcaaacgucagccuggccgcgauugcuaaccaggccguaguguuaaugggccuagacaaaggauggccaaucucuaagauggaucugggcguuccucuccuugcacuggggugcuauucacaggugaaucccuugacgcugacagccgcuguccuccugcuuauaacccacuacgccauuaucggaccgggcuuacaggcaaaagcuacuagagaggcccaaaagaggaccgcggccgguaucaugaagaacccaacaguggacgggauuaugacuaucgaucuggacccugucauauaugauuccaaauucgaaaagcagcucggacaggugauguugcugguucuaugugcagugcagcugcuccuuaugcggaccaguugggcucugugcgaggccuugacacuggcaacgggccccauuaccacucucugggaagguagcccaggcaaauuuuggaauacaaccaucgcuguaucgauggccaacauuuuccgcgggucuuaccuggccggagcgggcuuagcuuuuuccaucaugaagagcguggggacuggaaaaagaggcacagguucacaaggggagacccuuggagaaaaguggaagaaaaagcugaaucagcucaguaggaaagaguucgaccuauauaagaaaucuggcauaacggaggucgaucggaccgaagcaaaggagggucugaaacgaggcgaaaucacacaucacgccguuuccagagggagcgcuaaguugcagugguuuguggagcgcaacauggucauucccgaaggaagggugaucgaccugggcugugggcggggaggcuggucauacuauugcgccggucucaagaaaguaacugaggugcguggguacaccaagggaggcccuggccaugaggaaccgguucccaugaguacauacggguggaauauugugaaacuuaugagcggaaaggaugucuucuaucugccaccugagaaaugugacacuuugcugugcgauaucggugaauccucucccagcccuaccguggaggaguccagaacaauuaggguccucaagaugguggaaccaugguuaaagaacaaucaguucuguaucaaaguucugaaccccuacaugccuaccguaauagagcaccuugaacgccugcaacggaagcacggcgggaugcuagugcgaaauccacucucaagaaacucuacucaugagauguauuggauuaguaauggaacgggcaacaucgucgcaucggugaauaugguuagcaggcuguugcugaaccgcuuuacaaugaccuaccggagacccacuaucgaaaaagacguggaucucggugccgggacccgucacgucaacgcugagccggagacaccuaauauggacgugauuggagaaaggauagagcggaucaaggaagagcauaacuccacguggcacuaugacgaugaaaauccauacaaaaccugggcguaucacggcucuuacgagguaaaggccacuggcucagcaagcuccaugauuaacggggugguuaagcuucugacaaaacccugggacgucgugccuauggugacccagauggcuaugacugauacaaccccauucggacagcaacgcgucuuuaaggagaaaguugacacacgaauccccagaaguaugccggguacuaggcgggugaugggcauuaccgccgaaugguuauggcgcacgcuggggagaaauaagaaaccuagguugugcacccgagaggaauucacaaagaagguacggacuaacgcagccaugggagcuguguuuaccgaggaaaaucagugggauucugccaaagcggcagucgaggacgaggauuucuggaagcucguggaccgugaaagagagcugcauaaacuaggcaagugugguagcugcguuuacaacaugauggggaaacgcgaaaagaaacuuggagaguuuggcaaggccaagggcucaagggcuaucugguauauguggcugggggcccgguaccucgaguucgaagcacugggauuuuugaaugaggaucacugguucuccagagaaaacaguuauagcgguguggagggcgaagggcugcauaaacucggauacauacuucgcgacaucucuaagauucccggcggugcuauguaugccgaugacacagcugggugggacacuaggaucaccgaggaugaccugcacaaugaggaaaaaauuacgcagcagauggauccagagcaucgacaauuagccaacgcaaucuuuaagcugacauaccagaauaaagucgugaagguacagcggccuacccccacuggaacaguuauggacauaauuuccagaaaggaucagaggggcucaggccaaguggggaccuauggauugaacacuuucaccaauauggaagcgcagcucauccgccagauggagggugaaggcguccugagcaaagccgaccuagagaacccacaccuucccgagaagaaaaucacacaguggcuggaaacgaaggggguggagcgucuccggagaauggcuauuucgggagaugacugcguggucaaaccuauagaugacagguuugccaacgcacuguuggcuuuaaaugauaugggcaagguucgcaaggacaucccacaauggcagccgucuaaagguuggcacgauuggcagcaggugcccuucuguagucaucacuuccaugaacugauuaugaaggacgggcgaaaacucguagugccuugccggccacaagacgagcuuaucggaagagccaggauuucccagggcgcaggcuggagccugcgcgaaaccgccugucuagggaaggcguacgcucagauguggucacugauguacuuucacagacgggaucucagguuggccuccaacgcaaucugcucugccguccccgugcacuggguuccuacuagccguacaaccuggaguauacaugcucaccaucaauggaugacuacagaggacaugcugaccguguggaaucgagucuggaucgaggauaacccauggauggaagacaaaacgcccgugacaaccugggagaauguaccuuaucuuggaaagcgcgaagaucaguggugugguucccugauuggccucacuagcagagccaccugggcacagaacaucccgacagcuauucagcaaguucggucuuuaaucgggaaugaggaguuccuggacuacaugccaucaaugaagagguuucgcaaagaagaggaaagugagggagccauuugguga

SEQ ID NO: 15531 - RNA, 9873 nt, Artificial Sequence
  derived and/or modified CDS sequence (opt3) from DENV-3__FJ639805__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguuccuaaccuuuguucugcuccuguccggacagauuacguggcgggauauggcucacacucuuaucaugauuggcaguaaugccagcgacagaauggguaugggggugaccuacuuggcacugauagccacauucaagauccagcccuuuuuagcucucggauucuuucugaggaaacuuaccucucgcgagaaccugcuacucggcgucggccuggcgauggccacuacauugcaacugccggaagauauugagcagauggcaaaugggaucgcuuuaggacucauggcccugaagcuuauuacccaguucgagacauaucagcuguggacugccuugaucucccucaccuguucaaacacgauauuuacacugaccguggcuuggcgaacugcaacccuaauccuggccgguguuagucuucucccugugugccaaagcucguccaugcggaaaacagacuggcugccaaugacugucgcggcuaugggcguacccccuuugccccuguucauuuuuaauuuaaaggauacccuccguagaaggucuuggccacugaacgaaggggugauggccguuggacuugugagcauccuggcaucaaguuugcuccgcaacgacgucccuauggccggcccccugguggcuggugggcuacugauugcauguuacguaaucacgggaacauccgccgaucuuaccguggagaaggcggcugacgucacuugggaagaggaagccgagcagacaggcguuucucauaaucucaugauaaccguggacgaugacggcacuaugcggauuaaagaugacgagacagaaaacauccugaccguguuguuaaagacggcacugcucaucgucagcgggauuuucccauacuccauaccggccacucugcuuguguggcacaccuggcagaaacagacacaaagaucaggaguucugugggauguaccuagccccccagagacccagaaggcugaauuggaggaggguguguauaggaucaaacagcagggcauuuuugggaagacacaagucggagugggcguucagaaagaagguguguuccauacuauguggcacgucacccgaggggccgugcuaacguacaauggaaagcgccuggagcccaacugggcaaguguaaagaaagaccucaucucuuauggcggcggguggcggcuguccgcucaguggcaaaagggagaagagguccaggugauugccguugaaccugguaaaaauccaaagaacuuucagacaaugcccggcacuuuccagaccacaaccggggagaucggagcgauagcccuugauuucaaaccuggcacuagcgguucgccgaucauuaauagagaggggaagguggucggauuauacggcaacggcgugguuaccaagaaugggggauaugugucagguaucgcacaaacaaacgcugaaccagacggccccacgccugagcuggaagaggaaauguuuaaaaagaggaaucucacuauuauggauuugcacccagggucuggaaaaacccguaaguaccugcccgccaucguccgcgaggcuauaaaacggagacucaggacacugauucuugcaccuacccgagugguagccgccgagauggaagaggcucugaagggcuugccgauccgguaucagacuacagcgaccaagagugaacauacgggucgcgagaucguggaccuaaugugccacgcaacuuucacaaugagacugcucucccccguuagggucccaaacuacaauuuaauuaucauggaugaagcccauuuuaccgacccugcuagcauagccgcacggggguacauuucuacccgagugggaaugggcgaggccgcugcgaucuucaugacugccacacccccaggcaccgcagaugcuuuuccucagagcaacgcccccauucaggacgaggaaagagacaucccagagcgcuccuggaauucagggaacgaauggauaacagauuucgcaggaaaaacugugugguuugucccgaguauuaaggccgguaacgacaucgcuaauugucugaggaaaaacggcaagaaaguaauccaacuuagccguaagacguucgauaccgaguaucagaagacaaaacugaaugacugggauuuugugguuacuaccgacauuucugagaugggggccaacuucaaggcggaucgggugaucgacccuagaaggugccucaaacccgucauuuugacagauggaccagaacgcgugauacuggcaggccccaugccuguuaccgccgcuuccgccgcucagcgaagaggucggguggggaggaauccacagaaggagaacgaccaauacaucuuuacuggccagccccucaauaacgaugaagaccacgcacauuggacggaggccaaaaugcugcuugacaauauuaacaccccugaaggaaucaucccggcucuauucgagccagagcgcgaaaagucagccgcaauugauggcgaguaucgucugaagggggaaaguagaaaaacauucgucgaguugaugcggaggggagacuuacccguguggcuggcgcacaagguagccagcgaagguauaaaauacacugaucgcaaguggugcuuugacggccagcgaaauaaccagauccucgaggagaauauggauguggaaauuuggaccaaagagggggaaaagaaaaagcugagaccucgguggcuugacgcuaggacauauuccgauccccuggcccucaaggaguucaaagacuuugcagcuggacgcaagucuaucgccuuggaucugguuaccgaaauuggcagagucccaacucaccuagcacauaggacacggaacgcccuggacaaucucgugaugcuucacacgucggagcauggugggaaagcuuaccgucacgcgguggaggaacugccugagaccauggaaacuuuauugcugcucggccugaugauccuucugacaggaggcgccaugcucuucuugauaagcgggaagggacuggguaaaaccucaaucggcuuaauuugugucaucgcauccagugggaugcuauggauggcugagauuccccugcaauggaucgccucugccauaguucucgaguuuuucaugauggugcuucugauuccagaaccugagaagcagcgcaccccgcaggauaaccaauuggcauauguagugaucggaauucugacacucgcugccaucauagcggcuaaugaaaugggccugcuugagacuacgaagcgagaccucgguaugagcaaagaacccggggucguguccccaaccucauaccuggauguugacuugcacccugccucugcauggacacuguacgccguggcuacuaccgucaucacacccauguuaagacauaccauugagaacagcacugcaaacguaagucuagccgcgaucgcuaaucaggccgugguucugaugggccucgacaagggauggccaauuuccaaaauggaucuuggcgugccucuguuggcacuggggugcuauagccaggucaacccccucacgcugacagccgcugugcuuuuacugaucacccacuacgccauaauuggaccgggccuccaggcaaaggcuacuagggaggcccaaaaacggaccgcggccgguaucaugaagaauccaacagucgacgggaucaugacuauugauuuggacccugugaucuaugauucuaaguuugaaaaacagcugggacagguuaugcuacuggugcucugugcaguacagcuucuguugaugcgcaccucaugggcucugugcgaggcccucacacuggcaacgggccccauaaccacuuuaugggaagguuccccaggcaaguucuggaacacaaccauugcugugaguauggccaauaucuuuagagggagcuaccuugccggagcgggccuggcuuucucgauuaugaaaucugucgggacuggaaagaggggcacagguucccaaggggagacccucggagaaaaauggaagaagaaacuaaaccagcugagccggaaggaguuugacuuguauaaaaagucaggcaucacggagguugaucgaaccgaagcaaaagagggucugaagagaggcgaaauaacacaucacgccgugagucgcgggucugcuaaacuccagugguucgucgagaggaauauggugauccccgaaggacggguaauugaccuuggcugugggcguggaggcugguccuacuauugcgccggucugaagaaggugacugagguuagaggguacaccaaaggaggcccuggccaugaggaaccggugcccaugagcacauacggguggaacaucgucaaguugaugucaggaaaagauguguuuuaucugccaccugagaagugugacacucucuuaugcgauauuggugaaaguagccccuccccuaccgucgaggagucuaggacaauccgcgugcugaaaaugguugaaccauggcuuaagaauaaccaguucuguauuaagguacugaaucccuacaugccuaccgugaucgagcaccuagaacggcuccaacgaaaacacggcgggaugcuggucagaaacccauugagcaggaauuccacucaugagauguauuggauaucaaacggaacgggcaauauuguggcaucuguuaacauggugagucgccugcuccuuaaccgguucacaaugacccacagacgucccacuaucgaaaaggacgucgaucugggugccgggaccaggcaugugaaugcugagccggagacaccuaacauggacguaaucggagaacggauuaaacgcauaaaggaggaacacaauucgacguggcacuacgacgaugagaacccauauaaaaccugggcguaccauggcagcuaugaagugaaggccacuggcuccgcaucuucaaugaucaaugggguugucaaguuacugacaaaacccugggacguggugccuauggucauucagauggcuaugaccgauacuacaccauuuggacagcaacgaguuuucaaggagaaaguggacaccagaacacccaggagcaugccggguacucggcgcguaaugggcaucaccgccgagugguuguggagaacgcucgggaggaacaagaaaccucgacugugcacccgggaagaguuuacaaagaaggugcguacuaaugcagccaugggagcugucuucaccgaagagaaccagugggauuccgccaaagcggcaguggaagacgaggauuuuuggaagcuaguugacagagagcgcgaacuucacaaacugggcaagugugguaguugcguguacaauaugauggggaaaagggagaagaaacucggagaauucggcaaggccaagggcucucgggcuauuugguacauguggcugggggccagauauuuggaguuugaggcacugggauuccucaacgaagaucauugguuuagccgcgagaauucauacuccggugucgaaggcgaggggcuucacaaacugggauauaucuuaagggacauaaguaagauccccggcggugcuauguacgccgaugacacagcugggugggacacucgaauuaccgaagaugaccugcauaacgaggagaaaaucacgcagcagauggauccagaacaccggcaauuggccaaugcaauuuucaagcucacauaucagaacaaagugguaaagguucagagaccuacccccacuggaacagugauggacaucauaagcaggaaggaucagcgcggcucuggccaagucgggaccuacggacugaauacuuuuaccaacauggaggcgcagcuaauucgucagauggaaggugagggcgugcuuuccaaagccgaccuggaaaacccacaccuccccgagaagaaaaucacacaguggcuggagacgaaggggguggaacgguugaaaagaauggcuaucucaggagaugacugcgucguuaagccuauugaugacagguucgccaaugcauuacuggcucucaacgauaugggcaaggugcgcaaagacauaccacaauggcagccgagcaaggguuggcaugauuggcagcagguacccuuuuguucgcaccauuuccacgagcuuaucaugaaagacgggcgaaagcugguggucccuugccggccacaagacgaacuaauuggaagagccaggaucucucagggcgcaggcuggagucugcgcgagaccgccugucucgggaaagcguaugcucagaugugguccuugauguacuuccacagacgggaucugaggcuugccagcaaugcaauuugcucagccgugcccguucauugggugccuacuucccguacaaccuggucuauccacgcucaucaccaauggaugacuacagaagacaugcugaccgucuggaaccgaguguggauagaggauaauccauggauggaggacaagacgcccguaacaaccugggaaaacguuccuuaccucggaaagcgcgaggaucaguggugugguagcuuaaucggccugacuaguagagccaccugggcacagaauauuccgacagcuauccagcaagugcgguccuugauugggaacgaagaguuucuggacuauaugccaagcaugaaaagguuccgcaaggaggaagagucugaaggagccaucugguga

SEQ ID NO: 15532 - RNA, 9873 nt, Artificial Sequence
  derived and/or modified CDS sequence (opt3) from DENV-3__FJ639807__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgaggggggccguguugacauacaacggaaagcgacuagagcccaauugggcaucuguaaaaaaggaccugauuuccuauggcggcggguggcgccucagcgcucaguggcaaaaaggagaagagguccaggugaucgccguugaaccugguaagaacccaaaaaauuuccagacuaugcccggcaccuuccagacaaccacuggggagauuggagcgaucgcccuggauuuuaagccuggcaccucggguucaccgauaaucaaccgggaggggaagguggucggacuuuacggcaauggcgugguuacaaaaaacgggggauaugugucugguauugcacaaacgaaugcugaaccagacggccccacuccugaguuagaagaggaaauguucaagaaaagaaaccugaccaucauggaucuccacccagggaguggaaagacaaggaaauacuugcccgccauuguccgugaggcuaucaagcgccggcugagaacccucauacuggcaccuacuagggugguagccgccgagauggaagaggcucuuaagggccugccgauucgauaucagacaaccgcgacgaaauccgaacauacuggucgggagaucguggacuugaugugccacgcaacauuuaccaugcgccuacugagccccguuagagucccaaauuacaaccucaucauuauggaugaagcccauuucaccgacccugcuucuaucgccgcaaggggguacauaagcacucgggugggaaugggcgaggccgcugcgauuuuuaugacagccacccccccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacuguuuacgcaagaauggcaaaaagguaauccaacugucuaggaagaccuuugauacagaguaucagaaaacuaagcuuaacgacugggauuucgugguuaccacagacaucuccgagaugggggccaauuuuaaagcggaucgugugauugacccucggagaugccugaagcccgucauccucaccgauggaccagaaagggugauuuuggcaggccccaugccuguuacugccgcuucagccgcucagcgccgagguagaguggggcggaacccacagaaagagaaugaccaauacauauucacgggccagccccugaacaaugaugaagaccacgcacauuggaccgaggccaagaugcuccuggacaacaucaauacaccugaaggaauuaucccggcucuuuucgagccagagagggaaaagagugccgcaaucgauggcgaguaucgccuaaaaggggaaagccguaagacuuuugucgagcugaugagacggggagacuugcccgugugguuagcgcacaaaguagccuccgaagguauuaaguacaccgauaggaaauggugcuucgacggccagcgcaacaaucagauacuggaggagaacauggauguggaaaucuggacaaaggagggggaaaaaaagaagcuccgaccuagauggcuggacgcucggaccuauucugauccccuugcccugaaagaguuuaaggacuucgcagcuggaaggaaaucgauugcccucgauuugguuacugaaaucggccgcgucccaacacaccuggcacauagaacgaggaaugcccuagacaaccuggugaugcuccacaccagcgagcauggugggaaggcuuaccggcacgcgguggaggaacuuccugagacuauggaaacacuguuauugcugggccucaugauucugcuuaccggaggcgccaugcuguuucucaucucagggaaaggaauagguaagaccuccaucggcuugauuugugucaucgcaaguucugggaugcuguggauggcugagauucccuuacaauggaucgccagcgccauaguucuagaguucuuuaugauggugcugcucauuccagaaccugagaagcagcguacaccgcaggauaaucaacuugcauauguagugaucggaauucugacuuuggcugccacgaucgcggcuaacgaaaugggccugcucgagaccacaaaacgcgaccuggguauguccaaggaacccggggucgugucaccaacuucuuaccuugauguugaccuccacccugccagcgcauggacccuguacgccguggcuacaaccgucauaacucccauguugcgacauacgaucgagaauaguacagcaaacguaucccuggccgcgauugcuaaccaggccgugguuuuaaugggccuagacaaaggauggccaaucagcaagauggaucugggcgugccucuccuugcacuggggugcuauucucaggucaaucccuugacccugacugccgcugugcuccugcuuauuacccacuacgccaucauaggaccgggcuuacaggcaaaagcuacaagagaggcccaaaagaggacugcggccgguauuaugaagaacccaaccgucgacgggaucaugacaaucgaucuggacccugugauuuaugauucaaaauucgaaaagcagcucggacagguuauguugcuggugcuaugugcaguacagcugcuccuuaugcggacguccugggcucugugcgaggccuugacccuggcaacuggccccaucacaacccucugggaagguaguccaggcaaauuuuggaauacuacaauagcugugagcauggccaacauuuuccgcgggucguaccuggccggagcgggcuuagcuuuuucuaucaugaaguccgucgggaccggaaaaagaggcacggguagccaaggggagacccuuggagaaaaguggaagaaaaggcugaaucagcucucacggaaggaguucgaccuauauaaaaagaguggcauuacagagguugaucgaacugaagcaaaagagggucugaagagaggcgaaaucacccaucacgccgugucucgcggguccgcuaaauugcagugguuugucgagaggaacauggugauacccgaaggacggguaaucgaccugggcugugggcguggaggcuggagcuacuauugcgccggucucaagaaggugacagagguuagaggguacacuaaaggaggcccuggccaugaggaaccggugcccaugucaaccuacggguggaauauugucaagcuuaugaguggaaaagauguguucuaucugccaccugagaagugugacacauugcugugcgauaucggugaaagcucccccucuccuaccgucgaggagagcaggacuauucgcgugcucaaaaugguugaaccaugguuaaagaacaaucaguucuguaucaagguacugaaccccuacaugccuacggugauugagcaccuugaacggcugcaacgaaaacacggcgggaugcuagucagaaauccacucuccaggaacucaacacaugagauguauuggaucucuaauggaaccggcaacauaguggcaaguguuaauauggugucgcgccuguugcugaaccgguuuacuaugacccacagacgucccacaauugaaaaggacgucgaucucggugccgggacgaggcaugugaacgcugagccggagaccccuaauauggacguaaucggagaacggaucaaacgcauuaaggaggaacacaacagcacuuggcacuacgacgaugagaauccauauaaaacaugggcguaccauggcuccuaugaagugaaggccaccggcucugcaucaagcaugauaaacgggguugucaagcuucugacuaaacccugggacguggugccuauggucacacagauggcuaugaccgauacaacuccauucggacagcaacgaguuuuuaaggagaaaguggacaccagaacgcccagguccaugccggguacccggcgcguaaugggcaucacagccgagugguuauggagaacucuggggaggaauaagaaaccucgauugugcacccgggaagaguucacaaagaaggugcguacuaacgcagccaugggagcugucuuuaccgaagagaaucagugggauagugccaaagcggcaguggaagacgaggauuucuggaagcucguugacagagagcgcgaacugcacaaacuaggcaagugugguucuugcguguacaacaugauggggaaaagggagaagaaacuuggagaauuuggcaaggccaagggcagccgggcuauuugguacauguggcugggggccagauaucucgaguucgaggcacugggauuuuugaaugaagaucauugguucucacgcgagaacuccuacaguggugucgaaggcgaggggcugcacaaacucggauauauccuuagggacauuagcaagauccccggcggugcuauguacgccgaugacacggcugggugggacacacgaauaaccgaagaugaccugcauaaugaggagaaaaucacucagcagauggauccagaacaccggcaauuagccaacgcaauuuuuaagcugacauaucagaauaaagugguaaagguucagagaccuacccccacuggaaccgugauggacaucauuucuaggaaggaucagcgcggcuccggccaagucgggacauacggauugaacacguucaccaauauggaggcgcagcucauccgucagauggaaggugagggcgugcugucaaaagccgaccuagaaaacccacaccuucccgagaagaaaauaacucaguggcuggagacaaaggggguggaacggcucaaaagaauggcuauuagcggagaugacugcgucguuaagccuaucgaugacagguuugccaacgcacuguuggcuuuaaaugauaugggcaaggugcgcaaagacaucccacaauggcagccgucgaaggguuggcaugauuggcagcagguacccuucuguucucaccauuuccacgagcugauuaugaaagacgggcgaaagcucguggucccuugccggccacaagacgaacuuauaggaagagccaggaucagucagggcgcaggcuggucccugcgcgagaccgccugucuagggaaagcguaugcucagauguggagccugauguacuuucacagacgggaucucagguuggccucaaacgcaauuugcuccgccgugcccguucauugggugccuacuucucguacaaccuggagcauccacgcucaucaccaauggaugacgacagaagacaugcugaccgucuggaaucgaguguggauugaggauaacccauggauggaggacaagacucccguaaccacaugggaaaauguuccuuaccuuggaaagcgcgaggaucaguggugugguagucugaucggccucacuuccagagccaccugggcacagaacauaccgacagcuauccagcaagugcggagcuuaauugggaaugaagaguuccuggacuauaugccaucuaugaaaagguuucgcaaggaggaagagucagaaggagccaucugguga

SEQ ID NO: 15533 - RNA, 9873 nt, Artificial Sequence
  derived and/or modified CDS sequence (opt3) from DENV-3__FJ639810__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaggauagugacagcggaaacucaaaacaguuccuucauuaucgauggccccaauaccccagagugccccaacacgagccgggccuggaauguuugggaaguggaggacuaugguuuuggggucuucacaaccaacauuuggcugaagcuucgcgaaguguacacucaguugugugaccacagacucaugucugcugcaguuaaagaugagagggccgugcacgcugacaugggauacuggaucgagucacagaagaauggcaguuggaaacuggaaaaggccagccuaauagagguaaaaaccugcacauggccuaagucccauacucuguggucuaacgguguccucgaaucggauaugaucauuccaaagagccuggcaggcccgaucucccagcacaauuaucgucccggguaccauacccaaacagcgggaccuuggcaccuuggcaaauuggagcuggacuuuaacuauugcgaggggacgaccguggugauuacugaaaauuguggaacacggggcccaucauuacgaaccacuacagucagugguaagcucauccacgaguggugcuguagaucuugcacccugcccccucuuagguacaugggggaagauggauguugguauggcauggagauacgcccaauuagcgaaaaagaggagaacaugguuaagucccuggugucagccgguagcggcgaaguagacaauuucacgauggggguguugugccucgcuauccuguuugaggaagucaugcggggaaaauucggcaagaagcauaugaucgccggggugcuauucacuuuuguucugcuccugucuggacagauuaccuggagagauauggcacacacacuuaucaugauuggcuccaacgcuagugacaggauggguaugggggugaccuacuuggcccugauagcaacuuucaaaauccagcccuuuuuagcccucggauucuuucugcgcaagcuuacaagccgagagaaucugcuacucggcgucggccuggcuauggcgaccacauugcaacugccggaagauauugagcagauggccaacgggaucgcauuaggacucauggcucugaaacuuauuacucaguucgagaccuaucagcuguggacggccuugaucucucucacauguuccaauaccauauuuacucugaccguggccuggcggacagcuacucuaauccuggcagguguuucacuucucccugugugccaaaguagcucgaugcguaagaccgacuggcugccaaugacggucgccgcgaugggcguacccccuuugccccuguucauuuuuuguuuaaaagauacacucaagagaagguccuggccacugaacgaaggggugauggcuguuggacuugugucuauccuggccagcucauugcuccgcaacgacgucccuauggcaggcccccugguggccggugggcuacugauugcuugcuacguaaucaccggaacuagugcagaucuuacaguggagaaggccgcggacgucaccugggaagaggaagcugagcagacuggcguuucccauaaucucaugauaacaguggacgaugacggcaccaugcggauuaaagaugacgagacggaaaacauccugacuguguuguuaaagaccgcccugcucaucgucucugggauuuucccauacagcauaccggcaacacugcuuguguggcacaccuggcagaaacagacacaaagauccggaguucugugggauguaccuucacccccagagacucagaaggccgaauuggaggaggguguguauaggaucaaacagcagggcauuuuugggaagacccaagucggagugggcguucagaaagaagguguguuccauacgauguggcacgucacacgaggggcugugcuaacuuacaauggaaagcgccuggagcccaacugggccagcguaaagaaagaccucaucaguuauggcggcggguggcggcugucugcacaguggcaaaagggagaagagguccaggugauugcuguugaaccugguaaaaauccaaagaacuuucagaccaugcccggcacauuccagaccacuaccggggagaucggagccauagcgcuugauuucaaaccuggcacauccgguagcccgaucauuaauagagaggggaagguggucggauuauacggcaacggcgugguuacgaagaaugggggauaugugucggguaucgcccaaacuaacgcagaaccagacggccccaccccugagcuggaagaggaaauguuuaaaaagaggaaucucacaauuauggauuugcacccagggucaggaaaaacccguaaguaccugcccgcuaucguccgcgaggccauaaaacggagacucaggacucugauucuugcuccuacacgagugguagcagccgagauggaagaggcccugaagggcuugccgauccgguaucagaccacggcuacuaagucugaacauacaggucgcgagaucguggaccuaaugugucacgcgaccuucaccaugagacugcucagucccguuagggucccaaacuacaauuuaauuaucauggaugaagcacauuuuacugacccugccuccauagcugcccggggguacauuagcacacgagugggaaugggcgaggcagccgcuaucuucaugaccgcgacacccccaggcacugccgaugcauuuccucagucuaacgcucccauucaggacgaggaaagagacaucccagagcgcagcuggaauuccgggaacgaauggauaacggauuucgccggaaaaaccgugugguuugucccgucaauuaaggcagguaacgacaucgccaauugccugaggaaaaacggcaagaaaguaauccaacuuagucguaagacauucgauacugaguaucagaagaccaaacugaaugacugggauuuugugguuacaaccgacauuagcgagaugggggcuaacuucaaggccgaucgggugaucgacccuagaaggugccucaaacccgucauuuugacugauggaccagaacgcgugauacuggcgggccccaugccuguuacggcagccucugcugcccagcgaagaggucggguggggaggaauccacagaaggagaacgaccaauacaucuuuaccggccagccccucaauaacgaugaagaccacgcucauuggacagaggcaaaaaugcugcuugacaauauuaacacuccugaaggaaucaugccggcccuauucgagccagagcgcgaaaaguccgcugccaucgauggcgaguaucgucugaagggggaaucaagaaaaaccuucgucgaguugaugcggaggggagacuuacccguguggcuggcacacaagguagcgagugaagguauuaaauacacagaucgcaagugguguuuugacggccagcgaaauaaccagauacucgaggagaauauggauguggaaaucuggaccaaagagggggaaaagaaaaagcugagaccucgguggcuugacgccaggacuuauagcgauccccuggcucucaaggaguucaaagacuuugccgcaggacgcaaguccauugcuuuggaucugguuacagaaaucggcagagucccaacgcaccuagcccauaggacccggaacgcacuggacaaucucgugaugcuucacacuucugagcauggugggaaagccuaccgucacgcuguggaggaacugccugagacaauggaaaccuuauugcugcucggccugaugauucuucugaccggaggcgcgaugcucuucuugaucucggggaagggaauagguaaaacaagcaucggccugauuugcgucaucgccucauccgggauguuauggauggcagagauuccccuacaauggaucgcuagugccauaguucuggaguuuuucaugauggugcuccuuauuccagaaccugagaagcagcgcacuccgcaggauaaccaacuggccuauguagugaucggaauuuugacgcuggcagcuaucauagccgcgaaugaaaugggccuccuggagaccacaaagcgagaccuugguaugucuaaagaacccggggucgugagcccaacuuccuaccucgauguugaccugcacccugcuucagccuggaccuuguacgcaguggccacaaccgucaucacucccaugcugagacauacgauugagaacucuacagcuaacguaagcuuagcagccaucgcgaaucaggcugugguucuaaugggccuggacaagggauggccaauuaguaaaauggaucucggcgugccucuucuggccuugggguguuauucccaggucaacccccugacccucacugcagccgugcugcuuuuaaucacccacuacgcuauaauuggaccgggccugcaggccaaggcaacaagggaggcucaaaaacggacugccgcggguaucaugaagaauccaaccgucgacgggaucaugacaauugaucucgacccugugaucuaugauagcaaguuugaaaaacaguugggacagguuaugcugcuagugcugugcgccguacagcuccuucugaugcgcacgucuugggcauugugugaggcucugacccucgccacuggccccauaacaacccugugggaagguucaccaggcaaguucuggaacacuacaauugcaguguccauggcuaauaucuuuagagggaguuacuuagccggagccggccuugcguucagcauuaugaaaucggucgggaccggaaagaggggcacggguucucaaggggagacccugggagaaaaauggaagaagaaacucaaccagcuaucccggaaggaguuugaccuguauaaaaagagcggcaucacagagguugaucgaacugaagcuaaagaggguuugaagagaggcgaaauaacccaucacgcagugucacgcgggagugccaaacugcagugguucgucgagaggaauauggugauccccgaaggacggguaauugaccucggcugcgggcguggaggcuggucuuacuauugugcuggucuuaagaaggugacagagguuagaggguacacuaaaggaggcccuggccaugaggaaccggugcccauguccaccuacggguggaacaucgucaagcugaugagcggaaaagauguguuuuauuugccaccugagaagugcgacacacugcucugugauauuggugaaucaagucccagcccuaccgucgaggaguccaggacuauccgcguguuaaaaaugguugaaccauggcugaagaauaaccaguucugcauuaagguacuuaaucccuacaugccugccgugaucgagcaccuggaacggcuacaacgaaaacacggcgggaugcucgucagaaacccacugucuaggaauagcacgcaugagauguauuggauauccaacggaacaggcaauauuguggcaucaguuaacauggugucucgcuugcugcucaaccgguucaccaugacucacagacgucccaccaucgaaaaggacgucgaucuuggugccgggacaaggcaugugaaugcugagccggagacgccuaacauggacguaaucggagaacggauuaaacgcauaaaggaggaacacaauaguaccuggcacuacgacgaugagaacccauauaaaacuugggcguaccauggcucguaugaagugaaggccacaggcagcgcauccucuaugaucaaugggguugucaagcuguuaaccaaacccugggacguggugccuauggucacucagauggcuaugacagauaccacaccauuuggacagcaacgaguuuucaaggagaaaguggacacuagaacccccaggucaaugccggguacgcggcgcguaaugggcauuaccgccgaguggcuguggagaacauuggggaggaacaagaaaccucgacucuguacucgggaagaguuuaccaagaaggugcguacaaaugcagccaugggagcugucuucacugaagagaaccagugggauagcgccaaagcggcaguggaagacgaggauuuuuggaagcugguugacagagagcgcgaacuacacaaacuuggcaagugcgguuccugcguguacaauaugauggggaaaagggagaagaaacugggagaauucggcaaggccaagggcagucgggcuaucugguacauguggcucggggccagauaucuggaguuugaggcauugggauuccugaacgaagaucauugguuuucucgcgagaauagcuacucaggugucgaaggcgaggggcuccacaaacuuggauauauucugagggacaucuccaagauacccggcggugcuauguacgccgaugacaccgcugggugggacacgcgaaucacagaagaugacuuauauaacgaggagaaaauuacccagcagauggauccagaacaucggcaacuggccaaugcaaucuucaaguugacuuaccagaacaaagugguaaagguucagagaccuacacccaccggaacugugauggacauuaucaguaggaaggaucagcgcggcagcggccaagucgggaccuauggacucaauacauuuacgaacauggaggcgcagcugauacgucagauggaaggugagggcgugcuaucuaaagccgaccuugaaaacccacaccugcccgagaagaaaauuacccaguggcucgagacuaaggggguggaacggcugaaaagaauggcuaucuccggagaugacugugucguuaagccuaucgaugacagguucgccaaugcauuguuagcucugaacgauaugggcaaggugcgcaaagacauuccacaauggcagccgucaaaggguuggcacgauuggcagcagguacccuuuugcagccaucacuuccaugagcucauaaugaaagacgggcgaaagcuuguggucccuugucggccacaagacgaacugaucggaagagccaggauuucgcagggcgcaggcuggucucuacgcgagacagccugccuggggaaagcguacgcucagauguggagucucauguacuuccacagacgggauuugaggcuggccuccaaugcaaucuguagcgccgugcccguucacugggugccuaccucacguacuacaugguccauucaugcucaccaucaauggaugaccacggaagacaugcuuacagucuggaaccgaguguggaucgaggauaauccauggauggaggacaagacccccguaacuaccugggaaaacguuccuuaucugggaaagcgcgaggaucaguggugcgguucucucauaggcuuaacaagcagagccacuugggcacagaauaucccgaccgcuauucagcaagugcggagucugaucgggaacgaagaguuuuuggacuacaugccauccaugaaaagguuccgcaaggaggaagagagcgaaggagccauuugguga

SEQ ID NO: 15534 - RNA, 9873 nt, Artificial Sequence
  derived and/or modified CDS sequence (opt3) from DENV-3__FJ639816__SS-prME
accagccugugccucaugaugauccuucccgccacacuggcuuuccacuugacuuccagagacggcgagccuaggaugauuguggggaagaacgaacggggaaaaucuuuacuguuuaagacggcaucagguauaaauauguguacccuaaucgccauggaucucggcgagaugugcgacgauacagucacuuacaaauguccacauauuaccgaaguugagccggaagacaucgauugcugguguaaccugacaaguaccugggugacuuaugggacaugcaaucaggcgggagagcaccgccgagacaagcguagcguagcucuugccccccaugugggcaugggucuggauaccagaacgcaaacuuggauguccgcagagggggccuggaggcaggucgaaaaaguggagaccugggcuuugcggcacccuggauucacaauucucgcacuguuucuggcccauuacaucggcacuucucucacccagaagguugugauauucaucuuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacauugagcuccagaagacugaagcgacacaacuggcaacccuuaggaaacuguguaucgagggaaagauuacgaacaucaccacagauagccggugcccuacucagggcgaagccgucuugccagaggaacaggaccagaauuauguuuguaaacacaccuacguggaucgcgguugggggaacggaugcggccucuucggcaaggggagucugguaacaugcgcuaaguuucaauguuuagagcccauagagggaaaagugguccaguaugaaaaucugaaguacacugugauuaucaccguucauacaggugaccagcaccaggugggcaacgagacccaaggggucacugccgaaauuacgccucaggcauccacaaccgaggcuauccucccagaauauggaacucuuggccuggagugcucuccgcgaaccgguuuggacuucaaugagaugauccuacugacaaugaaaaacaaggccuggauggugcauagacagugguuuuucgaucucccccugccuuggaccagcggggcgacuacagaaacgccaaccuggaauaggaaagagcuucugguaacuuuuaagaacgcccacgcaaaaaagcaagaaguuguggucuugggcucccaggagggagcuaugcacacagcccucaccggcgcuacagaaauucagaauucagggggaacuaguauauucgccggucaucugaagugucgguuaaaaauggacaagcuggagcuaaaaggcaugagcuacgcaaugugcaccaacacguuugugcucaagaaagaggucucugaaacccagcacgggacaauccugauuaagguggaguacaagggagaagauguucccuguaaaaucccuuucuccacugaggacgagcaaggcaaggcccauaacggucgucuuauaaccgcuaauccagugguaacaaaaaaggaagagcccgucaacauugaagcggagccgccuuucggggaaucaaauaucgugaucggcauuggagauaacgcauugaaaaucaauugguauaagaagggcagcaguauugggaaaauguuugaggccacugcucgcggagccagaaggauggcaauacugggugacaccgccugggauuucggcucuguugggggagugcucaacucccugggcaagaugguccaccagaucuuugguagcgcuuacacggcccuuuucucgggggugucuuggguaaugaaaauuggcaucggagugcuguugacauggaucggccucaauuccaagaacaccucaaugaguuuuagcugcauugcaauagggaucauuacucuguauuuaggagcgguuguccaggcugacaugggcugugugaucaauuggaaagguaaggagcugaagugcggguccggaauuuucgugacaaacgaaguccauaccuggacugagcaguacaaauuucaagccgauucucccaagcggcuagcaaccgccaucgcuggcgccugggaaaaugguguuuguggcauacgaagcacaacgcgcauggagaaccuccuguggaaacagaucgcaaaugaacuuaacuauauuuugugggagaauaacaucaagcugaccguggugguaggggacauuaucggaguccucgagcagggcaaaagaacucugacaccacagccuauggaauuaaaguacucauggaaaaccugggggaaggcuaggauagugacagccgagacucaaaacaguuccuucauuaucgauggacccaauaccccagaaugccccagcgcgucucgggccuggaacguuugggagguggaagacuauggcuuuggugucuucacgacaaauauuuggcugaagcuucgcgagguguacacccaguugugugaccacagacucaugucagcugcaguuaaagaugagagggccgugcacgcugacaugggguacuggaucgaaagucagaagaacggaagcuggaaacuggagaaggccucccuaauagaaguaaaaacuugcaccuggccuaagucucauacacuguggucgaauggcguccucgagagcgauaugaucauuccaaagucccuggcagguccgaucucacagcacaacuaucgucccggcuaccauacucaaaccgcggggccuuggcaccuuggaaaauuggagcuggacuuuaauuauugcgaaggcacaacgguggugauuaccgagaacugugggacucggggaccaaguuuacgaacaaccacugucucuggcaagcucauccacgaauggugcuguagaagcugcacacugcccccucuuagguacaugggugaggauggguguugguauggaauggaaauacgcccaauuuccgagaaagaggaaaauaugguuaagucacuggugagcgccggcucuggugagguagacaacuucaccaugggcguguugugccucgcuauccuguuugaagaggucaugcgggggaaauucggaaagaagcauaugaucgccggcguguucuuuacguucguucuacugcucuccgggcagauuacuuggagagauauggcacacacccugaucaugauuggaaguaaugcuagcgacaggaugggcaugggugugacauaccuugccuugauagcaaccuuuaaaauccagcccuuccuggccuuaggguuuuuccuccgcaagcugacuucucgagaaaaccuucugcuaggagucggccucgcuauggcgacaacccugcaauugccggaggauauugagcagauggccaauggcaucgcacugggguuaauggcucucaaacugauuacacaguuugaaacuuaucagcuuuggaccgcccugaucuccuugacguguucaaacacaauauucacccucacuguggccuggcggaccgcuacacugauccuagcaggaguuagucugcuuccugugugccaaagcucguccaugcguaagacugacuggcucccaaugaccgucgccgcgauggguguacccccucugcccuuguuuauuuucucucugaaagauacguuaaagagaaggagcuggccacucaaugagggcgugauggcuguugggcuggugucaauccuugccaguucccuguugcgcaacgacgucccuauggcaggaccccucguggccggcggucugcuaauugcuuguuacguaaucacagggaccucugcagaucugacuguggaaaaggccgcggacgucacaugggaggaagaggcugagcagaccggaguuagccauaaccuuaugauaacuguggacgaugacggcacaaugcggauuaaagaugacgaaaccgagaauauccucacggugcuguugaagacugccuuacugaucgucuccggcauuuuuccauacucaauaccggcaacccuccugguguggcacacauggcagaaacagacccaaagaagcgggguucuuugggauguaccuagucccccagaaacacagaaggccgagcuggaggaaggaguguauaggaucaaacagcaggguauuuucggcaagacucaagucggggugggaguucagaaagagggcguguuucauaccauguggcacgucacgcgaggugcuguguugacauacaacgggaagcgccuagaacccaauugggccucuguaaagaaagaccugaucuccuauggaggcggcuggcggcucagcgcacaguggcaaaagggggaggaaguccaggugauugcuguugagccuggaaaaaacccaaagaauuuccagacuaugcccgguaccuuccagacaaccacuggcgagaucggggccauagcgcuggauuuuaaaccuggaaccucgggcucaccgaucauuaacagagaagguaagaucguggggcuuuacggaaauggcgucgugacaaagaacggcggguauguuucuggaauugcccaaacgaaugcagagccagacggucccacuccugaauuagaggaagagauguucaaaaagaggaaccugaccaucauggaucuccacccaggcagugggaaaacacguaaguacuugcccgcuauagugcgcgaggccauuaaacggagacugaggacccucauccuggcuccuacucgagucguggcagccgaaauggaggaagcccuuaagggacugccgauccgguaucagacaaccgcuacgaaguccgagcauacuggccgcgaaauuguagacuugaugugccacgcgacauuuaccaugagacuacugagccccgugaggguuccaaauuacaaccucaucauaauggaugaggcacauuucaccgacccugccucuauugcugcccgggguuacaucagcacucgagucgggaugggagaggcagccgcuauuuuuaugacagcgacccccccaggcacagccgaugcauucccucaguccaaugcucccauccaggacgaagagagagacauaccagaacgcucauggaacaguggcaaugaguggauuacugauuuugccgggaaaacggugugguucgugccgagcaucaaggcaggaaacgacaucgccaacuguuuaaggaaaaaugguaagaaagucauucaacugucucguaagaccuuugauacagaguaucagaagacuaaacuuaacgacugggauuucguagugaccacagacaucuccgaaaugggcgcuaauuuuaaggccgaucggguuauugacccuagaaggugccugaaacccgugauacucaccgaugggccagagcgcgucaucuuggcgggacccaugccugugacugcagccucagcugcccagcgaagaggccggguugguaggaacccacagaaggaaaaugaccaauacauuuucacggggcagccccugaacaaugaugaggaccacgcucauuggaccgaagcaaaaaugcuccuggacaacaucaauacaccugagggcaucauuccggcccuuuucgagccagaacgcgagaagagugcugccauagauggagaauaucgucuaaagggcgagagcagaaaaacuuuuguggaacugaugcggaggggggacuugcccgucugguuagcacacaagguggcguccgagggaaucaaauacaccgaucgcaaguggugcuucgacggucagcgaaacaaucagauucuggaggaaaacauggauguagagaucuggacaaaagaaggcgagaagaaaaagcucagaccucgguggcuggacgccaggaccuauucugauccccuugcucugaaggaauuuaaagacuucgccgcagggcgcaagucgauugcucucgauuuggugacugagaucggaagaguuccaacacaccuggcccauaggacgcggaaugcacuagacaaccuggucaugcuccacaccagcgagcauggcgguaaagccuaccgucacgcuguggaagagcuuccugaaacuauggagacacuguuauugcuggggcucaugauacugcuuaccggcggagcgaugcuguuucucaucucaggcaaggggauuggaaaaaccuccaucgguuugauuugugugaucgccaguucuggcaugcuguggauggcagagauacccuuacaauggauugcuagcgccaucguccuagaauucuuuaugaugguucugcucauuccagagccugaaaagcagcgcacaccgcaggauaaucaacuugccuaugugguaaucgggauacugacuuuggcagcuacgaucgccgcgaacgagaugggacugcucgaaaccacaaagcgagaccugggcauguccaaagagcccgguguggucucaccaacuucuuaccuugauguggaccuccacccugcuagcgccuggacccuguacgcaguugccacaaccgugauuacucccauguugagacauacgaucgagaauaguacagcuaacgucucccuggcagccauugcgaaccaggcuguaguguuaauggggcuagacaagggcuggccaaucagcaaaauggaucugggaguuccucuccuugcccugggcugcuauucucaggugaaucccuugacccugacugcagccguccuccugcuuauaacccacuacgcuauuaucgggccgggauuacaggccaaggcaacaagggaagcucaaaaacggacugccgcgggcaucaugaagaacccaaccguggacgguauuaugacaaucgaucuggacccugucauauaugauucaaaguucgagaaacagcucgggcaggugauguugcugguucuaugugccgugcagcugcuccuuaugcgcacguccugggcacugugcgaagcuuugacccuggccacuggacccauuacaacccucugggagggcaguccagguaaguuuuggaauacuacaaucgcaguaagcauggcuaacauuuucagaggcucguaccuggccggggccggauuagcguuuucugugaugaaauccgucggcaccgggaagaggggaacgggcagccaaggugaaacccuuggggagaaauggaagaagaaacugaaucagcucucacggaaggaguucgaccuauauaaaaagaguggaaucacagaaguugaucgaacugaggcuaaagaaggccugaagagaggugagauaacccaucacgcagugucucgcggcuccgccaaauugcagugguuugucgaaaggaacauggugauccccgaggggcggguaauugaccugggauguggccgugggggauggagcuacuauugcgcuggccucaagaaggugacagagguuagagguuacacuaaagggggaccuggccaugaagagccggugcccaugucaaccuacggcuggaauaucgucaagcuuaugagugggaaagauguguucuaucugccaccugaaaagugugacacauugcugugcgauauuggagagagcucccccucuccuaccgucgaggaaagcaggacuauccgcgugcucaaaaugguugagccaugguuaaagaacaaucaguucuguauuaagguacugaaccccuacaugccuacggugaucgaacaccuugagcggcugcaacgaaaacacgguggcaugcuagucagaaauccacucuccaggaacucaacacaugaaauguauuggauaucuaaugggaccggaaacauuguggccaguguuaauauggugucgcgccuguugcugaaccgguuuacuaugacccacagacgucccacaaucgagaaggacgucgaucucggcgcagguacgaggcaugugaacgccgagccggaaaccccuaauauggacguaaucggggagcggauuaaacgcauaaaggaagagcacaacagcacuuggcacuacgacgaugaaaauccauauaaaacaugggcuuaccauggauccuaugaggugaaggcgaccggcucugccucaagcaugaucaacggcguugucaagcuucugacuaaacccugggacguggugccuauggucacacagauggcaaugaccgauacaacuccauucgggcagcaacgaguuuuuaaggagaaaguggacaccagaacgcccagguccaugccgggaacccggcgcguaauggguauuacagcugaaugguuauggagaacucugggcaggaauaagaaaccucgauugugcacccgggaggaauucacaaagaaggugcguacuaacgccgcaaugggggccgucuuuaccgaggaaaaucagugggauagugcuaaagccgcgguggaggacgaggauuucuggaagcucguugacagagaacgcgagcugcacaaacuaggaaaguguggcucuugcguguacaacaugauggguaaaagggaaaagaaacuuggggaguuuggaaaggcaaagggcagccgggccaucugguacauguggcugggcgcuagauaucucgaguucgaagcccugggguuuuugaaugaggaucauugguucucacgcgaaaacuccuacaguggagucgagggugaaggccugcacaaacucggguauauucuuagggacaucagcaagauacccggaggcgcaauguacgcugaugacacggccgguugggacacacgaaucaccgaggaugaccugcauaaugaggaaaaaauuacucagcagauggauccagagcaccggcaauuagcuaacgccaucuuuaagcugacauaucagaauaaagugguaaagguucagagaccuacccccacugggaccgugauggacauuaucucuaggaaggaucagcgcggauccggccaagucggcacauacggguugaacacguucaccaauauggaagcacagcucauacgucagauggagggagaaggugugcugucaaaagcggaccuagagaacccacaccuucccgagaagaaaauuacucaguggcuggaaacaaagggcguggagcggcucaaaagaauggccaucagcggggaugacugcgucguuaagccuaucgaugacagguuugcuaacgcccuguuggcauuaaaugauaugggaaaggugcgcaaagacauuccacaauggcagccgucgaagggcuggcaugauuggcagcagguacccuucuguucucaccauuuccacgaacugauaaugaaagacggucgaaagcucguggucccuugccggccacaagacgagcuuaucgggagagcuaggauuagucagggagccggcuggucccugcgcgaaaccgcaugucuaggcaaagccuaugcgcagauguggagccugauguacuuucacagacgggaucucagguuggcuucaaacgccaucugcuccgcagugcccguucauugggugccuacuucucguacaaccuggagcauucacgcccaucaccaauggaugacgacagaggacaugcugaccgucuggaaucgaguguggaucgaggauaacccauggauggaagacaagacucccguaaccacaugggagaauguuccuuaccuugggaagcgcgaagaucagugguguggaagucugauaggucucacuuccagagcuaccugggcccagaacaucccgacagcaauucagcaagugcggagcuuaaucggcaaugaggaguuccuggacuauaugccaucuaugaaaagguuucgcaaggaagaggaaucagagggggcuauuugguga

SEQ ID NO: 15535 - RNA, 9873 nt, Artificial Sequence
  derived and/or modified CDS sequence (opt3) from DENV-3__FJ639817__SS-prME
acaagccugugccucaugaugauccuucccgccgcucuggcauuccacuugacauccagagacggagagccuaggaugauuguggggaagaacgaacggggaaaaucuuuacuguuuaagacugccucagguauaaauauguguacguuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacgucacgaccgauagccggugcccuacacagggcgaagcuguuuugccagaggaacaggaccagaauuauguguguaaacacacuuacguagaucgcgguugggggaacggaugcggccucuucggcaaggggagucuggugaccugcgccaaguuucaauguuuagagcccaucgagggaaaagucgugcaguaugaaaaucugaaguacacaguuauaauuacugugcauaccggugaccagcaccaggucggcaacgagacacaaggggugaccgcagaaaucacuccucaggcuuccacgacagaggccauucucccagaauauggaacccuuggccuggagugcucuccgcgaacugguuuggacuucaaugagaugauccuacugaccaugaaaaacaaggcguggaugguacauagacagugguuuuucgaucucccccugccuuggacaagcggggccaccacugaaacaccaacguggaauaggaaagagcuucugguuaccuuuaagaacgcacacgcuaaaaagcaagaaguggucguguugggcucccaggagggagccaugcacacugcucucacaggcgccaccgaaauccaaaauucagggggaacaaguauuuucgcaggucaucugaagugucgguuaaaaauggacaagcuggagcuaaaaggcaugagcuacgccaugugcacuaacaccuuuguccucaagaaagaggugucugaaacgcagcacgggaccauacugaucaagguugaguacaagggagaagaugugcccuguaaaauuccuuucuccacagaggacggccaagguaaggcucauaacgggcgucuuaucacugcgaauccaguagucaccaaaaaggaggaacccgugaacauagaggcagaaccgccuuucggcgagucaaauauuguuaucggaaucggcgauaacgccuugaaaauuaauugguauaagaaggggagcaguaucggaaaaauguuugaagcuacagcccgcggugcaagaaggauggccauucugggcgacacugcuugggauuucgggucugugggaggcguccucaacucccuggguaagauggugcaccagauauuugggagcgccuacaccgcacuuuucucgggcguaucuugggugaugaaaaucggaauuggcguucuguugacguggaucgggcucaauucccggaacacaucaaugaguuuuagcugcaucgcgauuggaauaaucacccuguauuuaggcgcugucgugcaggccgacauggguugugugauuaauuggaaggggaaagagcugaagugcggauccggcaucuucgucacuaacgagguucauacauggaccgaacaguacaaguuucaagcagauucucccaaacgacuagccacugcuauugccggugcaugggagaauggcgugugugggauccgcagcaccacaagaauggaaaaccuccuguggaagcagauagcuaaugagcuuaacuauaucuugugggaaaauaacauuaaacugacggugguagucggagacaucauuggcgugcucgagcaggggaagaggacccugacuccacagccuauggaguuaaaauacucauggaagacauggggaaaagccaagaucguuaccgcggaaacacaaaacaguuccuucauaauugauggccccaauacuccagagugccccagcgccucucgggcuuggaacgugugggaagucgaggacuaugguuuugggguguucaccacgaauaucuggcugaaacuucgcgaaguuuacacacaguugugugaccacagacucaugucagcagccgugaaagaugagagggcuguacacgccgacaugggauacuggauugagagucagaagaacggcagcuggaaacuggaaaaggcaucccuaaucgaggucaaaaccugcacuuggccuaagucucauacccuguggucgaauggugugcucgaaagcgauaugauaaucccaaagucccuggcgggcccgauuucacagcacaacuaucgucccggguaccauacacaaacugccggaccuuggcaccuuggcaaauuggagcuggacuuuaauuauugcgaggggaccacaguggucaucacggaaaacuguggaacccggggcccaaguuuacgaacuacaaccguuucugguaagcucauucacgaguggugcuguagaagcugcacucugcccccucuuagguacaugggggaagauggauguugguauggcauggagauccgcccaauauccgaaaaagaggagaauauggugaagucacugguaagcgcugguucuggcgaaguggacaacuucacaaugggggucuugugccucgccauucuguuugaggaagugaugcggggaaaauucggcaagaagcauaugaucgcagggguuuucuuuaccuucgugcuacugcucuccggacagaucacguggagagauauggcucacacucugauuaugaucggcaguaaugccagcgacaggauggguaugggggucaccuaccuugcauugauugccacauuuaaaauacagcccuuccuggcuuuaggauuuuuccuccgcaagcugaccucucgagagaaccuucugcuaggcgugggccucgcgauggccacuacacugcaauugccggaagauaucgagcagauggcaaaugggauugcucugggauuaauggcccucaaacugaucacccaguuugagacauaucagcuuuggacugcccugauuuccuugaccuguucaaacacgaucuucacacucaccguugcuuggcggacugcaacccugauacuagccggugugagucugcuuccugucugccaaagcucguccaugcguaagacagacuggcucccaaugacuguagcggcuaugggcgugcccccucugcccuuguuuaucuucucucugaaagauaccuuaaagagaaggagcuggccacucaaugaagggguuauggccgugggacuggucucaauucuugcaaguucccuguugcgcaacgacgugccuauggccggcccccucguagcuggugggcugcuaaucgcauguuacgugauuacgggaacaucugccgaucugaccgucgagaaggcggcugacguuacuugggaagaggaagccgagcagacaggcgugagccauaaccuuaugaucaccguggacgaugacggcacuaugcggauaaaagaugacgagacagaaaauauucucaccguccuguugaagacggcauuacugaucguguccgggaucuuuccauacucaauuccggccacucuccugguuuggcacaccuggcagaaacagacacaaagaagcggaguacuuugggaugugccuagucccccagagacccagaaggcugaacuggaggagggugucuauaggauaaaacagcagggcaucuucgggaagacacaagugggaguuggcgugcagaaagaaggugucuuucauacuauguggcacgugacccgaggggccguauugacguacaacggaaagcgccuagagcccaauugggcaucugucaagaaagaccugauuuccuauggcggcggguggcggcucagcgcucaguggcaaaagggagaagaggugcagguuaucgccguggaaccugguaaaaacccaaagaauuuccagacaaugcccggcacuuuccagaccacaaccggggagauuggagcgaucgcccuggauuuuaaaccuggcacuucggguucaccgauaaucaacagagaggggaaggucgugggacuuuacggcaauggcguugugaccaagaacgggggauaugucucugguauugcacaaacaaaugcugaaccagacggccccacgccugaguuagaagaggaaauguucaaaaagaggaaccugacuaucauggaucuccacccagggaguggaaaaacccguaaguacuugcccgccauugugcgcgaggcuaucaaacggagacugaggacacucauacuggcaccuacccgaguaguggccgccgagauggaagaggcucuuaagggccugccgauucgguaucagacuacagcgaccaaguccgaacauacgggucgcgagaucguugacuugaugugccacgcaacuuuuacaaugagacuacugagccccgucagggugccaaauuacaaccucaucauuauggaugaagcccauuucaccgacccugcuucuaucgccgcacggggguacauaagcacccgagugggaaugggcgaggccgcugcgauuuuuaugacugccacacccccaggcaccgcagaugcuuucccucaguccaaugcccccauccaggacgaggaaagagacauuccagagcgcucauggaacagugggaaugaauggaucacagauuuugcaggaaaaacugucugguucguaccgagcauaaaggccgguaacgacauugcuaacuguuuaaggaaaaauggcaagaaagugauccaacugucucguaagacguuugauaccgaguaucagaagacaaaacuuaacgacugggauuucguugugacuaccgacaucuccgagaugggggccaauuuuaaggcggaucgggucauugacccuagaaggugccugaaacccgugauccucacagauggaccagaacgcguuauuuuggcaggccccaugccugugaccgccgcuucagccgcucagcgaagaggucgggucgggaggaacccacagaaggagaaugaccaauacauauucacuggccagccccugaacaaugaugaagaccacgcacauuggacggaggccaaaaugcuccuggacaacaucaauaccccugaaggaauuaucccggcucuuuucgagccagagcgcgaaaagagugccgcaaucgauggcgaguaucgucuaaagggggaaagcagaaaaacauuuguggagcugaugcggaggggagacuugcccguaugguuagcgcacaagguggccuccgaagguauuaaauacacugaucgcaaguggugcuucgacggccagcgaaacaaucagauacuggaggagaacauggauguugaaaucuggaccaaagagggggaaaagaaaaagcucagaccucgguggcuggacgcuaggacauauucugauccccuugcccugaaggaguuuaaagacuucgcagcuggacgcaagucgauugcccucgauuuggucaccgaaaucggcagagugccaacucaccuggcacauaggacacggaaugcccuagacaaccuggugaugcuccacacgagcgagcauggugggaaggcuuaccgucacgcggucgaggaacuuccugagaccauggaaacucuguuauugcugggccucaugauucugcuuacaggaggcgccaugcuguuucucaucucagggaagggaauagguaaaaccuccaucggcuugauuuguguuaucgcaaguucugggaugcuguggauggcugagauucccuuacaauggaucgccagcgccauagugcuagaguucuuuaugaugguacugcucauuccagaaccugagaagcagcgcaccccgcaggauaaucaacuugcauauguggucaucggcauucugacauuggcugccaucauagcggcuaacgaaaugggccugcucgagacuacgaagcgagaccuggguauguccagagaacccggggugguuucaccaaccucuuaccuugauguggaccuccacccugccagcgcauggacacuguacgccgucgcuacuaccguaaucacacccauguugaggcauaccauugagaauaguacugcaaacgugucccuggccgcgaucgcuaaccaggccguuguguuaaugggccuagacaaaggauggccaauuagcaagauggaucugggcgucccucuccuugcacuggggugcuauucucaggugaaucccuugacgcugacagccgcuguccuccugcuuaucacccacuacgccauaauuggaccgggcuuacaggcaaaagcuacucgggaggcccaaaagcgcaccgcggccgguaucaugaaaaacccaacaguggacgggaucaugacuauugaucuggacccuguuaucuaugauucaaaguucgaaaagcagcucggacaggugauguugcugguacuaugugcagugcagcugcuccuuaugagaaccuccugggcucugugcgaggccuugacacuggcaacgggccccauaaccacucucugggaagguaguccaggcaaauuuuggaauacaaccauugcugucagcauggccaacaucuucagggggucguaccuggccggagcgggcuuagcuuuuucuauuaugaaguccguugggacuggaaaacggggcacagguagccaaggggagacccuuggagaaaaguggaaaaagaagcugaaucagcucucacgaaaagaguucgaccuauauaagaaaaguggcaucacggagguggauagaaccgaagcaaaggagggucugaaacgcggcgaaauaacacaucacgccgucucuaggggguccgcuaaguugcagugguuuguggagcggaacaugguaauccccgaaggacgugugauugaccugggcugugggagaggaggcuggagcuacuauugcgccggucucaaaaagguuacugaggugaggggguacaccaagggaggcccuggccaugaggaaccgguccccaugucaacauacggguggaauaucgugaaacuuaugaguggaaaggaugucuucuaucugccaccugagaaaugugacacuuugcugugcgauauuggugaaagcucccccucuccuaccguggaggagagccgcacaauccggguucucaagaugguagaaccauggcuaaagaacaaucaguucuguauuaaggugcugaaccccuacaugccugcagucaucgagcaccuugaacgacugcaaagaaagcacggcgggaugcuagugaggaauccacucucccgcaacucaacccaugagauguauuggauaucuaauggaacuggcaacauuguugccagugugaauauggucucgcggcuguugcugaacagauuuacgaugacacaccguaggcccaccaucgaaaaagacguggaucucggugcugggacucggcauguaaacgcggagccggagaccccuaauauggacgugaucggagaacgcauuaagcgaauaaaagaggaacacaacagcacauggcacuacgacgaugagaauccauauaagacgugggccuaccauggcuccuaugaaguuaaagcaaccggcucugcuucaagcaugaucaacggggucgugaaacuucugacuaagcccugggacguggucccuaugguuacacagauggccaugaccgauacuacaccauucggacagcaaagaguguuuaaagagaagguagacaccaggacaccccgguccaugccggguacucgcagagugaugggcauuaccgcagagugguuauggaggacgcuggggcgaaauaaaaagccucgguugugcacccgugaagaguucaccaagaaggucagaacuaacgccgcuaugggagccguguuuaccgaagagaaucagugggauagugcgaaggcagccguugaagacgaggauuucuggaaacucguggaccgcgagagggaacugcacaagcuaggcaaaugugguucuugcgucuacaacaugauggggaagcgggagaagaaacuuggagaauuuggcaaagcuaaaggcagcagagccaucugguacauguggcugggggcacgcuaucucgaguucgaggcucugggauuuuugaaugaagaucauugguucucaagggagaacuccuacagugguguggaaggcgaggggcugcacaagcucggauauauucuucgagacaucagcaaaauacccggcggugccauguacgcugaugacacagccgggugggacacucggaucaccgaagaugaccugcauaaugaggagaagauuacgcagcagauggauccagaacacagacaauuagcaaacgcgaucuuuaaacugacauaucagaauaagguaguuaaagugcagaggccuacccccacuggaacagucauggacauuaucucucgcaaggaucagcguggcuccggccaaguggggaccuacggauugaacacuuucaccaauauggaggcccagcucauacggcagauggaaggugagggcgugcugucaaaggcugaccuagaaaacccacaccuucccgagaaaaagauuacacaguggcuggagacgaaaggggucgaaagacucaagaggauggccaucagcggagaugacugcguugugaaaccuaucgaugaccgcuuugcaaacgcucuguuggccuuaaaugauaugggcaagguacgaaaggacauuccacaauggcagccgucgaaagguuggcaugauuggcaacaggugcccuucuguucucaccauuuccacgagcugauaaugaaggacgggcggaaacucgucgugccuugcagaccacaagacgaacuuaucggaagggcacgcauuagucagggcgccggcuggucccugagagagaccgcgugucuagggaaggcuuaugcccagauguggagccugauguacuuucaccggagggaucuccguuuggcaucaaacgccaucugcuccgcuguucccgugcauugggucccuacuucucgaacaaccuggagcauucacgcccaucaccaauggaugacuacagaagacaugcugaccguguggaaucgcguauggaucgaggauaacccauggauggaggacaaaacgcccguuacaaccugggaaaaugugccuuaccuuggaaagagagaggaucaguggugugguagucugauaggccucacuucccgggcaaccugggcucagaacaucccgacagccauucagcaagucaggagcuuaaucgggaaugaagaguuccuggacuauaugccaucuaugaagcgcuuuagaaaagaggaagagucagaaggagcgauuugguga

SEQ ID NO: 15536 - RNA, 9873 nt, Artificial Sequence
  derived and/or modified CDS sequence (opt3) from DENV-3__FJ639825__SS-prME
accagccugugccucaugaugauccuucccgccgcucuggcauuccacuugaccuccagggacggcgaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcagguagaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggauuacaagggagaggacguucccuguaaaaucccuuucuccacagaagauggccaagguaaggcucauaacgggcgucuuauaacugcgaauccagugguaaccaaaaaggaggagcccgucaacauugaagcagagccgccuuucggcgaaucaaauaucgugaucggaauuggcgacaacgccuugaaaaucaauugguauaagaaggggagcaguauuggaaaaauguuugaggcuacagcccgcggugcaagaaggauggccauacugggcgauacugcuugggacuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgauacugguugugugaucaauuggaaagggaaggaacugaagugcggauccggcauuuucgugacaaacgagguccauaccuggacugagcaguacaaauuucaagcagacucucccaagcggcuagccaccgcuaucgccggugcaugggaaaauggcguuugugggauacgaagcacaacgcgcauggagaaccuccuguggaaacagaucgcuaaugaacuuaacuauauuuugugggagaauaacaucaagcugaccguggugguaggagauauuaucggcguccucgaacaggggaaaagaacucugacaccacagccuauggaguuaaaguacucauggaaaaccuggggaaaggccaagauagugacagcggagacucaaaacaguuccuucauuaucgacggccccaauaccccagaaugccccagcgccucuagggcuuggaacguuugggagguggaagacuaugguuuuggggucuucacgacaaauauuuggcugaaacuucgggagguguacacccagcagugugaucaccgcuugaugucagcagccguuaaggacgaaagagcugugcacgccgauaugggauacuggaucgagagucagaaaaacggcagcuggaagcucgagaaagcaucccugauagaaguaaagacuugcaccuggccuaagucucauacacuauggucgaaugguguccuggagagcgacaugaucauuccaaaaucccucgcgggcccgaucucacaacacaacuauaggcccggguaccauacucagaccgccggaccuuggcaccugggcaaacuugaauuggauuuuaauuauugcgaggggacaacgguggugauuaccgagaacuguggaacucguggcccaagucugcggacaaccacugucucugguaaauuaauccacgaauggugcugucgaagcugcacacucccaccucugagauacaugggggaggacggauguugguauggcauggaaauaaggccaauuuccgagaaggaagagaauaugguuaaaucacuugugagcgcugguucuggcgagguagauaacuucaccaugggggugcugugcuuggccauccucuuugaagaggucaugcgcggaaaguucggcaagaaacauaugaucgcagggguguucuuuacguucguucugcuacuguccggacagauuacuuggcgggacauggcucacacccucaucaugauuggcaguaaugccagcgauagaauggguaugggggugacauaccuggcacuuauagccaccuuuaagauccaacccuucuuggcucugggauuuuucuuaaggaaacucacuucucgcgaaaaccugcuucugggcgucggccuagcgauggccacaacccuccagcugccggaggacauugaacagauggcaaaugggaucgcuuugggacugauggccuuaaagcucauuacacaguuugagacuuaucaacuguggaccgcccuuaucucccugacguguucaaacacaauauucaccuugacuguggcuuggcgaaccgcaacacucauccuggccgguguuagucuacugccugugugccagagcucguccaugcggaaaacugauuggcuuccaaugaccgucgcggcuaugggcguacccccucucccccuguuuauuuucucuuugaaggacacgcugaagcguagaagcuggccauuaaaugagggggugauggccguuggacucgugucaauccuggcaaguucccuucugaggaacgaugucccuauggccggccccuugguggcuggugggcuccugauugcauguuacguaaucacaggaaccucugccgaccuaacuguggaaaaagcggcugacgucacaugggaggaagaggccgaacagaccggcguuagccauaaccugaugauaacuguggaugacgauggcacaaugcgcauuaaggacgaugagaccgagaauauccuuacggugcuccugaaaacugcauuguuaaucgucuccgggauuuuuccauacucaauaccggccacccugcucguguggcacacauggcagaagcaaacccagcggagcggaguucugugggacguaccuagucccccagaaacacagaaagcugagcuugaagaggguguguauagaaucaagcagcaaggcauuuucgggaaaacucaggucggagugggcguucagaaggaggguguguuucauaccauguggcacgucacgagaggggccgugcugacauacaacggaaagcgauuggaacccaauugggcaucugucaagaaggaucuaaucuccuauggcggcggguggcgccugagcgcucaauggcagaaaggagaggaaguccaggugauugccguugagccugguaagaaccccaagaauuuccagacuaugcccggcaccuuccaaacaaccacuggggaaaucggagcgauagcccucgacuuuaagccuggcaccucggguucaccgaucauuaaccgggaggggaagguggucggacuguacggcaauggcgugguuaccaagaacgggggauaugugucugguaucgcacagacgaaugcugagccagauggccccacuccugaacuugaggaagagauguucaagaaaagaaacuuaaccauuauggaccugcacccagggaguggaaagacaaggaaauaccuccccgccaucguccgugaagcuauaaagcgccgguugagaacccugauucucgcaccuacuagggugguagccgccgagauggaggaagcucugaagggccuuccgauccgauaucagacaaccgcgacgaaauccgagcauacuggucgggaaaucguggaucugaugugccacgcaacauuuaccaugcgcuugcuaagccccguuagagucccaaauuacaaccugauuaucauggacgaggcccauuucaccgauccugcuucuauagccgcaaggggguacauuagcacucgggugggaaugggcgaagccgcugcgaucuuuaugacagccacacccccaggcacagcagacgcuuucccucaguccaaugcccccauucaagacgaggagcgagauaucccagaaagaucauggaacagugggaaugaguggauaacugacuuugcaggaaagacggugugguucgucccgagcauuaaagccgguaacgauaucgcuaacugucuccgcaagaauggcaaaaagguaauccaguuaucuaggaagaccuuugacacagaauaucagaaaacuaagcugaacgauugggacuucgugguuaccacagauauuuccgagaugggggccaauuuuaaagcggaccgugugaucgauccucggagaugccuuaagcccgucauucugaccgacggaccagagagggugauacucgcaggccccaugccuguuacugccgcuucagccgcucagcgccgagguagaguggggcggaacccacaaaaagaaaaugaucaguacaucuucacgggccagcccuugaacaaugacgaggaccacgcacauuggaccgaagccaagaugcugcucgauaacauuaauacaccugagggaaucaucccggcucuguucgaaccagagagggagaagagugccgcaauugacggcgaauaucgccuuaaaggggagagccguaagacuuuugucgaacuaaugagacggggagaucugcccgugugguuggcgcacaaaguagccuccgaggguauaaaguacaccgacaggaaauggugcuucgauggccagcgcaacaaucaaaucuuagaagagaacauggacguggagauuuggacaaaggaaggggagaaaaagaagcugcgaccuagauggcucgaugcucggaccuauucugacccccuggcccuuaaagaauuuaaggauuucgcagcuggaaggaaaucgaucgcccuggaccucguuacugagauuggccgcgucccaagccacuuggcacauagaacaaggaaugcccuggauaaccuagugaugcugcacacgucagaacauggugggaaggcuuaccggcacgcgguggaggagcucccugaaaccauggagacucuucuguuauugggccugaugauccuccugacaggaggcgccaugcuuuuucugauauccgggaaaggaaucgguaagaccaguauuggccucaucugugucauugcaucuagcgggauguuguggauggcugaaaucccccugcaguggauagccuccgccauuguuuuagaguucuuuaugauggugcuacugaucccagagccugaaaagcagcguaccccgcaagacaaucagcucgcauauguagugauuggaauccuuacacuggcugccauaaucgcggcuaacgagaugggcuugcuggaaacuacgaaacgcgaucucgguaugucaaaggagcccggggucgugucuccaaccagcuaccuggacguugaccuucacccugccagugcauggacacucuacgccguggcuacuaccgucauuacacccaugcugcgacauaccaucgaaaauuccacugcaaacgucagcuuggccgcgauugcuaaccaggccgugguucugaugggcuuagauaaaggauggccaaucucuaagauggaccuaggcgugccucugcucgcacuugggugcuauucacaggucaauccccugacguugacagccgcugugcugcuccugauaacccacuacgccauuaucggaccgggccuucaagcaaaagcuacuagagaggcccagaagaggaccgcggccgguaucaugaagaacccaacagucgaugggauuaugacuaucgacuuagauccugugauauaugacuccaaauucgagaagcagcugggacagguuaugcucuuggugcugugugcaguacaacuacugcucaugcggaccaguugggcucuuugcgaagcccugacauuggcaacgggccccauuaccacucugugggaggguagcccaggcaaauuuuggaauacaaccaucgcugugucgauggccaacauuuuccgcgggucuuaccucgccggagcgggccuggcuuuuuccaucaugaaaagcgucgggacuggaaaaagaggcacagguucacagggggaaaccuuaggagagaaguggaagaagaaacuuaaucagcugaguaggaaagaguucgaucucuauaagaaaucuggcauaacggagguugaccggaccgaggcaaaagaaggucuaaaacgaggcgagaucacacaucacgccguguccagagggagcgcuaagcugcagugguuugucgaacgcaacauggugauucccgagggaaggguaaucgauuugggcugugggcggggaggcuggucauacuauugcgccggucugaagaaagugacugaaguucguggguacaccaagggaggcccuggccaugaggagccggugcccaugaguacauacggguggaauauugucaaacucaugagcggaaaggacguguucuaucuuccaccugaaaaaugugauacucuguugugcgacaucggugaguccucucccagcccuaccgucgaagaguccagaacaauuagggugcugaagaugguugagccauggcucaagaacaaucaauucuguaucaaaguauuaaaccccuacaugccuaccgugauagaacaccuggagcgccuucagcggaagcacggcgggaugcugguccgaaauccacuaucaagaaacucuacucaugaaauguauuggauuaguaauggaacgggcaacaucguggcaucgguuaauauggugagcaggcuccuguugaaccgcuuuacaaugacccaccggagacccacuaucgagaaagaugucgaccugggugccgggacccgucaugugaacgcugaaccggagacaccuaauauggacguaauuggagagaggauaaagcggaucaaagaagaacacaacuccacguggcacuacgaugacgaaaauccauauaagaccugggcguaccauggcucuuaugaggugaaggccacuggcucagcaagcuccaugauuaacgggguugucaaacuccuuacaaagcccugggauguggugccuauggucacccagauggcuaugacugacacaaccccauucggacaacagcgcguuuuuaaagaaaagguggauacacgaacucccagaaguaugccggguaccaggcggguaaugggcaucacggccgaguggcuguggcgcaccuuagggagaaauaaaaagccuaggcugugcacacgagaggaguucacuaagaaagugcggaccaacgcagccaugggagcugucuuuacagaggaaaaucagugggacucugccaaggcggcaguggaggaugaagacuucuggaaauugguugaucgugagagagagcuccacaagcugggcaaaugugguagcugcguguacaacaugauggggaagcgcgagaaaaagcuaggagaguuuggcaaggccaaaggcucaagggcuauuugguacauguggcuuggggcccgguaucuggaguucgaggcacucggauuucugaaugaggaccauugguucuccagagaaaacaguuacagcggugucgagggcgaaggguugcacaagcugggauauauccuccgcgauauaucuaaaauccccggcggugcuauguacgccgacgacacugcugggugggauaccaggauuacggaggacgaucuucauaaugaagagaagaucacacagcaaauggacccagagcacaaacagcuggccaacgcaauuuuuaaguuaaccuaucagaauaaggugguaaaaguucagcgaccuacucccacaggaaccgugauggauaucauaucccggaaggaccaaagaggcucaggccaggucgggacuuacggacugaacaccuucacaaauauggaagcgcaguugauuaggcagauggagggugaaggcgugcucagcaaagccgaucuggagaacccacaccuacccgaaaagaaaaucacgcaauggcuugagaccaaggggguggagcgccugaagcguauggcuaucucgggagacgauugcgucguuaaaccuauugacgaucgguuugccaacgcacuccuggcuuugaaugacaugggcaaggugagaaaagauauaccacaguggcagccgucuaaggguuggcaugacuggcagcaaguacccuucuguagucaccauuuccacgaauuaaucaugaaagacgggaggaagcugguggucccuugccgcccacaggaugagcucauuggacgagcccggaucucccagggcgcaggcuggagccuuagagaaacugccugucuggggaaggcguaugcucaaauguggucacuaauguacuuucacaggcgcgaccugagacucgccuccaacgcaauuugcucugccgugcccguucauugggugccuacaagccggaccacuuggaguauccacgcucaucaccaguggaugacaaccgaggauauguugacggucuggaauaggguguggauagaagacaacccauggauggaggauaaaacacccguaaccacuugggagaauguuccuuaccugggaaagcgugaagaccaguggugugguucccuuaucggccugaccagccgagccacaugggcacagaacauuccgacugcuauccaacaggugcgcucucucauugggaaugaggaguucuuagauuauaugccaucaaugaaaagauuucggaaggaggaggaaagugagggagccaucugguga

SEQ ID NO: 15537 - RNA, 9873 nt, Artificial Sequence
  derived and/or modified CDS sequence (opt3) from DENV-3__FJ639826__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaggauagugacagcggaaacucaaaacaguuccuucauuaucgauggccccaauaccccagagugccccaacacgagccgggccuggaauguuugggaaguggaggacuaugguuuuggggucuucacaaccaacauuuggcugaagcuucgcgaaguguacacucaguugugugaccacagacucaugucugcugcaguuaaagaugagagggccgugcacgcugacaugggauacuggaucgagucacagaagaauggcaguuggaaacuggaaaaggccagccuaauagagguaaaaaccugcacauggccuaagucccauacucuguggucuaacgguguccucgaaucggauaugaucauuccaaagagccuggcaggcccgaucucccagcacaauuaucgucccggguaccauacccaaacagcgggaccuuggcaccuuggcaaauuggagcuggacuuuaacuauugcgaggggacgaccguggugauuacugaaaauuguggaacacggggcccaucauuacgaaccacuacagucagugguaagcucauccacgaguggugcuguagaucuugcacccugcccccucuuagguacaugggggaagauggauguugguauggcauggagauacgcccaauuagcgaaaaagaggagaacaugguuaagucccuggugucagccgguagcggcgaaguagacaauuucacgauggggguguugugccucgcuauccuguuugaggaagucaugcggggaaaauucggcaagaagcauaugaucgccgggguguucuuuacuuucguucuacugcucucuggacagauuaccuggagagauauggcacacacacugaucaugauuggcuccaacgcuaccgacaggauggguaugggggugacuuaccuugccuugauagcaacauuuaaaauccagcccuuccuggccuuaggauuuuuccuccgcaagcugaccagucgagagaaucuucugcuaggcgucggccucgcuauggcgacaacucugcaauugccggaagauauugagcagauggccaacgggaucgcacugggauuaauggcucucaaacugauuacccaguuugagacguaucagcuuuggacagcccugaucagcuugaccuguucuaauacuauauucacccucacaguggccuggcggacugcuacccugauccuagcagguguuucccugcuuccugugugccaaucaaguagcaugcguaagacggacuggcucccaaugacagucgccgcgaugggcguacccccucugcccuuguuuauuuucucgcugaaagauaccuuaaagagaagguccuggccacucaacgaaggggugauggcuguuggacuggugucuauccuugccagcucacuguugcgcaacgacgucccuauggcaggcccccucguggccggugggcugcuaauugcuuguuacguaaucacuggaacaagugcagaucugaccguggagaaggccgcggacgucacuugggaagaggaagcugagcagacaggcguuucccauaaucuuaugauaaccguggacgaugacggcacgaugcggauuaaagaugacgagacugaaaacauccucaccgugcuguugaagacagccuuacugaucgucucugggauuuuuccauacagcauaccggcaacccuccugguguggcacacauggcagaaacagacucaaagauccggaguucuuugggauguaccuucacccccagagacccagaaggccgaacuggaggaggguguguauaggaucaaacagcagggcauuuucgggaagacgcaagucggagugggcguucagaaagaagguguguuucauacaauguggcacgucacucgaggggcuguguugaccuacaauggaaagcgccuagagcccaacugggccagcguaaagaaagaccugaucaguuauggcggcggguggcggcucucugcacaguggcaaaagggagaagagguccaggugauugcuguugaaccugguaaaaauccaaagaacuuccagacaaugcccggcaccuuccagacuaccacaggggagaucggagccauagcgcuggauuuuaaaccuggcacguccgguagcccgaucauuaauagagaggggaagguggucggacuuuacggcaacggcgugguuacuaagaaugggggauaugugucggguaucgcccaaaccaacgcagaaccagacggccccacaccugaguuagaagaggaaauguucaaaaagaggaaucugaccauuauggaucuccacccagggucaggaaaaacucguaaguacuugcccgcuaucguccgcgaggccauaaaacggagacugaggacacucauucuggcuccuacccgagugguagcagccgagauggaagaggcccuuaagggccugccgauccgguaucagacgacugcuacaaagucugaacauaccggucgcgagaucguggacuugaugugccacgcgaccuuuacuaugagacuacugagucccguuagggucccaaacuacaaucucauuaucauggaugaagcacauuucacagacccugccuccauagcugcccggggguacauuagcacccgagugggaaugggcgaggcagccgcuaucuuuaugacagcgacucccccaggcacggccgaugcauucccucagucuaacgcucccauucaggacgaggaaagagacaucccagagcgcagcuggaauuccgggaacgaauggauaaccgauuuuacaggaaaaacugugugguucgucccgucaauuaaggccgguaacgacaucgcaaauuguuuaaggaaaaacggcaagaaaguaauccaacugagucguaagaccuuugauacagaguaucagaagaccaaacuuaaugacugggauuucgugguuacuacggacauuagcgagaugggggccaacuuuaaggcugaucgggugaucgacccuagaaggugccugaaacccgucauucucaccgauggaccagaacgcgugauauuggccggccccaugccuguuacagcggcaucugccgcucagcgaagaggucggguggggaggaauccacagaaggagaacgaccaauacaucuucacuggccagccccugaauaacgaugaagaccacgcccauuggaccgaggcuaaaaugcuccuggacaauauuaacacaccugaaggaaucaucccggcacuuuucgagccagagcgcgaaaaguccgccgcuauugauggcgaguaucgucuaaagggggaaucaagaaaaaccuuugucgagcugaugcggaggggagacuugcccgugugguuagcccacaagguagcaagugaagguauaaaauacacugaucgcaaguggugcuucgacggccagcgaaauaaccagauccuggaggagaauauggauguggaaauuuggacaaaagagggggaaaagaaaaagcucagaccucgguggcuggacgcgaggacguauagcgauccccuugcccugaaggaguuuaaagacuucgcugccggacgcaaguccaucgcacucgauuugguuaccgaaauuggcagagucccaacucaccuggcucauaggacacggaacgcccuagacaaucuggugaugcuccacaccucugagcauggugggaaagcauaccgucacgccguggaggaacuuccugagaccauggaaacacuguuauugcugggccucaugauccugcuuacuggaggcgcuaugcuguuucucauaucggggaagggaaucgguaaaacgagcauuggcuugaucugugucauugcgucauccgggaugcuguggauggccgagauccccuuacaauggauagcaagugcuauuguucuagaguucuuuaugauggugcugcucaucccagaaccugagaagcagcgcaccccgcaggauaaccaacuugccuauguagugauuggaauccugacauuggccgcaauaaucgcugccaaugaaaugggccugcucgagacuaccaagcgagaccuggguaugucuaaagaacccggggucgugagcccaacauccuaccuugauguugaccuccacccugcgucagcuuggacccuguacgccguggcaacuacggucauuacacccauguugagacauaccaucgagaacucuacugccaacguaagccuggcugcaauugccaaucaggcggugguuuuaaugggccuagacaagggauggccaaucaguaaaauggaucugggcgugccucuccuugcucuggggugcuauucccaggucaaccccuugacccugacagccgcagugcuccugcuuauaacucacuacgccauuaucggaccgggcuuacaggcuaaggccaccagggaggcacaaaaacggacagcugccgguaucaugaagaauccaacggucgacgggauuaugaccaucgaucuggacccugugauauaugauagcaaguucgaaaaacagcucggacagguuauguugcuggugcuaugugcgguacagcugcuccuuaugcgcacuucuugggcccugugcgaggcauugacacuggcuaccggccccauuacuacacucugggaagguucaccaggcaaguuuuggaacaccacgaucgccguguccauggcaaauauuuucagagggaguuaccuggcuggagccggcuuagccuuuagcaucaugaaaucggucgggaccggaaagaggggcacagguucucaaggggagacucuuggagaaaaauggaagaagaaacugaaccagcucucccggaaggaguucgaccuauauaaaaagagcggcauaaccgagguugaucgaacagaagcgaaagagggucugaagagaggcgaaaucacucaucacgcugugucacgcgggagugcaaaauugcagugguuugucgagaggaauauggugauucccgaaggacggguaaucgaccugggcugugggcguggaggcuggucuuacuauugcgccggucucaagaaggugaccgagguuagaggguacacaaaaggaggcccuggccaugaggaaccggugcccauguccaccuacggguggaacauugucaagcuuaugagcggaaaagauguguucuaucugccaccugagaagugugacacuuugcugugcgauaucggugaaucaagucccagcccuacggucgaggaguccaggacaauucgcgugcucaaaaugguugaaccaugguuaaagaauaaccaguucuguaucaagguacugaaucccuacaugccugcugugauagagcaccuugaacggcugcaacgaaaacacggcgggaugcuagucagaaacccacucucuaggaauagcacccaugagauguauuggauuuccaacggaacuggcaauaucguggccucaguuaacauggugucucgccuguugcugaaccgguuuaccaugacacacagacgucccacgaucgaaaaggacgucgaucucggugcagggaccaggcaugugaaugccgagccggagacuccuaacauggacguaauuggagaacggauaaaacgcaucaaggaggaacacaauaguacauggcacuacgacgaugagaacccauauaaaaccugggcuuaccauggcucguaugaagugaaggcgacuggcagcgccuccucuaugauuaaugggguugucaagcuucugacaaaacccugggacguggugccuauggucacccagauggcaaugacagauacuaccccauucggacagcaacgaguuuuuaaggagaaaguggacacgagaacccccaggucaaugccggguacacggcgcguaauggagaucacugcugaaugguuauggagaacccugggcaggaacaagaaaccucgauugugcacacgggaggaauucacuaagaaggugcguaccaaugccgcaaugggggccgucuuuacggaggaaaaccagugggauagcgcuaaagccgcgguggaggacgaggauuucuggaagcucguugacagagaacgcgagcugcacaaacuaggaaaguguggcuccugcguguacaauaugauggguaaaagggaaaagaaacuuggggaguuuggaaaggcaaagggcagucgggccauuugguacauguggcugggcgcuagauaucucgaguucgaagcccugggguuuuugaacgaggaucauugguucucucgcgaaaauagcuacucaggagucgagggugaaggccugcacaaacucggguauauccuuagggacauauccaagauccccggaggcgcaauguacgcugaugacacagccgguugggacacccgaauuacugaggaugaccugcauaacgaggaaaaaaucacacagcagauggauccagagcaccggcaauuagcuaaugccauuuuuaagcugaccuaucagaacaaagugguaaagguucagagaccuacucccaccgggacagugauggacaucauaaguaggaaggaucagcgcggaagcggccaagucggcacguacggguugaauaccuucacuaacauggaagcacagcucauucgucagauggagggagaaggugugcugucuaaagcggaccuagagaacccacaccuucccgagaagaaaaucacacaguggcuggaaaccaagggcguggagcggcucaaaagaauggccaucuccggggaugacugcgucguuaagccuauugaugacagguuugcuaaugcccuguuggcauuaaacgauaugggaaaggugcgcaaagacauaccacaauggcagccgucaaagggcuggcaugauuggcagcagguacccuucuguagccaccauuuccacgaacugaucaugaaagacggucgaaagcucguggucccuugccggccacaagacgagcuuauugggagagcuaggaucucgcagggagccggcuggucucugcgcgaaacugcaugucuaggcaaagccuaugcgcagauguggagucugauguacuuucacagacgggaucucagguuggcuuccaaugccauuugcagcgcagugcccguucauugggugccuacaucacguaccacgugguccauccacgcccaucaccaauggaugacaaccgaggacaugcugacugucuggaaccgaguguggauagaggauaauccauggauggaagacaagacccccguaacaacuugggagaacguuccuuaccuugggaagcgcgaagaucagugguguggaucucugaucggucucaccagcagagcuacaugggcccagaauauuccgacggcaauccagcaagugcggaguuuaauuggcaacgaggaguuccuggacuauaugccauccaugaaaagguuucgcaaggaagaggaaagcgagggggcuaucugguga

SEQ ID NO: 15538 - RNA, 9873 nt, Artificial Sequence
  derived and/or modified CDS sequence (opt3) from DENV-3__FJ810416__SS-prME
accagccugugccucaugaugauccuuccagccgcucuggcauuccacuugacuuccagagacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugaugaccgaaauuggccgcguuccaagccaccuggcacauagaacuaggaaugcccuagacaaccuggucaugcuccacacaucagagcauggugggaaggcuuaccggcacgcgguggaggaacuuccugagacgauggaaacccuguuauugcugggccucaugauccugcuuacuggaggcgccaugcuguuucucauauccgggaaaggaaucgguaagacaaguauuggcuugaucugugugauugcaucuagcgggaugcuguggauggcugagauccccuuacaauggauagccuccgccauuguccuagaguucuuuaugaugguucugcucaucccagaaccugagaagcagcguaccccgcaggauaaucaacuugcauaugugguaauuggaauccugaccuuggcugccauaaucgcggcuaacgaaaugggccugcucgagacaacuaaacgcgaccuggguaugucaaaggaacccgggguggucucuccaacgagcuaccuugauguggaccuccacccugccagugcauggacccuguacgccguugcuacaacugugauuacccccauguugcgacauacaaucgaaaauuccaccgcaaacgucagccuggccgcgauugcuaaccaggccguaguguuaaugggccuagacaaaggauggccaaucucuaagauggaucugggcguuccucuccuugcacuggggugcuauucacaggugaaucccuugacucugacggccgcuguccuccugcuuauaacacacuacgccauuaucggaccgggcuuacaggcaaaagcuaccagagaggcccaaaagaggacugcggccgguaucaugaagaacccaaccguggacgggauuaugacaaucgaucuggacccugucauauaugauuccaaauucgagaagcagcucggacaggugauguugcugguucuaugugcagugcagcugcuccuuaugcggacaaguugggcucugugcgaggccuugacccuggcaacaggccccauuacgacccucugggaagguagcccaggcaaauuuuggaauacuacaaucgcuguaucgauggccaacauuuuccgcgggucuuaccuggccggagcgggcuuagcuuuuuccaucaugaaaagcguggggaccggaaaaagaggcacugguucacaaggggagacacuuggagaaaaguggaagaaaaagcugaaucagcucaguaggaaagaguucgaccuauauaagaaaucuggcauaaccgaggucgaucggacggaagcaaaggagggucugaaacgaggcgaaaucacccaucacgccguuuccagagggagcgcuaaguugcagugguuuguggagcgcaacauggucauucccgaaggaagggugaucgaccugggcugugggcggggaggcuggucauacuauugcgccggucucaagaaaguaacagaggugcguggguacacuaagggaggcccuggccaugaggaaccgguucccaugaguaccuacggguggaauauugugaaacuuaugagcggaaaggaugucuucuaucugccaccugagaaaugugacacauugcugugcgauaucggugaauccucucccagcccuacuguggaggaguccagaaccauuaggguccucaagaugguggaaccaugguuaaagaacaaucaguucuguaucaaaguucugaaccccuacaugccuacaguaguggagcaccuugaacgccugcaacggaagcacggcgggaugcuaguccgaaauccacucucaagaaacucuacccaugagauguauuggauaaguaauggaacuggcaacauuguggcaucgguuaauauggugagcaggcuguugcugaaccgcuuuacgaugacacaccggagacccaccaucgaaaaagacgucgaucucggugccgggacucgucaugugaacgcugagccggagaccccuaauauggacguaaucggagaaaggauuaagcggauaaaagaggaacacaacuccacauggcacuacgacgaugagaauccauauaagacgugggcguaccauggcucuuaugaagugaaggccaccggcucagcaagcuccaugaucaacgggguugucaaacuucugacuaagcccugggacguggugccuauggucacacagauggcuaugaccgauacuacaccauucggacagcaacgcguuuuuaaagagaagguggacacccgaacacccagaaguaugccggguacuaggcggguaaugggcauuaccgccgagugguuauggcgcacgcuggggagaaauaaaaagccuagguugugcacccgagaagaguucacaaagaaagugcggacuaacgcagccaugggagcugucuuuaccgaagagaaucagugggauucugccaaggcggcaguggaagacgaggauuucuggaaacucguugaccgugagagagaacugcacaagcuaggcaaaugugguagcugcguguacaacaugauggggaagcgcgagaagaaacuuggagaauuuggcaaagccaaaggcucaagggcuaucugguacauguggcugggggcccgguaucucgaguucgaggcacugggauuuuugaaugaagaucauugguucuccagagagaacaguuacagcggugucgaaggcgaggggcugcacaagcucggauauauucuucgcgacaucucuaaaauacccggcggugcuauguacgccgaugacacagcugggugggacacuaggaucaccgaagaugaccugcauaaugaggagaagauuacgcagcagauggauccagaacaccgacaauuagccaacgcaaucuuuaaacugacauaucagaauaaggugguaaagguucagcggccuacccccacuggaacagugauggacauuaucuccagaaaagaucagaggggcucaggccaagucgggaccuacggauugaacacuuucaccaauauggaggcgcagcucauacgccagauggaaggugagggcgugcugagcaaggccgaccuagaaaacccacgucuucccgagaaaaagauuacacaguggcuggagacgaaagggguggaacggcucaagagaauggcuaucucgggagaugacugcgucguuaagccuaucgaugacagguuugccaacgcacuguuggcuuuaaaugauaugggcaaagugcgcaaggacauuccacaauggcagccgucuaaagguuggcacgauuggcagcagguacccuucuguagucaucacuuccaugagcugauaaugaaggacgggcgaaaacucguggucccuugccggccacaagacgaacuuaucggaagggccaggauuucccagggcgcaggcuggagccugcgcgagaccgccugucuagggaaggcguaugcucagauguggucacugauguacuuucacagacgggaucucagguuggccuccaacgcaaucugcucugccgugcccguucacugggugccuacuagccguacaaccuggaguauucaugcucaccaucaauggaugacuacagaagacaugcugaccgucuggaaucgaguguggaucgaggauaacccauggauggaggacaagacgcccauaacaaccugggaaaauguaccuuaccuuggaaaacgcgaggaucaguggugugguucccugaucggccucacuagcagagccaccugggcacagaacauuccgacagcuauccagcaaguucggucuuuaauugggaaugaagaguuccuggacuauaugccaucaaugaagagguuucgcaaagaggaagagagugaaggagccaucugguga

SEQ ID NO: 15539 - RNA, 9873 nt, Artificial Sequence
  derived and/or modified CDS sequence (opt3) from DENV-3__GQ252678__SS-prME
accagccugugccucaugaugauccuuccagccgcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacgcacaacggaaagcgacuagagcccaauugggcaucugucaagaaggaccugaucuccuacggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuauggcaauggcgugguuaccaaaaacgggggauacgugucugguaucgcacaaacaaaugcugaaccagacggccccacgccugaguuagaagaggaaauguucaagaaaagaaaccugacuauuauggaucuccauccagggaguggaaagaccaggaaauauuugcccgccaucguccgugaggcuauaaagcgccggcugagaacacucauucuggcaccuaccagggugguagccgccgagauggaagaggcucuuaagggccugccgauccgauaccagacuacagcgaccaaauccgaacacacgggucgggagaucguggacuugaugugccaugcaacuuuuacaaugcgccuacugagccccguuagagucccaaauuauaaccucauuaucauggaugaagcccacuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaccagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauauaucuucacuggccagccccugaacaaugaugaagaccaugcacacuggacggaggccaagaugcuccuggacaacauuaauaccccugaaggaaucaucccggcucuuuucgagccagagagggaaaagagugccgcaauugauggcgaguaccgccuaaaaggggaaagccguaagacauuugucgagcugaugagacggggagacuugcccgugugguuagcgcacaaaguagccuccgaagguauaaaguauacugauaggaaauggugcuucgacggccagcgcaacaaucagauccuggaggagaacauggauguggaaauuuggaccaaggagggggagaaaaagaagcuccgaccuagauggcuggacgcucggacauacucugauccccuugcccugaaagaguuuaaggacuucgcagcuggaaggaaaucgaucgcccucgauuugguuaccgaaauuggccgcgucccaacucaucuggcacacagaacaaggaaugcccuagacaaccuggugaugcuccauacgagcgagcacggugggaaggcuuaucggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauacguagugauuggaauccugacauuggcugccauaaucgcggcuaacgaaaugggccugcucgagacuacgaaacgcgaccuggguauguccaaggaacccggggucgugucaccaaccucuuaucuugauguugaccuccauccugccagcgcauggacacuguacgccguggcuacuaccgucauuacacccauguugcgacacaccaucgagaauaguacugcaaacguaucccuggccgcgauugcuaaccaggccgugguuuuaaugggccuagacaaaggauggccaaucagcaagauggaucugggcgugccucuccuugcacuggggugcuacucucaggucaaucccuugacgcugacagccgcugugcuccugcuuauaacccauuaugccauuaucggaccgggcuuacaggcaaaagcuacuagagaggcccaaaagaggaccgcggccgguaucaugaagaacccaacagucgacgggauuaugacuaucgaucuggacccugugauauacgauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaucuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauacaagaaaaguggcauaacggagguugaucggaccgaagcaaaggagggucugaaacgaggcgaaaucacacaccaugccgugucuagaggguccgcuaaguugcagugguuugucgagcgcaacauggugauucccgaaggaaggguaaucgaccugggcugugggcggggaggcuggagcuauuacugcgccggucucaagaaagugacugagguucguggguauaccaagggaggcccuggccacgaggaaccggugcccaugucaacauacggguggaauauugucaaacuuaugaguggaaaggauguguucuaccugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuauaugccuaccgugauagagcaccuugaacgccugcaacggaagcauggcgggaugcuaguccgaaauccacucuccagaaacucaacucacgagauguacuggauuucuaauggaacgggcaacaucguggcaaguguuaauauggugucgaggcuguugcugaaccgcuuuacaaugacccaucggagacccacuaucgaaaaagacgucgaucucggugccgggacccgucacgugaacgcugagccggagacaccuaauauggacguaauuggagaaaggauaaagcggaucaaagaggaacacaacagcacguggcauuaugacgaugagaauccauacaagaccugggcguaucacggcuccuacgaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgaggauuucuggaaacucguugaccgugagagagaacugcauaagcuaggcaaaugugguucuugcguguauaacaugauggggaagcgcgagaagaaacuuggagaauuuggcaaagccaaaggcagcagggcuauuugguacauguggcugggggcccgguaccucgaguucgaggcacugggauuuuugaaugaagaucacugguucucaagagagaacuccuauaguggugucgaaggcgaggggcugcauaagcucggauacauccuucgcgacauaagcaaaauccccggcggugcuauguaugccgaugacacugcugggugggacaccaggauuacggaagaugaccugcacaaugaggagaagaucacacagcagauggauccagaacaccgacaauuagccaacgcaauuuuuaaacugaccuaccagaauaaggugguaaagguucagcggccuacucccacaggaaccgugauggacaucauaucuagaaaagaucagaggggcuccggccaagucgggacuuauggauugaacaccuucacaaauauggaggcgcagcucauucgccagauggaaggugagggcgugcugucaaaggccgaccuagaaaacccacaucuucccgagaaaaagaucacgcaguggcuggagaccaaagggguggaacgucucaagcggauggcuaucagcggagaugacugcgucguuaagccuauugaugacagauuugccaacgcacuguuggcuuuaaaugauaugggcaaagugaggaaggacauaccacaauggcagccgucgaaagguuggcacgauuggcagcagguacccuucuguucucaucacuuccacgagcugaucaugaaggacgggcgcaaacucguggucccuugccgaccacaagacgaacuuauuggacgggccagaaucagucagggcgcaggcuggucccugagggagacugccugucuagggaaggcguacgcucagauguggagccugauguauuuucaucgcagagaucuccgguuggccucaaacgcaauuugcuccgccgugcccguucacugggugccuacaucuaggaccacuuggagcauccaugcucaccaucaauggaugacaaccgaagacaugcugacggucuggaaucguguguggauagaggauaacccauggauggaggacaagacacccguaaccacuugggaaaauguuccuuaccuuggaaaacgagaggaucaguggugugguagucugaucggccucaccucccgcgccacaugggcacagaacauuagcacugcuauccagcaagugagaucuuuaauugggaaugaagaguuccuggacuacaugccgucaaugaagcgguuuaggaaagaggaagagagugaaggagccaucugguga

SEQ ID NO: 15540 - RNA, 9873 nt, Artificial Sequence
  derived and/or modified CDS sequence (opt3) from DENV-3__FJ850098__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaucccgucaacauugaagcagagccgccuuucggcgaaucaaauaucgugaucggaauuggcgacaacgccuugaaaaucaauugguauaagaaggggagcaguauuggaaaaauguuugaggcuacagcccgcggugcaagaaggauggccauacugggcgauacugcuugggacuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgauauggguugugugaucaauuggaaagggaaggaacugaagugcggauccggcauuuucgugacuaacgagguccauacauggaccgagcaguacaaauuucaagcagacucucccaagcggcuagccacugcuaucgccggugcaugggaaaauggcguuugugggauacgaagcaccacacgcauggagaaccuccuguggaaacagaucgcuaaugaacuuaacuauauuuugugggagaauaacaucaagcugacgguggugguaggagaugucauuggcgugcucgaacaggggaaaagaacccugacuuuacagccaauggagcugaaguacucauggaaaacauggggaaaggccaagaucguuaccgcggagacacaaaacaguuccuucauaauugacggcccuaauacucccgaaugcccaagcgccucuagggcuuggaacgugugggaggucgaagacuaugguuuugggguguucaccacgaauaucuggcuuaaauugcgggagguuuacacacagcucugugaucaccgccugaugucagcagccgugaaggacgaaagagcuguacacgccgauaugggauacuggauugagagucagaaaaacggcagcuggaagcuagagaaagcaucccugaucgaagucaagaccugcacuuggcccaagucucauacccucuggucgaauggugugcuggagagcgacaugauaaucccuaaaucccuugcgggcccaauuucacagcacaacuauaggccgggguaccauacacaaacugccggacccuggcacuugggcaagcuggaauuagauuuuaauuauugcgaggggaccacaguggucaucacggagaacuguggaacccguggcccuagucuccggacuacaaccguuucugguaaacugauucacgaauggugcugucgaagcugcacucuuccaccccugagauacaugggggaggacggauguugguauggcauggaaaucaggccuauauccgagaaggaagagaauauggugaaaucauugguaagcgcugguucuggcgagguggauaacuucacaauggggguccucugccuggccauucuauuugaagaggugaugcgcggaaaguucggcaagaaacauaugaucgcagggguuuucuuuaccuucgugcugcuccuguccggacagaucacguggcgggacauggcucacacucuuauuaugaucggcaguaaugccagcgauagaauggguaugggggucaccuacuuggcacugauugccacauuuaagauacagccauucuuagcucucggauuuuuccugaggaaacuuaccucucgcgaaaaccugcuacucggcgugggccuggcgauggccacuacauugcaacugcccgaggacaucgaacagauggcaaaugggauugcuuuaggacucauggcccugaagcuuaucacccaguuugagacauaucagcuguggacugccuugauuucccucaccuguucaaacacgaucuucacacugaccguugcuuggcgaacugcaacccuaauacuggccggugugagucuucucccggucugccaaagcucguccaugcggaaaacagauuggcugccuaugacuguagcggcuaugggcgugccacccuugccucuguuuaucuucucuuuaaaggacacccucaagcguagaagcuggccccugaaugaggggguuauggccgugggacuugucucaauucuggcaaguuccuugcucaggaacgaugugccaauggccggcccucugguagcuggugggcuacugaucgcauguuacgugauuacgggaacaucugccgaccuuaccgucgaaaaagcggcugacguuacuugggaggaagaggccgaacagacaggcgugagccauaaccucaugaucaccguggaugacgauggcacuaugcgcauaaaggacgaugagacagagaauauucugaccgucuuguuaaaaacggcacugcucaucguguccgggaucuuucccuacucaauuccagccacucugcuuguuuggcacaccuggcagaagcagacacaacggagcggaguacugugggacgugccgaguccucccgaaacccagaaagcugaguuggaagagggugucuauagaauaaagcagcagggcaucuucgggaaaacacaagugggaguuggcgugcagaaggagggugucuuucauacuauguggcacgugaccaggggggccguacuaacguacaacggaaagcgacuggaaccaaauugggcaucugucaaaaaggaucucauuuccuauggcggcggguggcgccugagcgcucaguggcaaaaaggagaggaagugcagguuaucgccguggagcccgguaagaacccuaaaaauuuccagacaaugccaggcacuuuccagaccacaaccggggaaauuggagcgaucgcccuugacuuuaagcccggcacuucggguucaccuauaaucaaccgggaggggaaggucgugggauuauacggcaauggcguugugaccaaaaacgggggauaugucucugguauugcacaaacaaaugcugagccggauggcccaacgcccgaacuggaggaagagauguucaagaaaagaaaccucacuaucauggacuugcacccugggaguggaaagaccaggaaauaccugccagccauugugcgugaagcuaucaagcgccggcucagaacacugauacuugcacccaccaggguaguggccgccgagauggaggaagcucugaagggcuugccuauucgauaucagacuacagcgaccaaauccgagcauacgggucgggaaaucguugaucuaaugugccacgcaacuuuuacaaugcgccugcucagcccggucagagugcccaauuacaacuuaaucauuauggacgaggcccauuucaccgauccagcuucuaucgccgcaaggggguacauaagcacccgggugggaaugggcgaagccgcugcgauuuuuaugacugccacaccucccggcaccgcagacgcuuucccacaguccaaugccccuauccaggacgaggagcgagauauucccgaaagaucauggaacagugggaaugaguggaucacagacuuugcaggaaagacugucugguucguaccaagcauaaaagccgguaacgauauugcuaacugucugcgcaagaauggcaaaaaggugauccaacuuucuaggaagacguuugacaccgaauaucagaaaacaaagcugaacgauugggacuucguugugacuaccgauaucuccgagaugggggccaauuuuaaagcggaccgugucauugauccgcggagaugccucaagccugugaucuugacagacggacccgagaggguuauucuggcaggcccaaugcccgugaccgccgcuucagccgcucagcgccgagguagagucgggcggaacccucagaaagaaaaugaucaauacauauucacuggccagccacucaacaaugacgaggaccacgcacauuggacggaagccaagaugcugcuugauaacaucaauacccccgagggaauuaucccugcucuauucgaaccggagagggagaagagugccgcaaucgacggcgaauaucgccugaaaggggagagccguaagacauuuguggaauugaugagacggggagauuuaccaguauggcuggcgcacaaaguggccuccgaggguauuaaguacacugacaggaaauggugcuucgauggccagcgcaacaaucagauacucgaagagaacauggacguugagaucuggaccaaggaaggggagaaaaagaagcugcgacccagauggcuugaugcucggacauauucugacccucuggcccucaaagaauuuaaggauuucgcagcuggaaggaaaucgauugccuuggaccuggucaccgagaucggccgcgugcccagccaccuagcacauagaacuaggaaugcccuggauaaccucgugaugcuucacacaucagaacauggugggaaggcuuaccggcacgcggucgaggagcugccagaaacgauggagaccuuauugcugcucggccugaugauucuucugacuggaggcgccaugcucuuuuugaucuccgggaaaggaauagguaagacaaguaucggccugauuuguguuaucgcaucuagcgggauguuauggauggcugaaauuccucuacaauggaucgccuccgccauagugcuggaguucuuuaugaugguacuccuuauucccgagccagaaaagcagcguaccccucaggacaaucaacuggcauauguggucaucggaauuuugacccuggcugccaucauagcggcuaacgagaugggccuccuggaaacaacuaaacgcgaucuugguaugucaaaggagccgggggugguuucucccacgagcuaccucgacguggaccugcacccagccagugcauggaccuuguacgccgucgcuacaacuguaaucaccccuaugcugcgacauacaauugaaaauuccaccgcaaacgugagcuuagccgcgaucgcuaaccaggccguugugcuaaugggccuggauaaaggauggcccauuucuaagauggaccucggcgucccacuucuggcauuggggugcuauucacaggugaauccucugacucucacggccgcuguccugcuuuuaaucacacacuacgccauaauuggacccggccugcaggcaaaagcuaccagagaggcccaaaagaggacugcggccgguaucaugaagaacccgaccguggaugggaucaugacaauugaccucgauccaguuaucuaugacuccaaauucgagaagcaguugggacaggugaugcugcuaguacugugugcagugcagcuccuucugaugcggacuaguugggcuuugugcgaagcccugacccucgcaacaggcccuauaacgacccugugggaggguagccccggcaaauuuuggaauacuacaauugcugucucgauggccaacaucuuccgcgggucuuacuuagccggagcgggccuugcuuuuuccauuaugaagagcguugggaccggaaaaagaggcacugguucacaaggggaaacacugggagagaaguggaagaaaaagcucaaucagcuaaguaggaaagaauucgaucuguauaagaaaucuggcaucaccgagguggaccggacggaggcaaaggaagguuugaaacgaggcgagauaacccaucacgccgucuccagagggagcgcuaagcugcagugguuuguggaacgcaacaugguaaucccagagggaagggugauugaucucggcugugggcggggaggcuggucauacuauugcgccggucuuaagaaaguuacagaagugcguggguacacuaagggaggccccggccaugaggagccugucccgaugaguaccuacggguggaauaucgugaaacugaugagcggaaaggacgucuucuauuugcccccagaaaaaugugauacacugcucugcgacauuggugaguccucuccuagccccacuguggaagaguccagaaccaucaggguuuuaaagaugguagagccuuggcugaagaacaaucaguucuguauuaaagugcuuaacccauacaugcccacagucguggaacaccuggagcgccuacaacggaagcacggcgggaugcucguucgaaauccucugucaagaaacucuacccaugaaauguauuggaucaguaauggaacuggcaacauaguggcaucggucaauauggugagcagguugcugcucaaccgcuuuacgaugacacaccggagaccaaccauugagaaagauguagaccuuggugccgggacucgucaugugaacgcugaacccgagaccccgaauauggacguuaucggagagaggaucaagcggauuaaagaagagcacaacuccacauggcacuacgaugacgaaaauccuuauaagacgugggcguaccauggcucuuaugaggucaaggccaccggcucagcaagcuccaugauaaacgggguggugaaacuguuaacuaagccaugggaugucguucccauggugacacagauggcuaugaccgacacuacaccuuucggacagcaacgcguauuuaaagaaaagguggauacccgaacaccaagaaguaugcccgguacuaggcgggucaugggcaucaccgccgaguggcuguggcgcacguuggggagaaauaaaaagccgaggcucugcacccgagaggaauucacaaagaaagugcggacuaacgcagccaugggagcuguuuuuaccgaggaaaaucagugggacucugccaaggcggcaguggaggaugaagacuucuggaaacuggucgaucgugagagagagcuacacaagcuuggcaaaugugguagcugcguguacaacaugauggggaagcgcgaaaaaaagcugggagaguuuggcaaggccaaaggcucaagggcuauuugguacauguggcucggggcccgguaucuggaauucgaggcauugggauuucugaaugaggaccauugguucuccagagaaaacaguuacagcgguguagagggcgaagggcuccacaagcuuggauauauccugcgcgauauuucuaaaaucccuggcggugcuauguacgccgacgacacagcugggugggauacuaggauaaccgaggacgauuuacauaaugaagagaagaucacgcagcagauggaccccgagcaccgacaacuggccaacgcaauuuuuaaauugacauaucagaauaagguugugaagguccagcggccaaccccuacuggaacagugauggauaucauuuccagaaaagaccagaggggcucaggccaaguggggaccuacggacucaacacuuucaccaauauggaagcgcagcugauccgccagauggagggugaaggcguccuaagcaaggccgaucuugagaacccccgucugccagaaaaaaagauaacacaguggcucgagacgaaagggguugagcggcugaagagaauggcuauuucgggagacgauugcgugguaaagcccaucgacgauagguuugccaacgcauuguuagcucugaaugacaugggcaaagugcgcaaggauaucccucaauggcagccaucuaaagguuggcacgacuggcagcaggucccguucuguagucaucacuuccaugaacucauuaugaaggacgggcgaaaacuugugguucccugccggccucaagaugagcugauaggaagagccaggaucucccagggcgcaggcuggagccuacgcgaaaccgccugucuggggaaggcguaugcucagauguggucacucauguacuuucacagacgggacuugaggcuggccuccaacgcaauuugcucugccgugccaguccacugggugcccacuagccguacaaccuggaguauccaugcucaccaucaauggaugacuacagaggauaugcuuaccguauggaaucgaguuuggauugaagacaacccuuggauggaggauaagacgccagugacaaccugggagaauguccccuaccugggaaaacgcgaagaccaguggugugguucccucaucggcuuaacuagcagagccaccugggcacagaacauaccuacagcuauccagcaagugcggucucugauugggaaugaggaauucuuggauuauaugccgucaaugaagagguuucgcaaagaggaggaaagugagggagccaucugguga

SEQ ID NO: 15541 - RNA, 9873 nt, Artificial Sequence
  derived and/or modified CDS sequence (opt3) from DENV-3__KF955479__SS-prME
accagccugugccucaugaugauccuucccgccgcucuggcauuccacuugacuuccagggacggcgaaccuaggaugauuguggggaagaacgaacggggaaaaucuuuacuguuuaagacugccucagguauuaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcagguagaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcauccuuuauagagguaaagaccugcacuuggccuaagucucauacccuauggucgaaugguguccuggaaagcgauaugaucauuccaaaaucccucgcgggcccgaucucacagcacaacuauaggcccggguaccauacacaaacugccggaccuuggcaccugggcaaacuugaguuggacuucaauuauugcgaggggaccacaguggugauuacggaaaacuguggaacccguggcccaagucugcggacuacaaccgucucugguaaauuaauccacgaguggugcugucgaagcugcacucucccaccucugagauacaugggggaagauggauguugguauggcauggagauaaggccaauuuccgaaaaggaggagaauaugguuaaaucacuugugagcgcugguucuggcgaaguagacaacuuuacaaugggggugcugugcuuggccauccucuucgaggaagucaugcgcggaaaguucggcaagaaacauaugaucgcagggguguuuuucaccuuuguucugcuacuguccggacagauuacguggcgggauauggcucacacucucaucaugauuggcaguaaugccagcgacagaauggguaugggggugaccuaccuggcacuuauagccacauucaagauccagcccuuuuuggcucugggauucuuuuuaaggaaacucaccucucgcgagaaccugcuucugggcgucggccuagcgauggccacuacacuccaacugccggaagauauugagcagauggcaaaugggaucgcuuugggacugauggccuuaaagcucauuacccaguucgagacauaucagcuguggacugcccuuaucucccugaccuguucaaacacgauauuuacauugaccguggcuuggcgaacugcaacccucauccuggccgguguuagucuacugccugugugccaaagcucguccaugcggaaaacagacuggcuuccaaugacugucgcggcuaugggcguacccccucucccccuguucauauuuucuuugaaggauacccugaagcguagaagcuggccauuaaaugaaggggugauggccguuggacucgugucaauccuggcaaguucccuucugaggaacgacgucccuauggccggccccuugguggcuggugggcuccugauugcauguuacguaaucacgggaacaucugccgaucuaaccguggagaaagcggcugacgucacuugggaagaggaagccgagcagacaggcguuagccauaaccugaugauaaccguggacgaugacggcacuaugcgcauuaaggaugacgagacagaaaauauccuuaccgugcuccugaaaacggcauuguuaaucgucuccgggauuuucccauacucaauaccggccacucugcucguguggcacaccuggcagaagcagacacaacggagcggaguucugugggauguaccuagucccccagagacccagaaagcugaacuugaggaggguguguauagaaucaagcagcagggcauuuuugggaaaacacaagucggagugggcguucagaaggaagguguguuccauacuauguggcacgucaccagaggggccgugcugacguacaacggaaagcgauuggagcccaauugggcaucugucaagaaggaccuaaucuccuauggcggcggguggcgccugagcgcucaguggcaaaaaggagaagagguccaggugauugccguugaaccugguaagaaccccaagaauuuccagacaaugcccggcacuuuucagaccacaaccggggagaucggagcgauagcccucgauuucaagccuggcacuucggguucaccgaucauuaaccgggaggggaagguggucggacuguacggcaauggcgugguuaccaaaaacgggggauaugugucugguaucgcacaaacaaaugcugaaccagacggccccacgccugagcuugaagaggaaauguuuaagaaaagaaacuuaacuauuauggaucugcacccagggaguggaaagaccaggaaauaccuccccgccaucguccgugaggcuauaaagcgccgguugagaacacugauucucgcaccuaccagggugguagccgccgagauggaagaggcucugaagggccuuccgauccgauaucagacuacagcgaccaaauccgaacauacgggucgggagaucguggaccugaugugccacgcaacuuucacaaugcgcuugcuaagccccguuagagucccaaauuacaaccugauuaucauggaugaagcccauuuuaccgacccugcuucuauagccgcaaggggguacauuagcacccgggugggaaugggcgaggccgcugcgaucuucaugacugccacacccccaggcaccgcagaugcuuuuccucaguccaaugcccccauucaggacgaggaacgagacaucccagagagaucauggaacagugggaaugaauggauaacagauuucgcaggaaagacugugugguuugucccgagcauuaaagccgguaacgacaucgcuaacugucuccgcaagaauggcaaaaagguaauccaauuaucuaggaagacguucgauaccgaguaucagaaaacaaagcugaacgacugggauuuugugguuacuaccgacauuuccgagaugggggccaauuucaaagcggaucgugugaucgacccucggagaugccuuaagcccgucauucugacagauggaccagaaagggugauacucgcaggccccaugccuguuaccgccgcuucagccgcucagcgccgagguagaguggggcggaacccacagaaagagaaugaccaauacaucuucacuggccagcccuugaacaaugaugaagaccacgcacauuggacggaggccaagaugcugcucgacaacauuaauaccccugaaggaaucaucccggcucuguuugagccagagagggaaaagagugccgcaauugauggcgaguaucgccuuaaaggggaaagccguaagacauucgucgagcuaaugagacggggagaccugcccgugugguuggcgcacaaaguagccuccgaagguauaaaguacacugauaggaaauggugcuuugacggccagcgcaacaaucagaucuuagaggagaacauggauguggaaauuuggaccaaggagggggagaagaagaagcugcgaccuagauggcucgacgcucggacauauucugauccccuggcccuuaaagaguucaaggacuuugcagcuggaaggaaaucgaucgcccuggaucucguuaccgaaauuggccgcgucccaagccacuuggcacauagaacuaggaaugcccuggacaaccuagugaugcugcacacaucagagcauggugggaaggcuuaccggcacgcgguggaggaacucccugagacgauggaaacccuucuguuauugggccugaugauccuccugacuggaggcgccaugcuuuuccugauauccgggaaaggaaucgguaagacaaguauuggccucaucugugucauugcaucuagcgggauguuguggauggcugagaucccccugcaauggauagccuccgccauuguuuuagaguuuuucaugauggugcuacugaucccagaaccugagaagcagcguaccccgcaggauaaucaacucgcauauguagugauuggaauccuuacccuggcugccauaaucgcggcuaacgaaaugggcuugcuggagacaacuaaacgcgaccucgguaugucaaaggaacccggggucgugucuccaacgagcuaccuggauguugaccuucacccugccagugcauggacccucuacgccguggcuacaacugucauuacccccaugcugcgacauacaaucgaaaauuccaccgcaaacgucagcuuggccgcgauugcuaaccaggccgugguucugaugggcuuagacaaaggauggccaaucucuaagauggaucuaggcgugccucugcucgcacuugggugcuauucacaggucaauccccugacuuugacggccgcugugcugcuccugauaacacacuacgccauuaucggaccgggccuucaggcaaaagcuaccagagaggcccaaaagaggacugcggccgguaucaugaagaacccaaccgucgacgggauuaugacaaucgauuuagacccugugauauaugauuccaaauuugaaaagcagcugggacagguuaugcucuuggugcugugugcaguacagcuacugcucaugcggacaaguugggcucuuugcgaggcccugaccuuggcaacaggccccauuacgacccugugggaagguagcccaggcaaauucuggaauacuacaaucgcugugucgauggccaacauuuuucgcgggucuuaccucgccggagcgggccuggcuuucuccaucaugaaaagcgucgggaccggaaaaagaggcacugguucacaaggggagacauuaggagaaaaguggaagaagaaacuuaaucagcugaguaggaaagaguuugaccucuauaagaaaucuggcauaaccgagguugaucggacggaagcaaaagagggucuaaaacgaggcgaaaucacccaucacgccguguccagagggagcgcuaagcugcagugguucgucgagcgcaacauggugauucccgaaggaaggguaaucgacuugggcugugggcggggaggcuggucauacuauugcgccggucugaagaaagugacagagguucguggguacacuaagggaggcccuggccaugaggaaccggugcccaugaguaccuacggguggaauauugucaaacucaugagcggaaaggauguguucuaucuuccaccugagaaaugugacacacuguugugcgauaucggugaauccucucccagcccuacugucgaggaguccagaaccauuagggugcugaagaugguugaaccauggcucaagaacaaucaguuuuguaucaaaguauuaaaccccuacaugccuacagugauagagcaccuggaacgccuucaacggaagcacggcgggaugcugguccgaaauccacuaucaagaaacucuacccaugagauguauuggauuaguaauggaacuggcaacaucguggcaucgguuaauauggugagcaggcuccuguugaaccgcuucacgaugacacaccggagacccaccaucgaaaaagacgucgaucugggugccgggacucgucaugugaacgcugagccggagaccccuaauauggacguaauuggagaaaggauaaagcggaucaaagaggaacacaacuccacauggcacuacgacgaugagaauccauauaagacgugggcguaccauggcucuuaugaagugaaggccaccggcucagcaagcuccaugauuaacgggguugucaaacuccuuacuaagcccugggacguggugccuaucgucacacagauggcuaugaccgauacuacaccauuuggacagcaacgcguuuucaaagagaagguggacacccgaacacccagaaguaugccggguacuaggcggguaaugggcauuaccgccgaguggcuguggcgcacguuagggagaaauaaaaagccuaggcugugcacccgagaagaguuuacaaagaaagugcggacuaacgcagccaugggagcugucuucaccgaagagaaucagugggauucugccaaggcggcaguggaagacgaggauuuuuggaaauugguugaccgugagagagaacuccacaagcugggcaaaugugguagcugcguguacaacaugauggggaagcgcgagaaaaagcuaggagaguucggcaaggccaaaggcucaagggcuaucugguacauguggcuuggggcccgguaucuggaguuugaggcacucggauuccugaaugaagaucauugguuuuccagagagaacaguuacagcggugucgaaggcgagggguugcacaagcugggauauauacuccgcgacaucucuaaaauucccggcggugcuauguacgccgaugacacagcugggugggacacuaggaucaccgaagaugaccuucauaaugaggagaagauuacgcagcagauggauccagaacaccgacaacuggccaacgcaaucuucaaauuaacauaucagaauaaggugguaaagguucagcggccuacccccacuggaacagugauggacauaauuuccagaaaagaucagaggggcucaggccaagucgggaccuacggacugaacacuuuuaccaauauggaggcgcaguugauccgccagauggaaggugagggcgugcucagcaaggccgaccuggaaaacccacaccuacccgagaaaaagaucacacaguggcuugagacgaaagggguggaacgucugaagcggauggcuauuucgggagaugacugcgucguuaagccuauagaugacagauucgccaacgcacuccuggcuuugaaugauaugggcaaagugaggaaggacaucccacaauggcagccgucuaaagguuggcaugauuggcagcagguacccuucuguagucaccauuuucacgaguuaauuaugaaggacgggcgcaaacugguggucccuugccgaccacaagacgaacucaucggacgggccagaauuucccagggcgcaggcuggagccuuagggagaccgccugucuggggaaggcguaugcucagauguggucacuaauguacuuccaccgcagagaucugcggcucgccuccaacgcaaucugcucugccgugcccguucauugggugccuacuagcaggacaaccuggaguauacacgcucaucaccaauggaugacuacagaagacauguugaccgucuggaaucguguguggaucgaggauaacccauggauggaggacaagacgcccguaacaaccugggaaaauguuccuuaccugggaaaacgagaggaucaguggugugguucccuuauuggccugacuagccgcgccaccugggcacagaacaucccgacagcuauucagcaagugagaucucucaucgggaaugaagaguuuuuagacuauaugccaucaaugaagcgguucaggaaagaggaagagagugaaggagccauuugguga

SEQ ID NO: 15542 - RNA, 9873 nt, Artificial Sequence
  derived and/or modified CDS sequence (opt3) from DENV-3__FJ850109__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacacaggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacagcuugaaaauuaauugguauaagaaggggaguucuaucggaaaaauguuugaagccacugcucgcggugccagaaggauggcaauucugggcgacaccgccugggauuucggguccguuggaggcgugcucaacagccuggguaagaugguccaccagauauuugggucggcuuacacggcccuuuucucuggcguguccuggguaaugaaaaucggaauuggcgugcuguugacauggaucgggcucaauucaaagaacaccaguaugagcuuuuccugcaucgcaauuggaauaaucacucuguauuuaggcgcgguuguccaggcugacacagguugugugauuaauuggaaagggaaggagcugaagugcggaucuggcaucuucgugaccaacgagguccauacuuggaccgaacaguacaaauuucaagccgauagccccaagcggcuagcaacagccauugcuggugccugggagaauggcguuugugggauccgaucaacgacccgcauggaaaaccuccuguggaaacagauagcaaaugagcuuaacuauaucuugugggaaaauaacauuaagcugacuguggugguaggagacaucauuggcguccucgagcaggggaaaagaacacugaccccacagccuauggaguuaaaguacaguuggaaaacauggggaaaggcuaggaucgugacugccgaaacccaaaacuccagcuucauaauugauggccccaauacgccagagugccccaacacaucucgggcguggaauguuugggaaguggaggacuaugguuuuggggucuucaccacuaacaucuggcugaagcuucgcgaaguguacacccaguugugugaccacagacucaugucagccgcuguuaaagaugagagggcagugcacgccgacaugggauacuggauugagagucagaagaauggcagcuggaaacuggaaaaggcuucccuaaucgagguaaaaacaugcacuuggccuaagucucauacccuguggucgaacgguguccucgaaagcgauaugauaaucccaaagucccuggccggcccgauuucacagcacaauuaucgucccggguaccauacacaaacggcaggaccuuggcaccuuggcaaauuggagcuggacuuuaacuauugcgaggggaccacuguggugaucacagaaaauuguggaacccggggcccaaguuuacgaacuacaaccgucucugguaagcucauucacgaguggugcuguagaagcugcacgcugcccccucuuagguacaugggggaagauggauguugguauggcauggagauccgcccaauauccgaaaaagaggagaacaugguuaagucacuggugagcgcggguucuggcgaaguagacaauuucacuauggggguguugugccucgccauucuguuugaggaagucaugcggggaaaauucggcaagaagcauaugaucgcugggguguucuuuaccuucguucuacugcucuccggacagaucacauggagagauauggcccacacccugauuaugaucggcaguaacgcaacugacaggauggguaugggggugacauaccuugcuuugauugccaccuuuaaaauacagcccuuccuggcauuaggauuuuuccuccgcaagcugacaagccgagagaaucuucugcuaggcgucggccucgccauggcuacuacccugcaauugccggaagauaucgagcagauggcgaacgggauugcccugggauuaauggcacucaaacugaucacgcaguuugagacauaucagcuuuggaccgcucugauuucuuugacuuguuccaauaccaucuucacacucacuguggccuggcggaccgccacgcugauacuagcugguguuucacugcuuccugugugccaaaguagcucgaugcguaagacagacuggcucccaaugaccgucgcagccaugggcguacccccucugcccuuguuuaucuucucccugaaagauacuuuaaagagaaggucuuggccacucaacgaaggggugauggcgguuggacuggugagcauucuugcuucaagucuguugcgcaacgacgucccuauggccggcccccucguggcaggugggcugcuaaucgccuguuacguaauuacaggaaccuccgcugaucugacuguggagaaggcagccgacgucacaugggaagaggaagcggagcagaccggcguuucucauaaucuuaugaucacgguggacgaugacggcacuaugcggauaaaagaugacgagaccgaaaacauucucacagugcuguugaagaccgcuuuacugaucgucagcgggaucuuuccauacuccauuccggccacacuccugguguggcacacuuggcagaaacagacccaaagaucaggaguucuuugggauguaccuagccccccagagacgcagaaggcagaacuggaggaggguguguauaggauaaaacagcagggcaucuucgggaagacacaagucggagugggcguucagaaagaagguguguuucauacuauguggcacgucacccgaggggccguguugacauacaauggaaagcgccuagagcccaacugggcuaguguaaagaaagaccugauuucuuauggcggcggguggcggcucuccgcccaguggcaaaagggagaagagguccaggugaucgcaguugaaccugguaaaaauccaaagaacuuccagaccaugcccggcacuuuccagaccacaacgggggagauuggagcuaucgcccuggauuuuaaaccuggcacuagcgguucgccgauaaucaauagagaggggaagguggucggacuuuacggcaacggcgugguuaccaagaaugggggauaugugucagguauugcgcaaacaaacgccgaaccagacggccccaccccugaguuagaagaggaaauguucaaaaagaggaaucugacuaucauggaucuccacccagggucuggaaaaacacguaaguacuugcccgcaauuguccgcgaggcuaucaaacggagacugaggacccucauacuggccccuacgcgagugguagcugcagagauggaagaggcccuuaagggccugccgauucgguaucagacuacagccaccaagagugaacauaccggucgcgagaucguggacuugaugugccacgcuacuuuuacaaugagacuacugucccccguuagggucccaaacuacaaucucaucauuauggaugaagcgcauuucaccgacccugcaagcaucgccgcucggggguacauaucuacacgagugggaaugggcgaggccgcagccauuuuuaugacugcuacgcccccaggcaccgcggaugccuucccucagagcaacgcacccauccaggacgaggaaagagacauuccagagcgcuccuggaauucagggaacgaauggaucacagauuuugcuggaaaaacugugugguucgucccgaguauaaaggccgguaacgacauugcaaauuguuuaaggaaaaacggcaagaaaguaauccaacugagccguaagaccuuugauacagaguaucagaagaccaaacuuaaugacugggauuucgugguuacuacggacaucucugagaugggggccaacuuuaaggcugaucgggugauugacccuagaaggugccugaaacccgucauccucaccgauggaccagaacgcgugauuuuggccggccccaugccuguuacagcggcauccgccgcucagcgaagaggucggguggggaggaauccacagaaggagaacgaccaauacauauucacuggccagccccugaauaacgaugaagaccacgcccauuggaccgaggcuaaaaugcuccuggacaauaucaacacaccugaaggaauuaucccggcacuuuucgagccagagcgcgaaaagucagccgcuaucgauggcgaguaucgucuaaagggggaaaguagaaaaaccuuugucgagcugaugcggaggggagacuugcccgugugguuagcccacaagguagcaagcgaagguauuaaauacacugaucgcaaguggugcuucgacggccagcgaaauaaccagauacuggaggagaauauggauguggaaaucuggacaaaagagggggaaaagaaaaagcucagaccucgguggcuggacgcgaggacguauuccgauccccuugcccugaaggaguuuaaagacuucgcugccggacgcaagucuauugcacucgauuugguuaccgaaaucggcagagucccaacucaccuggcucauaggacacggaacgcccuagacaaucuggugaugcuccacaccucggagcauggugggaaagcauaccgucacgccguggaggaacuuccugagaccauggaaacacuguuauugcugggccucaugauucugcuuacuggaggcgcuaugcuguuucucaucagcgggaagggaauagguaaaacgucaaucggcuugauuugugucaucgcguccagugggaugcuguggauggccgagauucccuuacaauggaucgcaucugcuauaguucuagaguucuuuaugauggugcugcucauuccagaaccugagaagcagcgcaccccgcaggauaaccaacuugccuauguagugaucggaauucugacauuggccgcaaucauagcugccaaugaaaugggccugcucgagacuaccaagcgagaccuggguaugagcaaagaacccggggucguguccccaacaucauaccuugauguugaccuccacccugcgucugcuuggacccuguacgccguggcaacuacggucaucacacccauguugagacauaccauugagaacagcacugccaacguaagucuggcugcaaucgccaaucaggcggugguuuuaaugggccuagacaagggauggccaauuuccaaaauggaucugggcgugccucuccuugcucuggggugcuauagccaggucaaccccuugacccugacagccgcagugcuccugcuuaucacucacuacgccauaauuggaccgggcuuacaggcuaaggccaccagggaggcacaaaaacggacagcugccgguaucaugaagaauccaacggucgacgggaucaugaccauugaucuggacccugugaucuaugauucuaaguucgaaaaacagcucggacagguuauguugcuggugcuaugugcgguacagcugcuccuuaugcgcacuucaugggcccugugcgaggcauugacacuggcuaccggccccauaacuacacucugggaagguuccccaggcaaguuuuggaacaccacgauugccgugaguauggcaaauaucuucagagggagcuaccuggcuggagccggcuuagccuuuucgauuaugaaaucugucgggaccggaaagaggggcacagguucccaaggggagacucuuggagaaaaauggaagaagaaacugaaccagcucagccggaaggaguucgaccuauauaaaaagucaggcaucaccgagguugaucgaacagaagcgaaagagggucugaagagaggcgaaauaacucaucacgcugugagucgcgggucugcaaaauugcagugguuugucgagaggaauauggugauccccgaaggacggguaauugaccugggcugugggcguggaggcugguccuacuauugcgccggucucaagaaggugaccgagguuagaggguacacaaaaggaggcccuggccaugaggaaccggugcccaugagcaccuacggguggaacaucgucaagcuuaugucaggaaaagauguguucuaucugccaccugagaagugugacacuuugcugugcgauauuggugaaaguagccccuccccuacggucgaggagucuaggacaauccgcgugcucaaaaugguugaaccaugguuaaagaauaaccaguucuguauuaagguacugaaucccuacaugccugcugugaucgagcaccuugaacggcugcaacgaaaacacggcgggaugcuagucagaaacccacucagcaggaauuccacccaugagauguauuggauaucaaacggaacuggcaauauuguggccucuguuaacauggugagucgccuguugcugaaccgguuuaccaugacacacagacgucccacgaucgaaaaggacgucgaucucggugcagggaccaggcaugugaaugccgagccggagacuccuaacauggacguaaucggagaacggauuaaacgcauaaaggaggaacacaauucgacauggcacuacgacgaugagaacccauauaaaaccugggcuuaccauggcagcuaugaagugaaggcgacuggcuccgccucuucaaugaucaaugggguugucaagcuucugacaaaacccugggacguggugccuauggucauucagauggcaaugaccgauacaacuccauucggacagcaacgaguuuuuaaggagaaaguggacaccagaacgcccaggagcaugccggguacccggcgcguaauggagaucacagcugaaugguuauggagaacucugggcaggaacaagaaaccucgauugugcacccgggaggaauucacaaagaaggugcguacuaaugccgcaaugggggccgucuuuaccgaggaaaaccagugggauuccgcuaaagccgcgguggaggacgaggauuucuggaagcucguugacagagaacgcgagcugcacaaacuaggaaaguguggcaguugcguguacaauaugauggguaaaagggaaaagaaacuuggggaguuuggaaaggcaaagggcucucgggccauuugguacauguggcugggcgcuagauaucucgaguucgaagcccugggguuuuugaacgaggaucauugguucagccgcgaaaauucauacuccggagucgagggugaaggccugcacaaacucggguauauccuuagggacauaaguaagauccccggaggcgcaauguacgcugaugacacggccgguugggacacacgaauuaccgaggaugaccugcauaacgaggaaaaaaucacucagcagauggauccagagcaccggcaauuagcuaaugccauuuuuaagcugacauaucagaacaaagugguaaagguucagagaccuacccccacugggaccgugauggacaucauaagcaggaaggaucagcgcggaucuggccaagucggcacauacggguugaauacguucaccaacauggaagcacagcucauucgucagauggagggagaaggugugcuguccaaagcggaccuagagaacccacaccuucccgagaagaaaaucacucaguggcuggaaacaaagggcguggagcggcucaaaagaauggccaucucaggggaugacugcgucguuaagccuauugaugacagguuugcuaaugcccuguuggcauuaaacgauaugggaaaggugcgcaaagacauaccacaauggcagccgagcaagggcuggcaugauuggcagcagguacccuucuguucgcaccauuuccacgaacugaucaugaaagacggucgaaagcucguggucccuugccggccacaagacgagcuuauugggagagcuaggaucucucagggagccggcuggagucugcgcgaaaccgcaugucuaggcaaagccuaugcgcagauguggucccugauguacuuucacagacgggaucucagguuggcuagcaaugccauuugcucagcagugcccguucauugggugccuacuucccguacaaccuggucuauccacgcccaucaccaauggaugacgacagaggacaugcugaccgucuggaaccgaguguggauagaggauaauccauggauggaagacaagacucccguaaccacaugggagaacguuccuuaccuugggaagcgcgaagaucagugguguggaagccugaucggucucacuaguagagcuaccugggcccagaauauuccgacagcaauccagcaagugcgguccuuaauuggcaacgaggaguuccuggacuauaugccaagcaugaaaagguuucgcaaggaagaggaaucugagggggcuaucugguga

SEQ ID NO: 15543 - RNA, 9873 nt, Artificial Sequence
  derived and/or modified CDS sequence (opt3) from DENV-3__GQ868586__SS-prME
accagccugugccucaugaugauccuucccgccgcucuggcauuccacuugaccuccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcagguagaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggauuacaagggagaggacguucccuguaaaaucccuuucuccacagaagauggccaagguaaggcucauaacgggcgucuuauaacugcgaauccagugguaaccaaaaaggaggagcccgucaacauugaagcagagccgccuuucggcgaaucaaauaucgugaucggaauuggcgacaacgccuugaaaaucaauugguauaagaaggggagcaguauuggaaaaauguuugaggcuacagcccgcggugcaagaaggauggccauacugggcgauacugcuugggacuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgauacugguugugugaucaauuggaaagggaaggaacugaagugcggauccggcauuuucgugacaaacgagguccauaccuggacugagcaguacaaauuucaagcagacucucccaagcggcuagccaccgcuaucgccggugcaugggaaaauggcguuugugggauacgaagcacaacgcgcauggagaaccuccuguggaaacagaucgcuaaugaacuuaacuauauuuugugggagaauaacaucaagcugaccguggugguaggagauauuaucggcguccucgaacaggggaaaagaacucugacaccacagccuauggaguuaaaguacucauggaaaaccuggggaaaggccaagauagugacagcggagacucaaaacaguuccuucauuaucgacggccccaauaccccagaaugccccagcgccucuagggcuuggaacguuugggagguggaagacuaugguuuuggggucuucacgacaaauauuuggcugaaacuucgggagguguacacccagcagugugaucaccgcuugaugucagcagccguuaaggacgaaagagcugugcacgccgauaugggauacuggaucgagagucagaaaaacggcagcuggaagcucgagaaagcaucccugauagaaguaaagacuugcaccuggccuaagucucauacacuauggucgaaugguguccuggagagcgacaugaucauuccaaaaucccucgcgggcccgaucucacaacacaacuauaggcccggguaccauacucagaccgccggaccuuggcaccugggcaaacuugaauuggauuuuaauuauugcgaggggacaacgguggugauuaccgagaacuguggaacucguggcccaagucugcggacaaccacugucucugguaaauuaauccacgaauggugcugucgaagcugcacacucccaccucugagauacaugggggaggacggauguugguauggcauggaaauaaggccaauuuccgagaaggaagagaauaugguuaaaucacuugugagcgcugguucuggcgagguagauaacuucaccaugggggugcugugcuuggccauccucuuugaagaggucaugcgcggaaaguucggcaagaaacauaugaucgcagggguguucuuuacguucguucugcuacuguccggacagauuacuuggcgggacauggcucacacccucaucaugauuggcaguaaugccagcgauagaauggguaugggggugacauaccuggcacuuauagccaccuuuaagauccaacccuucuuggcucugggauuuuucuuaaggaaacucacuucucgcgaaaaccugcuucugggcgucggccuagcgauggccacaacccuccagcugccggaggacauugaacagauggcaaaugggaucgcuuugggacugauggccuuaaagcucauuacacaguuugagacuuaucaacuguggaccgcccuuaucucccugacguguucaaacacaauauucaccuugacuguggcuuggcgaaccgcaacacucauccuggccgguguuagucuacugccugugugccagagcucguccaugcggaaaacugauuggcuuccaaugaccgucgcggcuaugggcguacccccucucccccuguuuauuuucucuuugaaggacacgcugaagcguagaagcuggccauuaaaugagggggugauggccguuggacucgugucaauccuggcaaguucccuucugaggaacgaugucccuauggccggccccuugguggcuggugggcuccugauugcauguuacguaaucacaggaaccucugccgaccuaacuguggaaaaagcggcugacgucacaugggaggaagaggccgaacagaccggcguuagccauaaccugaugauaacuguggaugacgauggcacaaugcgcauuaaggacgaugagaccgagaauauccuuacggugcuccugaaaacugcauuguuaaucgucuccgggauuuuuccauacucaauaccggccacccugcucguguggcacacauggcagaagcaaacccagcggagcggaguucugugggacguaccuagucccccagaaacacagaaagcugagcuugaagaggguguguauagaaucaagcagcaaggcauuuucgggaaaacucaggucggagugggcguucagaaggaggguguguuucauaccauguggcacgucacgagaggggccgugcugacauacaacggaaagcgauuggaacccaauugggcaucugucaagaaggaucuaaucuccuauggcggcggguggcgccugagcgcucaauggcagaaaggagaggaaguccaggugauugccguugagccugguaagaaccccaagaauuuccagacuaugcccggcaccuuccaaacaaccacuggggaaaucggagcgauagcccucgacuuuaagccuggcaccucggguucaccgaucauuaaccgggaggggaagguggucggacuguacggcaauggcgugguuaccaagaacgggggauaugugucugguaucgcacagacgaaugcugagccagauggccccacuccugaacuugaggaagagauguucaagaaaagaaacuuaaccauuauggaccugcacccagggaguggaaagacaaggaaauaccuccccgccaucguccgugaagcuauaaagcgccgguugagaacccugauucucgcaccuacuagggugguagccgccgagauggaggaagcucugaagggccuuccgauccgauaucagacaaccgcgacgaaauccgagcauacuggucgggaaaucguggaucugaugugccacgcaacauuuaccaugcgcuugcuaagccccguuagagucccaaauuacaaccugauuaucauggacgaggcccauuucaccgauccugcuucuauagccgcaaggggguacauuagcacucgggugggaaugggcgaagccgcugcgaucuuuaugacagccacacccccaggcacagcagacgcuuucccucaguccaaugcccccauucaagacgaggagcgagauaucccagaaagaucauggaacagugggaaugaguggauaacugacuuugcaggaaagacggugugguucgucccgagcauuaaagccgguaacgauaucgcuaacugucuccgcaagaauggcaaaaagguaauccaguuaucuaggaagaccuuugacacagaauaucagaaaacuaagcugaacgauugggacuucgugguuaccacagauauuuccgagaugggggccaauuuuaaagcggaccgugugaucgauccucggagaugccuuaagcccgucauucugaccgacggaccagagagggugauacucgcaggccccaugccuguuacugccgcuucagccgcucagcgccgagguagaguggggcggaacccacaaaaagaaaaugaucaguacaucuucacgggccagcccuugaacaaugacgaggaccacgcacauuggaccgaagccaagaugcugcucgauaacauuaauacaccugagggaaucaucccggcucuguucgaaccagagagggagaagagugccgcaauugacggcgaauaucgccuuaaaggggagagccguaagacuuuugucgaacuaaugagacggggagaucugcccgugugguuggcgcacaaaguagccuccgaggguauaaaguacaccgacaggaaauggugcuucgauggccagcgcaacaaucaaaucuuagaagagaacauggacguggagauuuggacaaaggaaggggagaaaaagaagcugcgaccuagauggcucgaugcucggaccuauucugacccccuggcccuuaaagaauuuaaggauuucgcagcuggaaggaaaucgaucgcccuggaccucguuacugagauuggccgcgucccaagccacuuggcacauagaacaaggaaugcccuggauaaccuagugaugcugcacacgucagaacauggugggaaggcuuaccggcacgcgguggaggagcucccugaaaccauggagacucuucuguuauugggccugaugauccuccugacaggaggcgccaugcuuuuucugauauccgggaaaggaaucgguaagaccaguauuggccucaucugugucauugcaucuagcgggauguuguggauggcugaaaucccccugcaguggauagccuccgccauuguuuuagaguucuuuaugauggugcuacugaucccagagccugaaaagcagcguaccccgcaagacaaucagcucgcauauguagugauuggaauccuuacacuggcugccauaaucgcggcuaacgagaugggcuugcuggaaacuacgaaacgcgaucucgguaugucaaaggagcccggggucgugucuccaaccagcuaccuggacguugaccuucacccugccagugcauggacacucuacgccguggcuacuaccgucauuacacccaugcugcgacauaccaucgaaaauuccacugcaaacgucagcuuggccgcgauugcuaaccaggccgugguucugaugggcuuagauaaaggauggccaaucucuaagauggaccuaggcgugccucugcucgcacuugggugcuauucacaggucaauccccugacguugacagccgcugugcugcuccugauaacccacuacgccauuaucggaccgggccuucaagcaaaagcuacuagagaggcccagaagaggaccgcggccgguaucaugaagaacccaacagucgaugggauuaugacuaucgacuuagauccugugauauaugacuccaaauucgagaagcagcugggacagguuaugcucuuggugcugugugcaguacaacuacugcucaugcggaccaguugggcucuuugcgaagcccugacauuggcaacgggccccauuaccacucugugggaggguagcccaggcaaauuuuggaauacaaccaucgcugugucgauggccaacauuuuccgcgggucuuaccucgccggagcgggccuggcuuuuuccaucaugaaaagcgucgggacuggaaaaagaggcacagguucacagggggaaaccuuaggagagaaguggaagaagaaacuuaaucagcugaguaggaaagaguucgaucucuauaagaaaucuggcauaacggagguugaccggaccgaggcaaaagaaggucuaaaacgaggcgaggugacacaucacgccgucuccagagggagcgcuaagcugcagugguuuguggaacgcaacaugguaauccccgagggaagggugauugauuugggcugugggcggggaggcuggucauacuauugcgccggucugaagaaaguuacugaagugcguggguacaccaagggaggcccuggccaugaggagccgguccccaugaguacauacggguggaauaucgugaaacucaugagcggaaaggacgucuucuaucuuccaccugaaaaaugugauacucuguugugcgacauuggugaguccucucccagcccuaccguggaagaguccagaacaaucaggguucugaagaugguagagccauggcucaagaacaaucaauucuguauuaaaguguuaaaccccuacaugccuaccgucaucgaacaccuggagcgccuucagcggaagcacggcgggaugcuggugcgaaauccacuaucaagaaacucuacucaugaaauguauuggauaaguaauggaacgggcaacauuguugcaucggugaauauggucagcaggcuccuguugaaccgcuuuacaaugacccaccggagacccacuaucgagaaagauguggaccugggugccgggacccgucauguaaacgcugaaccggagacaccuaauauggacgugaucggagagaggauuaagcggauaaaagaagaacacaacuccacguggcacuacgaugacgaaaauccauauaagaccugggcguaccauggcucuuaugagguuaaggccacuggcucagcaagcuccaugaucaacggggucgugaaacuccuuacaaagcccugggauguggucccuaugguuacccagauggcuaugacugacacaaccccauucggacaacagcgcguguuuaaagaaaagguagauacacgaacucccagaaguaugccggguaccaggcgggugaugggcauuacggccgaguggcuguggcgcaccuuagggagaaauaaaaagccuaggcugugcacacgagaggaguucacuaagaaaguccggaccaacgcagccaugggagcuguguuuacagaggaaaaucagugggacucugccaaggcggcaguugaggaugaagacuucuggaaauugguggagcgugagagagaacuccacaagcugggcaaaugugguagcugcgucuacaacaugauggggaagcgcgagaaaaagcuaggagaauuuggcaaggccaaaggcucaagggcuaucugguacauguggcuuggggcccgguaucuggaguucgaggcacucggauuucugaaugaagaucauugguucuccagagagaacaguuacagcgguguggaaggcgagggguugcacaagcugggauauauucuccgcgacaucucuaaaauacccggcggugcuauguacgccgaugacacugcugggugggacaccaggaucacggaagaugaccuucauaaugaggagaagauuacacagcaaauggauccagaacacaaacagcuggccaacgcaaucuuuaaguuaaccuaucagaauaagguaguuaaagugcagcgaccuacucccacaggaaccgucauggacauuaucucccggaaggaucaaagaggcucaggccagguggggacuuacggacugaacaccuucacaaauauggaggcgcaguugauaaggcagauggaaggugagggcgugcucagcaaagccgaccuggaaaacccacaccuacccgagaagaaaauuacgcaauggcuugagaccaagggggucgaacgccugaagcguauggcuaucucgggagaugacugcguugugaaaccuaucgaugaccgguuugccaacgcacuccuggcuuugaaugauaugggcaagguaagaaaagacauuccacaguggcagccgucuaaggguuggcaugauuggcagcaagugcccuucuguagucaccauuuccacgaguuaauaaugaaagacgggaggaagcuggucgugccuugccgcccacaggacgaacucaucggacgagcccggauuucccagggcgcaggcuggagccuuagagagacugccugucuggcgaaggcuuaugcccaaauguggucacuaauguacuuucacaggcgcgaucugagacucgcauccaacgccaucugcucugcuguucccgugcauugggucccuacaagccggaccacuuggaguauucacgcccaucaccaguggaugacaaccgaagacauguugacgguguggaauaggguauggaucgaggauaacccauggauggaggacaaaacacccguuaccacuugggaaaaugugccuuaccuggggaagcgugaggaucagugguguggaucccuuauaggucugaccagccgagcaacaugggcucagaacaucccgacugccauucaacagguccgcucucucaucggcaaugaagaguucuuagacuauaugccaucaaugaaaagauuucggaaggaggaagagagugaaggggcgauuugguga

SEQ ID NO: 15544 - RNA, 9873 nt, Artificial Sequence
  derived and/or modified CDS sequence (opt3) from DENV-3__FJ850110__SS-prME
accagccugugccucaugaugauccuucccgcagcucuggcauuccacuugacauccagagacggcgaaccuaggaugauuguggggaagaacgaacggggaaagucuuuacuguuuaagacugccucagguauaaauauguguacgcuaaucgcgauggaucucggcgaaaugugcgacgauaccgucacauacaaguguccacauauuacugaaguugagccggaagacaucgauugcugguguaaccugaccaguacaugggugaccuaugggacuugcaaucaggcuggagagcaccgccgagacaagcguuccguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaggauagugacagcggaaacucaaaacaguuccuucauuaucgauggccccaauaccccagagugccccaacacgagccgggccuggaauguuugggaaguggaggacuaugguuuuggggucuucacaaccaacauuuggcugaaacuucgcgaaguguacacucaguugugugaccacagacucaugucugcugcaguuaaagaugagagggccgugcacgcugacaugggauacuggaucgagucacagaagaauggcaguuggaaacuggaaaaggccagccuaauagagguaaaaaccugcacauggccuaagucccauacucuguggucuaacgguguccucgaaucggauaugaucauuccaaagagccuggcaggcccgaucucccagcacaauuaucgucccggguaccauacccaaacagcgggaccuuggcaccuuggcaaauuggagcuggacuuuaacuauugcgaggggacgaccguggugauuacugaaaauuguggaacacggggcccaucauuacgaaccacuacagucagugguaagcucauccacgaguggugcuguagaucuugcacccugcccccucuuagguacaugggggaagauggauguugguauggcauggagauacgcccaauuaacgaaaaagaggagaauaugguuaagagccugguguccgccgguucaggcgaaguagacaacuucacgauggggguguugugccucgcuauccuguuugaggaagucaugcggggaaaauucggcaagaagcauaugaucgccgggguguucuuuacuuucguucuacugcucagcggacagauuaccuggagagauauggcacacacacugaucaugauuggcucuaaugcuaccgacaggauggguaugggggugacuuaccuugccuugauagcaacauuuaaaauccagcccuuccuggccuuaggauuuuuccuccgcaagcugaccucccgagagaaccuucugcuaggcgucggccucgcuauggcgacaacucugcaauugccggaagauauugagcagauggccaaugggaucgcacugggauuaauggcucucaaacugauuacccaguuugagacguaucagcuuuggacagcccugaucaguuugaccuguagcaacacuauauucacccucacaguggccuggcggacugcuacccugauccuagccgguguuucucugcuuccugugugccaauccucaaguaugcguaagacggacuggcucccaaugacagucgccgcgaugggcguacccccucugcccuuguuuauuuucagccugaaagauaccuuaaagagaaggucguggccacucaacgaaggggugauggcuguuggacugguguccauccuugccucuagccuguugcgcaaugacgucccuauggcaggcccccucguggccggugggcugcuaauugcuuguuacguaaucacuggaacaucagcagaucugaccguggagaaggccgcggacgucacuugggaagaggaagcugagcagacaggcguuagucauaaccuuaugauaaccguggacgaugacggcacgaugcggauuaaagaugacgagacugaaaauauccucaccgugcuguugaagacagccuuacugaucgucuccgggauuuuuccauacucuauaccggcaacccuccugguguggcacacauggcagaaacagacucaaagaagcggaguucuuugggauguaccuucacccccagagacccagaaggccgaacuggaggaggguguguauaggaucaaacagcagggcauuuucgggaagacgcaagucggagugggcguucagaaagaagguguguuucauacaauguggcacgucacucgaggggcuguguugaccuacaacggaaagcgccuagagcccaauugggccagcguaaagaaagaccugaucagcuauggcggcggguggcggcucagugcacaguggcaaaagggagaagagguccaggugauugcuguugaaccugguaaaaacccaaagaauuuccagacaaugcccggcaccuuccagacuaccacaggggagaucggagccauagcgcuggauuuuaaaccuggcacgucugguuccccgaucauuaacagagaggggaagguggucggacuuuacggcaauggcgugguuacuaagaacgggggauaugugagcgguaucgcccaaaccaaugcagaaccagacggccccacaccugaguuagaagaggaaauguucaaaaagaggaaccugaccauuauggaucuccacccagggucgggaaaaacucguaaguacuugcccgcuaucguccgcgaggccauaaaacggagacugaggacacucauucuggcuccuacccgagugguagcagccgagauggaagaggcccuuaagggccugccgauccgguaucagacgacugcuacaaagucagaacauaccggucgcgagaucguggacuugaugugccacgcgaccuuuacuaugagacuacugucucccguuagggucccaaauuacaaccucauuaucauggaugaagcacauuucacagacccugccaguauagcugcccggggguacauuuccacccgagugggaaugggcgaggcagccgcuaucuuuaugacagcgacucccccaggcacggccgaugcauucccucagagcaaugcucccauucaggacgaggaaagagacaucccagagcgcucuuggaacagcgggaacgaauggauaaccgauuuugccggaaaaacagugugguucgucccguccauuaaggcagguaaugacaucgccaacuguuuaaggaaaaauggcaagaaaguaauccaacugucacguaagacuuuugauaccgaguaucagaagacaaaacuuaacgacugggauuucgugguuaccacugacauuagugagaugggggcuaauuuuaaggccgaucgggugaucgacccuagaaggugccugaaacccgucauucucacggauggaccagaacgcgugauauuggcgggccccaugccuguuaccgcagccagcgcugcccagcgaagaggucggguggggaggaacccacagaaggagaaugaccaauacaucuucacaggccagccccugaacaaugaugaagaccacgcucauuggacugaggcaaaaaugcuccuggacaacauuaauaccccugaaggaaucaucccggcccuuuucgagccagagcgcgaaaagucugcugccauugauggcgaguaucgucuaaagggggaauccagaaaaacauuugucgagcugaugcggaggggagacuugcccgugugguuagcacacaagguagcgucagaagguauaaaauacaccgaucgcaaguggugcuucgacggccagcgaaacaaucagauccuggaggagaacauggauguggaaauuuggacuaaagagggggaaaagaaaaagcucagaccucgguggcuggacgccaggacauauagugauccccuugcucugaaggaguuuaaagacuucgccgcaggacgcaagagcaucgcucucgauuugguuacggaaauuggcagagucccaacccaccuggcccauaggacucggaaugcacuagacaaccuggugaugcuccacacauccgagcauggugggaaagccuaccgucacgcuguggaggaacuuccugagaccauggaaacccuguuauugcugggccucaugauccugcuuacaggaggcgcgaugcuguuucucauaucugggaagggaaucgguaaaacuucgauuggcuugaucugugucauugccagcucagggaugcuguggauggcagagauccccuuacaauggauagcuuccgccauuguucuagaguucuuuaugauggugcugcucaucccagaaccugagaagcagcgcacgccgcaggauaaucaacuugccuauguagugauuggaauccugaccuuggcagcuauaaucgccgcgaacgaaaugggccugcucgagacaacuaagcgagaccuggguaugaguaaagaacccggggucgugucuccaaccagcuaccuugauguugaccuccacccugcuuccgccuggacacuguacgcaguggccaccacugucauuacgcccauguugagacauacaaucgagaacucaaccgcuaauguaucucuggcagccauugcgaaccaggcugugguuuuaaugggccuagacaagggauggccaaucagcaaaauggaucugggcgugccucuccuugcccuggggugcuauagucaggucaaucccuugacucugaccgcagccgugcuccugcuuauaacacacuacgcuauuaucggaccgggcuuacaggccaaggcaacuagggaggcucaaaaacggaccgccgcggguaucaugaagaacccaacagucgacgggauuaugacgaucgaucuggacccugugauauaugauuccaaguucgaaaaacagcucggacagguuauguugcuggugcuaugugccguacagcugcuccuuaugcgcaccagcugggcacugugcgaggcuuugacucuggccacaggccccauuaccacucucugggaagguucuccaggcaaguuuuggaauacaaccaucgcagugucaauggcuaacauuuucagaggguccuaccuggccggagccggcuuagcguuuaguaucaugaaaagcgucgggacgggaaagaggggcaccgguucgcaaggggagacacuuggagaaaaauggaagaagaaacugaaucagcucucucggaaggaguucgaccuauauaaaaaguccggcauaacugagguugaucgaaccgaagcuaaagagggucugaagagaggcgaaaucacacaucacgcagugagccgcgggucagccaaauugcagugguuugucgagaggaacauggugauucccgaaggacggguaaucgaccugggcugugggcguggaggcuggaguuacuauugcgcuggucucaagaaggugacugagguuagaggguacaccaaaggaggcccuggccaugaggaaccggugcccaugucuacauacggguggaauauugucaaacuuauguccggaaaagauguguucuaucugccaccugagaagugugacaccuugcugugcgauaucggugaaagcucacccaguccuacugucgaggagagcaggacgauucgcgugcucaaaaugguugaaccaugguuaaagaacaaucaguucuguaucaagguacugaaccccuacaugccugccgugauagagcaccuugaacggcugcaacgaaaacacggcgggaugcuagucagaaauccacucuccaggaacucuacacaugagauguauuggauuagcaauggaaccggcaacaucguggcauccguuaacauggugucacgccuguugcugaaucgguuuacuaugacccacagacgucccacaaucgaaaaggacgucgaucucggugccgggacgaggcaugugaacgcugagccggagaccccuaauauggacguaauuggagaacggauaaaacgcaucaaggaggaacacaacucuacuuggcacuacgacgaugagaauccauauaaaacaugggcguaccauggcaguuaugaagugaaggccaccggcucggcaagcuccaugauuaacgggguugucaaacuucugacuaaacccugggacguggugccuauggucacacagauggcuaugaccgauacaacuccauucggacagcaacgaguuuuuaaggagaaaguggacaccagaacgcccaggucuaugccggguacccggcgcguaauggagaucacagccgaaugguuauggagaacucugggcaggaauaagaaaccucgauugugcacccgggaggaguucacaaagaaggugcguacuaacgcagccaugggggcugucuuuaccgaggaaaaucagugggauucagccaaagcggcaguggaggacgaggauuucuggaagcucguugacagagaacgcgagcugcacaaacuaggaaaguguggcagcugcguguacaacaugauggguaaaagggaaaagaaacuuggggaguuuggaaaggccaagggcucccgggcuauuugguacauguggcugggcgccagauaucucgaguucgaagcacugggguuuuugaaugaggaucauugguucagucgcgaaaacucuuacagcggagucgagggugaaggccugcacaaacucggguauauccuuagggacauaucaaagauccccggaggcgcuauguacgccgaugacacggcugguugggacacacgaauuaccgaggaugaccugcauaaugaggagaagaucacucagcagauggauccagagcaccggcaauuagccaacgcaauuuuuaagcugacauaucagaauaaagugguaaagguucagagaccuacccccacugggaccgugauggacaucauauccaggaaggaucagcgcggaaguggccaagucggcacauacggguugaacacguucaccaacauggaagcgcagcucauucgucagauggagggagaaggugugcugagcaaagccgaccuagagaauccacaccuucccgagaagaaaaucacucaguggcuggaaacaaagggcguggagcggcucaaaagaauggcuaucucuggggaugacugcgucguuaagccuauugaugacagguuugccaacgcacuguuggcuuuaaaugauaugggaaaggugcgcaaagacauaccacaauggcagccguccaagggcuggcaugauuggcagcagguacccuucuguucacaccauuuccacgaacugaucaugaaagacggucgaaagcucguggucccuugccggccacaagacgagcuuauugggagagccaggaucagccagggagcaggcuggucgcugcgcgaaaccgccugucuaggcaaagcguaugcucagauguggucucugauguacuuucacagacgggaucucagguuggccaguaacgcaauuugcuccgccgugcccguucauugggugccuacuagccguacaaccuggucaauccacgcucaucaccaauggaugacgacagaggacaugcugaccgucuggaaucgaguguggauagaggauaacccauggauggaagacaagacucccguaaccacaugggagaauguuccuuaccuugggaagcgcgaagaucagugguguggaucccugaucggucucacuucuagagccaccugggcacagaacauuccgacagcuauccagcaagugcggagcuuaauuggcaaugaggaguuccuggacuauaugccaaguaugaaaagguuucgcaaggaagaggaauccgagggggccaucugguga

SEQ ID NO: 15545 - RNA, 9873 nt, Artificial Sequence
  derived and/or modified CDS sequence (opt3) from DENV-3__FJ850111__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacagcuugaaaaucaauugguauaagaaggggaguucuauuggaaaaauguuugaagccacagcucgcggugccagaaggauggcaauacugggcgacacugccugggauuucggguccguuggaggcgugcucaacagccuggguaagaugguccaccagaucuuugggucggcuuacaccgcccuuuucucuggcguguccuggguaaugaaaauuggaaucggcgugcuguugacguggaucgggcucaauucaaagaacacaaguaugagcuuuuccugcauugcaauaggaaucauuacccuguauuuaggcgcgguuguccaggcugacacugguugugugaucaauuggaaagggaaggagcugaagugcggaucuggcauuuucgugacaaacgagguccauaccuggacugaacaguacaaauuucaagccgauagccccaagcggcuagcaaccgccaucgcuggugccugggagaauggcguuugugggauacgaucaacaacgcgcauggaaaaccuccuguggaaacagaucgcaaaugagcuuaacuauauuuugugggaaaauaacaucaagcugaccguggugguaggagacauuaucggcguccucgagcaggggaaaagaacucugacaccacagccuauggaguuaaaguacaguuggaaaaccuggggaaaggcuaggauagugacagccgaaacucaaaacuccagcuucauuaucgauggccccaauaccccagagugccccaacacgucucgggcguggaauguuugggaaguggaggacuaugguuuuggggucuucacaaccaacauuuggcugaagcuucgcgaaguguacacucaguugugugaccacagacucaugucagccgcuguuaaagaugagagggcagugcacgccgacaugggauacuggaucgagagucagaagaauggcagcuggaaacuggaaaaggcuucccuaauagagguaaaaaccugcacauggccuaagucucauacucuguggucgaacgguguccucgaaagcgauaugaucauuccaaagucccuggccggcccgaucucacagcacaauuaucgucccggguaccauacccaaacagcaggaccuuggcaccuuggcaaauuggagcuggacuuuaacuauugcgaggggacgaccguggugauuacugaaaauuguggaacacggggcccaaguuuacgaaccacuacagucucugguaagcucauccacgaguggugcuguagaagcugcacccugcccccucuuagguacaugggggaagauggauguugguauggcauggagauacgcccaauuuccgaaaaagaggagaacaugguuaagucacuggugagcgcggguucuggcgaaguagacaauuucacgauggggguguugugccucgccauccuguuugaggaagucaugcggggaaaauucggcaagaagcauaugaucgcugggguguucuuuacuuucguucuacugcucuccggacagauuaccuggagagauauggcccacacacugaucaugauuggcaguaacgcaaccgacaggauggguaugggggugacuuaccuugcuuugauagccacauuuaaaauccagcccuuccuggcauuaggauuuuuccuccgcaagcugaccagccgagagaaucuucugcuaggcgucggccucgccauggcuacaacucugcaauugccggaagauauugagcagauggcgaacgggaucgcccugggauuaauggcacucaaacugauuacccaguuugagacguaucagcuuuggacagcucugaucucuuugaccuguuccaauacuauauucacccucacaguggccuggcggacugccacccugauccuagcugguguuucacugcuuccugugugccaaaguagcucgaugcguaagacggacuggcucccaaugacagucgcagccaugggcguacccccucugcccuuguuuauuuucucccugaaagauaccuuaaagagaaggucuuggccacucaacgaaggggugauggcgguuggacuggugagcauccuugcuucaagucuguugcgcaacgacgucccuauggccggcccccucguggcaggugggcugcuaauugccuguuacguaaucacuggaacauccgcugaucugaccguggagaaggcagccgacgucacuugggaagaggaagcggagcagacaggcguuucucauaaucuuaugauaaccguggacgaugacggcacgaugcggauuaaagaugacgagacugaaaacauccucaccgugcuguugaagacagcuuuacugaucgucagcgggauuuuuccauacuccauaccggccacccuccugguguggcacacauggcagaaacagacucaaagaucaggaguucuuugggauguaccuagccccccagagacccagaaggcagaacuggaggaggguguguauaggaucaaacagcagggcauuuucgggaagacgcaagucggagugggcguucagaaagaagguguguuucauacaauguggcacgucacucgaggggccguguugaccuacaauggaaagcgccuagagcccaacugggcuaguguaaagaaagaccugaucucuuauggcggcggguggcggcucuccgcccaguggcaaaagggagaagagguccaggugauugcaguugaaccugguaaaaauccaaagaacuuccagacaaugcccggcaccuuccagacuaccacaggggagaucggagcuauagcccuggauuuuaaaccuggcacgagcgguucgccgaucauuaauagagaggggaagguggucggacuuuacggcaacggcgugguuacuaagaaugggggauaugugucagguaucgcgcaaaccaacgccgaaccagacggccccacaccugaguuagaagaggaaauguucaaaaagaggaaucugaccauuauggaucuccacccagggucuggaaaaacucguaaguacuugcccgcaaucguccgcgaggcuauaaaacggagacugaggacacucauucuggccccuacccgagugguagcugcagagauggaagaggcccuuaagggccugccgauccgguaucagacgacugccacaaagagugaacauaccggucgcgagaucguggacuugaugugccacgcuaccuuuacuaugagacuacugucccccguuagggucccaaacuacaaucucauuaucauggaugaagcgcauuucacagacccugcaagcauagccgcucggggguacauuucuacccgagugggaaugggcgaggccgcagccaucuuuaugacagcuacucccccaggcacggcggaugccuucccucagagcaacgcacccauucaggacgaggaaagagacaucccagagcgcuccuggaauucagggaacgaauggauaaccgauuuugcuggaaaaacagugugguucgucccgaguauuaaggccgguaacgacaucgcaaauuguuuaaggaaaaacggcaagaaaguaauccaacugagccguaagacuuuugauaccgaguaucagaagacaaaacuuaaugacugggauuucgugguuaccacugacauuucugagaugggggccaacuuuaaggcugaucgggugaucgacccuagaaggugccugaaacccgucauucucacggauggaccagaacgcgugauauuggccggccccaugccuguuaccgcggcauccgccgcucagcgaagaggucggguggggaggaauccacagaaggagaacgaccaauacaucuucacaggccagccccugaauaacgaugaagaccacgcccauuggacugaggcuaaaaugcuccuggacaauauuaacaccccugaaggaaucaucccggcacuuuucgagccagagcgcgaaaagucagccgcuauugauggcgaguaucgucuaaagggggaaaguagaaaaacauuugucgagcugaugcggaggggagacuugcccgugugguuagcccacaagguagcaagcgaagguauaaaauacaccgaucgcaaguggugcuucgacggccagcgaaauaaccagauccuggaggagaauauggauguggaaauuuggacuaaagagggggaaaagaaaaagcucagaccucgguggcuggacgcgaggacauauuccgauccccuugcccugaaggaguuuaaagacuucgcugccggacgcaagucuaucgcacucgauuugguuacggaaauuggcagagucccaacccaccuggcucauaggacucggaacgcccuagacaaucuggugaugcuccacacaucggagcauggugggaaagcauaccgucacgccguggaggaacuuccugagaccauggaaacccuguuauugcugggccucaugauccugcuuacaggaggcgcuaugcuguuucucauaagcgggaagggaaucgguaaaacuucaauuggcuugaucugugucauugcguccagugggaugcuguggauggccgagauccccuuacaauggauagcaucugcuauuguucuagaguucuuuaugauggugcugcucaucccagaaccugagaagcagcgcacgccgcaggauaaccaacuugccuauguagugauuggaauccugaccuuggccgcaauaaucgcugccaaugaaaugggccugcucgagacaacuaagcgagaccuggguaugagcaaagaacccggggucguguccccaaccucauaccuugauguugaccuccacccugcgucugcuuggacacuguacgccguggcaaccacugucauuacgcccauguugagacauacaaucgagaacagcaccgccaacguaagucuggcugcaauugccaaucaggcggugguuuuaaugggccuagacaagggauggccaaucuccaaaauggaucugggcgugccucuccuugcucuggggugcuauagccaggucaaccccuugacucugaccgccgcagugcuccugcuuauaacacacuacgccauuaucggaccgggcuuacaggcuaaggccacuagggaggcacaaaaacggaccgcugccgguaucaugaagaauccaacagucgacgggauuaugacgaucgaucuggacccugugauauaugauucuaaguucgaaaaacagcucggacagguuauguugcuggugcuaugugcgguacagcugcuccuuaugcgcaccucaugggcccugugcgaggcauugacucuggcuacaggccccauuaccacucucugggaagguuccccaggcaaguuuuggaacacaaccaucgccgugaguauggcaaauauuuucagagggagcuaccuggcuggagccggcuuagccuuuucgaucaugaaaucugucgggacgggaaagaggggcaccgguucccaaggggagacacuuggagaaaaauggaagaagaaacugaaccagcucagccggaaggaguucgaccuauauaaaaagucaggcauaacugagguugaucgaaccgaagcgaaagagggucugaagagaggcgaaaucacacaucacgcugugagucgcgggucugcaaaauugcagugguuugucgagaggaauauggugauucccgaaggacggguaaucgaccugggcugugggcguggaggcugguccuacuauugcgccggucucaagaaggugacugagguuagaggguacaccaaaggaggcccuggccaugaggaaccggugcccaugagcacauacggguggaacauugucaagcuuaugucaggaaaagauguguucuaucugccaccugagaagugugacaccuugcugugcgauaucggugaaaguagccccuccccuacugucgaggagucuaggacgauucgcgugcucaaaaugguugaaccaugguuaaagaauaaccaguucuguaucaagguacugaaucccuacaugccugcugugauagagcaccuugaacggcugcaacgaaaacacggcgggaugcuagucagaaacccacucagcaggaauuccacacaugagauguauuggauuucaaacggaaccggcaauaucguggccucuguuaacauggugagucgccuguugcugaaccgguuuacuaugacccacagacgucccacaaucgaaaaggacgucgaucucggugcagggacgaggcaugugaaugccgagccggagaccccuaacauggacguaauuggagaacggauaaaacgcaucaaggaggaacacaauucgacuuggcacuacgacgaugagaacccauauaaaacaugggcuuaccauggcagcuaugaagugaaggcgaccggcuccgccucuucaaugauuaaugggguugucaagcuucugacuaaacccugggacguggugccuauggucauccagauggcaaugacagauaccacaccauucggacagcaacgaguuuuuaaggagaaaguggacacuagaacccccaggagcaugccggguacgcggcgcguaauggagauuaccgcugaaugguuauggagaacacugggcaggaacaagaaaccucgauugugcacucgggaggaauucaccaagaaggugcguacaaaugccgcaaugggggccgucuuuacugaggaaaaccagugggauuccgcuaaagccgcgguggaggacgaggauuucuggaagcucguugacagagaacgcgagcugcacaaacuaggaaaguguggcaguugcguguacaauaugauggguaaaagggaaaagaaacuuggggaguuuggaaaggcaaagggcucucgggccaucugguacauguggcugggcgcuagauaucucgaguucgaagcccugggguuuuugaacgaggaucauugguucagccgcgaaaauucauacuccggagucgagggugaaggccugcacaaacucggguauauacuuagggacaucaguaagauucccggaggcgcaauguacgcugaugacaccgccgguugggacacgcgaaucacagaggaugaccugcauaacgaggaaaaaauuacccagcagauggauccagagcaccggcaauuagcuaaugccaucuuuaagcugacuuaucagaacaaagugguaaagguucagagaccuacacccaccgggacugugauggacauaauuagcaggaaggaucagcgcggaucuggccaagucggcaccuacggguugaauacauucacgaacauggaagcacagcucauccgucagauggagggagaaggugugcuguccaaagcggaccuagagaacccacaccuucccgagaagaaaaucacccaguggcuggaaacuaagggcguggagcggcucaaaagaauggccauuucaggggaugacugcgucguuaagccuauagaugacagguuugcuaaugcccuguuggcauuaaacgauaugggaaaggugcgcaaagacaucccacaauggcagccgagcaagggcuggcaugauuggcagcagguacccuucuguucgcaccauuuccacgaacugauuaugaaagacggucgaaagcucguggucccuugccggccacaagacgagcuuaucgggagagcuaggauuucucagggagccggcuggagucugcgcgaaacagcaugucuaggcaaagccuaugcgcagauguggucccugauguacuuucacagacgggaucucagguuggcuagcaaugccaucugcucagcagugcccguucauugggugccuaccucccguacuacauggucuauacacgcccaucaccaauggaugaccacggaggacaugcugacagucuggaaccgaguguggaucgaggauaauccauggauggaagacaagacccccguaacuaccugggagaacguuccuuaccuugggaagcgcgaagaucagugguguggaagccugauuggucucacaaguagagcuacuugggcccagaauaucccgaccgcaauucagcaagugcgguccuuaaucggcaacgaggaguuccuggacuauaugccaagcaugaaaagguuucgcaaggaagaggaaucugagggggcuauuugguga

SEQ ID NO: 15546 - RNA, 9873 nt, Artificial Sequence
  derived and/or modified CDS sequence (opt3) from DENV-3__KF955486__SS-prME
accagccugugccucaugaugauccuucccgccgcucuggcauuccacuugaccuccagagacggagaaccuaggaugauuguggggaagaacgaacggggaaaaucuuuacuguuuaagacugccucagguauaaauauguguacguuaaucgcgauggaucucggcgagaugugcgacgauaccguaaccuacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaccuuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccaaaauucagggggaacaaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacuaagaaagaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgagaggggccguguugacauacaacggaaagcgacuagagcccaauugggcaucugucaagaaggaccugauuuccuauggcggcggguggcgccucagcgcucaguggcaaaaaggagaagagguccaggugaucgccguugaaccugguaagaaccccaagaauuuccagacuaugcccggcaccuuccagacaaccacuggggagauuggagcgaucgcccuggauuuuaagccuggcaccucggguucaccgauaaucaaccgggaggggaagguggucggacuuuacggcaauggcgugguuaccaaaaacgggggauaugugucugguauugcacaaacgaaugcugaaccagacggccccacuccugaguuagaagaggaaauguucaagaaaagaaaccugaccaucauggaucuccacccagggaguggaaagacaaggaaauacuugcccgccauuguccgugaggcuaucaagcgccggcugagaacccucauacuggcaccuacuagggugguagccgccgagauggaagaggcucuuaagggccugccgauucgauaucagacaaccgcgacgaaauccgaacauacuggucgggagaucguggacuugaugugccacgcaacauuuaccaugcgccuacugagccccguuagagucccaaauuacaaccucaucauuauggaugaagcccauuucaccgacccugcuucuaucgccgcaaggggguacauaagcacucgggugggaaugggcgaggccgcugcgauuuuuaugacagccacaccaccaggcacagcagaugcuuucccucaguccaaugcccccauccaggacgaggaaaaggacauuccagagcgaucauggaacagugggaaugaauggaucacugauuuugcaggaaaaacggugugguucgucccgagcauaaaggccgguaacgacauugcuaacuguuuaaggaaaaauggcaagaagguaauccaacugucucgcaaaaccuuugauacagaguaucagaagacuaaacuuaacgacugggauuucgugguuaccacagacaucuccgagaugggggccaauuuuaaggcggauagggugauugacccucgucggugccugaaacccgucauccucaccgauggaccagaaagagugauuuuggcaggccccaugccuguuacugccgcuucagccgcucagaggcgcggucgaguggggagaaacccacagaaggagaaugaccaauacauauucacgggccagccccugaacaaugaugaagaccacgcacauuggaccgaggccaagaugcuccuggacaacaucaauacaccugaaggaauuaucccggcucuuuucgagccagagcgggagaaaagugccgcaaucgauggcgaguauaggcuaaagggggaaagccgcaaaacuuuugucgagcugaugcguagaggagacuugcccgugugguuagcgcacaagguagccuccgaagguauuaaauacaccgaucggaaguggugcuucgacggccagaggaacaaucagauacuggaggagaacauggauguggaaaucuggacaaaagagggggaaaagaagaaacuccgcccucgauggcuggacgcuagaaccuauucugauccccuugcccugaaggaguuuaaagacuucgcagcuggacggaagucgauugcccucgauuugguuacugaaaucggcagggucccaacacaccuggcacaucgcacgagaaaugcccuagacaaccuggugaugcuccacaccagcgagcauggugggaaggcuuacaggcacgcgguggaggaacuuccugagacuauggaaacacuguuauugcugggccucaugauucugcuuaccggaggcgccaugcuguuucucaucucagggaagggaauagguaagaccuccaucggcuugauuugugucaucgcaaguucugggaugcuguggauggcugagauucccuuacaauggaucgccagcgccauaguucuagaguucuuuaugauggugcugcucauuccagaaccugagaaacagcggacaccgcaggauaaucaacuugcauauguagugaucggcauucugacuuuggcugccaucauagcggcuaacgaaaugggccugcucgagacgaccaagcgugaccuggguauguccaaagaacccggggucgugucaccaacaucuuaccuugauguugaccuccacccugccagcgcauggacucuguacgccguggcuaccacagucaucacccccauguugcgccauacuauugagaauaguacggcaaacguaucccuggccgcgaucgcuaaccaggccgugguuuuaaugggccuagacaagggauggccaauuagcaaaauggaucugggcgugccucuccuugcacuggggugcuauucucaggucaaucccuugacacugaccgccgcugugcuccugcuuaucacucacuacgccauaauuggaccgggcuuacaggcaaaggcuacccgagaggcccaaaagagaacagcggccgguaucaugaaaaacccaacugucgacgggaucaugaccauugaucuggacccugugaucuaugauucaaaguucgaaaaacagcucggacagguuauguugcuggugcuaugugcaguacagcugcuccuuaugaggacauccugggcucugugcgaggccuugacgcuggcaaccggccccauaacuacacucugggaagguaguccaggcaaguuuuggaauaccacuauugcugugagcauggccaacaucuuccgggggucguaccuggccggagcgggcuuagcuuuuucuauuaugaaauccgucgggacaggaaagcgcggcaccgguagccaaggggagacgcuuggagaaaaguggaaaaagaaacugaaucagcucucaagaaaggaguucgaccuauauaaaaagaguggcaucaccgagguugauaggacagaagcaaaagagggucugaagcggggcgaaauaacucaucacgccgugucucgaggguccgcuaaguugcagugguuugucgagagaaacauggugauccccgaaggacgcguaauugaccugggcugugggaggggaggcuggagcuacuauugcgccggucucaaaaaggugaccgagguucggggguacacaaaaggaggcccuggccaugaggaaccggugcccaugucaacuuacggguggaauaucgucaaacuuaugaguggaaaagauguguucuaucugccaccugagaagugugacaccuugcugugcgauauuggugaaagcucccccucuccuacagucgaggagagccguaccaucagagugcucaagaugguugaaccauggcugaaaaacaaucaguucuguauuaagguacuaaaccccuacaugccuacugugaucgagcaccuugaaaggcugcaacgcaaacacggcgggaugcuaguccggaauccacucucccgaaacucaacgcaugagauguauuggauaucuaauggaacaggcaacauuguggcaaguguuaauauggugucgagacuguugcugaacagguuuaccaugacucaccgccggcccaccaucgaaaaggacgucgaucucggugccgggacaagacaugugaacgcugagccggagacgccuaauauggacguaaucggagaacguauuaaaaggauaaaggaggaacacaacagcaccuggcacuacgacgaugagaauccauauaagacuugggcguaccauggcuccuaugaagugaaagccacaggcucugcaucaagcaugaucaacgggguugucaaacuucugaccaaacccugggacguggugccuauggucacucagauggcuaugacagauaccacaccauucggacagcaacggguuuuuaaggagaaaguggacacucgcacaccccgauccaugccggguacgagaaggguaaugggcauuaccgccgagugguuauggcggacacuggggcgcaauaagaagccuagauugugcacuagggaagaguucaccaaaaaggugcgaacaaacgcagccaugggagcugucuuuacugaagagaaucagugggauagugccaaagcggcaguggaagacgaggauuucuggaagcucguugaccgggagcgugaacugcacaaacuaggcaagugugguucuugcguguacaacaugauggggaaaagagagaagaaacuuggagaauuuggcaaagccaagggcagccgcgcuaucugguacauguggcugggggccagguaucucgaguucgaggcacugggauuuuugaaugaagaucauugguucucacgggagaacuccuacaguggugucgaaggcgaggggcugcacaaacucggauauauucuuagagacaucagcaagauacccggcggugcuauguacgccgaugacaccgcugggugggacacgcgcaucacagaagaugaccugcauaaugaggagaaaauuacccagcagauggauccagaacacaggcaauuagccaacgcaaucuuuaagcugacuuaucagaauaaggugguaaaaguucagcgaccuacacccaccggaacugugauggacauuaucucucggaaggaucagagaggcuccggccaagucgggaccuacggauugaacacauucacgaauauggaggcgcagcucauaaggcagauggaaggugagggcgugcugucaaaagccgaccuagaaaacccacaccuucccgagaagaaaauuacccaguggcuggagacuaaggggguggaacgccucaagcguauggcuaucagcggagaugacugcgucguuaaaccuaucgaugaccgguuugccaacgcacuguuggcuuuaaaugauaugggcaaggugagaaaagacauuccacaauggcagccgucgaaggguuggcaugauuggcagcagguacccuucuguucucaccauuuccacgagcugauaaugaaagacgggaggaagcucguggucccuugccgcccacaagacgaacuuaucggacgagcccggauuagucagggcgcaggcuggucccugagagagacagccugucuagggaaggcguaugcucagauguggagccugauguacuuucacaggcgcgaucucagauuggccucaaacgcaaucugcuccgccgugcccguucauugggugccuaccucucggacuacauggagcauucacgcucaucaccaauggaugaccacggaagacaugcugacagucuggaauaggguguggaucgaggauaacccauggauggaggacaaaacccccguaacuaccugggaaaauguuccuuaccuuggaaagcgugaggaucaguggugugguagucugauaggccucacaucccgagccacuugggcacagaacaucccgaccgcuauucagcaagugcgcagcuuaaucgggaaugaagaguuccuggacuauaugccaucuaugaaaagauuucggaaggaggaagagucagaaggagccauuugguga

SEQ ID NO: 15547 - RNA, 9873 nt, Artificial Sequence
  derived and/or modified CDS sequence (opt3) from DENV-3__FJ898468__SS-prME
accagccugugccucaugaugauccuuccagccgcucuggcauuccacuugacuuccagagacggagaaccuaggaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacgucauuggcgugcucgagcaggggaaaagaacccugacuccacagccuauggaguuaaaguacucauggaaaacauggggaaaggccaagaucguuaccgcggaaacacaaaacaguuccuucauaauugauggccccaauacuccagagugccccagcgccucuagggcuuggaacgugugggaagucgaggacuaugguuuugggguguucaccacgaauaucuggcugaaacuucgggaaguuuacacacaguugugugaccaccgccucaugucagcagccgugaaggaugagagagcuguacacgccgacaugggauacuggauugagagucagaaaaacggcagcuggaagcuggaaaaagcaucccuaaucgaggucaagaccugcacuuggccuaagucucauacccuguggucgaauggugugcucgaaagcgauaugauaaucccaaaaucccuggcgggcccgauuucacagcacaacuauaggcccggguaccauacacaaacugccggaccuuggcaccuuggcaaguuggagcuggacuuuaauuauugcgaggggaccacaguggucaucacggaaaacuguggaacccguggcccaaguuuacggacuacaaccguuucugguaaacucauucacgaguggugcugucgaagcugcacucugcccccucuuagauacaugggggaagauggauguugguauggcauggagaucaggccaauauccgaaaaggaggagaauauggugaaaucacugguaagcgcugguucuggcgaaguggacaacuucacaaugggggucuugugccucgccauucuguuugaggaagugaugcgcggaaaguucggcaagaaacauaugaucgcagggguuuucuuuaccuucgugcuacugcucuccggacagaucacguggcgggauauggcucacacucugauuaugaucggcaguaaugccagcgacagaauggguaugggggucaccuaccuugcauugauugccacauuuaagauacagcccuuccuggcuuuaggauuuuuccucaggaaacugaccucucgcgagaaccuucugcuaggcgugggccucgcgauggccacuacacugcaauugccggaagauaucgagcagauggcaaaugggauugcucugggauuaauggcccucaagcugaucacccaguuugagacauaucagcuuuggacugcccugauuuccuugaccuguucaaacacgaucuucacacucaccguugcuuggcgaacugcaacccugauacuagccggugugagucugcuuccugucugccaaagcucguccaugcggaaaacagacuggcucccaaugacuguagcggcuaugggcgugcccccucugcccuuguuuaucuucucucugaaggauaccuuaaagcguagaagcuggccacucaaugaagggguuauggccgugggacuggucucaauucuugcaaguucccuguugaggaacgacgugccuauggccggcccccucguagcuggugggcugcuaaucgcauguuacgugauuacgggaacaucugccgaucugaccgucgagaaagcggcugacguuacuugggaagaggaagccgagcagacaggcgugagccauaaccuuaugaucaccguggacgaugacggcacuaugcgcauaaaggaugacgagacagaaaauauucucaccguccuguugaaaacggcauuacugaucguguccgggaucuuuccauacucaauuccggccacucuccugguuuggcacaccuggcagaagcagacacaacggagcggaguacuuugggaugugccuagucccccagagacccagaaagcugaacuggaggagggugucuauagaauaaagcagcagggcaucuucgggaaaacacaagugggaguuggcgugcagaaggaaggugucuuucauacuauguggcacgugaccagaggggccguauugacguacaacggaaagcgacuagagcccaauugggcaucugucaaaaaggaccugauuuccuauggcggcggguggcgccucagcgcucaguggcaaaaaggagaagaggugcagguuaucgccguggaaccugguaagaaccccaagaauuuccagacaaugcccggcacuuuccagaccacaaccggggagauuggagcgaucgcccuggauuuuaagccuggcacuucggguucaccgauaaucaaccgggaggggaaggucgugggacuuuacggcaauggcguugugaccaaaaacgggggauaugucucugguauugcacaaacaaaugcugaaccagacggccccacgccugaguuagaagaggaaauguucaagaaaagaaaccugacuaucauggaucuccacccagggaguggaaagaccaggaaauacuugcccgccauugugcgugaggcuaucaagcgccggcugagaacacucauacuggcaccuaccaggguaguggccgccgagauggaagaggcucuuaagggccugccgauucgauaucagacuacagcgaccaaauccgaacauacgggucgggagaucguugacuugaugugccacgcaacuuuuacaaugcgccuacugagccccgucagagugccaaauuacaaccucaucauuauggaugaagcccauuucaccgacccugcuucuaucgccgcaaggggguacauaagcacccgggugggaaugggcgaggccgcugcgauuuuuaugacugccacacccccaggcaccgcagaugcuuucccucaguccaaugcccccauccaggacgaggaacgagacauuccagagagaucauggaacagugggaaugaauggaucacagauuuugcaggaaagacugucugguucguaccgagcauaaaagccgguaacgacauugcuaacuguuuacgcaagaauggcaaaaaggugauccaacugucuaggaagacguuugauaccgaguaucagaaaacaaaacuuaacgacugggauuucguugugacuaccgacaucuccgagaugggggccaauuuuaaagcggaucgugucauugacccucggagaugccugaagcccgugauccucacagauggaccagaaaggguuauuuuggcaggccccaugccugugaccgccgcuucagccgcucagcgccgagguagagucgggcggaacccacagaaagagaaugaccaauacauauucacuggccagccccugaacaaugaugaagaccacgcacauuggacggaggccaagaugcuccuggacaacaucaauaccccugaaggaauuaucccggcucuuuucgagccagagagggaaaagagugccgcaaucgauggcgaguaucgccuaaaaggggaaagccguaagacauuuguggagcugaugagacggggagacuugcccguaugguuagcgcacaaaguggccuccgaagguauuaaguacacugauaggaaauggugcuucgacggccagcgcaacaaucagauacuggaggagaacauggauguugaaaucuggaccaaggagggggagaagaagaagcuccgaccuagauggcuggacgcucggacauauucugauccccuugcccugaaagaguuuaaggacuucgcagcuggaaggaaaucgauugcccucgauuuggucaccgaaaucggccgcgugccaagccaccuggcacauagaacuaggaaugcccuagacaaccuggugaugcuccacacaucagagcauggugggaaggcuuaccggcacgcggucgaggaacuuccugagacgauggaaacccuguuauugcugggccucaugauucugcuuacuggaggcgccaugcuguuucucaucuccgggaaaggaauagguaagacaaguaucggcuugauuuguguuaucgcaucuagcgggaugcuguggauggcugagauucccuuacaauggaucgccuccgccauagugcuagaguucuuuaugaugguacugcucauuccagaaccugagaagcagcguaccccgcaggauaaucaacuugcauauguggucaucggcauucugaccuuggcugccaucauagcggcuaacgaaaugggccugcucgagacaacuaaacgcgaccuggguaugucaaaggaacccggggugguuucuccaacgagcuaccuugauguggaccuccacccugccagugcauggacccuguacgccgucgcuacaacuguaaucacccccauguugcgacauacaauugaaaauuccaccgcaaacgugagccuggccgcgaucgcuaaccaggccguuguguuaaugggccuagacaaaggauggccaauuucuaagauggaucugggcgucccucuccuugcacuggggugcuauucacaggugaaucccuugacucugacggccgcuguccuccugcuuaucacacacuacgccauaauuggaccgggcuuacaggcaaaagcuaccagagaggcccaaaagaggacugcggccgguaucaugaagaacccaaccguggacgggaucaugacaauugaucuggacccuguuaucuaugauuccaaauucgagaagcagcucggacaggugauguugcugguacuaugugcagugcagcugcuccuuaugcggacaaguugggcucugugcgaggccuugacccuggcaacaggccccauaacgacccucugggaagguagcccaggcaaauuuuggaauacuacaauugcugucucgauggccaacaucuuccgcgggucuuaccuggccggagcgggcuuagcuuuuuccauuaugaaaagcguugggaccggaaaaagaggcacugguucacaaggggagacacuuggagaaaaguggaagaaaaagcugaaucagcucaguaggaaagaguucgaccuauauaagaaaucuggcaucaccgagguggaucggacggaagcaaaggagggucugaaacgaggcgaaauaacccaucacgccgucuccagagggagcgcuaaguugcagugguuuguggagcgcaacaugguaauccccgaaggaagggugauugaccugggcugugggcggggaggcuggucauacuauugcgccggucucaagaaaguuacagaggugcguggguacacuaagggaggcccuggccaugaggaaccgguccccaugaguaccuacggguggaauaucgugaaacuuaugagcggaaaggaugucuucuaucugccaccugagaaaugugacacauugcugugcgauauuggugaauccucucccagcccuacuguggaggaguccagaaccaucaggguucucaagaugguagaaccaugguuaaagaacaaucaguucuguauuaaagugcugaaccccuacaugccuacagucguggagcaccuugaacgccugcaacggaagcacggcgggaugcuaguucgaaauccacucucaagaaacucuacccaugagauguauuggaucaguaauggaacuggcaacauaguggcaucggucaauauggugagcaggcuguugcugaaccgcuuuacgaugacacaccggagacccaccauugaaaaagacguagaucucggugccgggacucgucaugugaacgcugagccggagaccccuaauauggacguuaucggagaaaggaucaagcggauuaaagaggaacacaacuccacauggcacuacgacgaugagaauccauauaagacgugggcguaccauggcucuuaugaagucaaggccaccggcucagcaagcuccaugauaaacgggguggugaaacuucugacuaagcccugggacgucguuccuauggugacacagauggcuaugaccgauacuacaccauucggacagcaacgcguauuuaaagagaagguggacacccgaacacccagaaguaugccggguacuaggcgggucaugggcaucaccgccgagugguuauggcgcacgcuggggagaaauaaaaagccuagguugugcacccgagaagaguucacaaagaaagugcggacuaacgcagccaugggagcuguuuuuaccgaagagaaucagugggauucugccaaggcggcaguggaagacgaggauuucuggaaacucgucgaccgugagagagaacugcacaagcuaggcaaaugugguagcugcguguacaacaugauggggaagcgcgagaagaaacuuggagaauuuggcaaagccaaaggcucaagggcuauuugguacauguggcugggggcccgguaucucgaguucgaggcacugggauuuuugaaugaagaucauugguucuccagagagaacaguuacagcgguguagaaggcgaggggcugcacaagcucggauauauccuucgcgacauuucuaaaauccccggcggugcuauguacgccgaugacacagcugggugggacacuaggauaaccgaagaugaccugcauaaugaggagaagaucacgcagcagauggauccagaacaccgacaauuagccaacgcaauuuuuaaacugacauaucagaauaagguugugaagguccagcggccuacccccacuggaacagugauggacaucauuuccagaaaagaucagaggggcucaggccaaguggggaccuacggauugaacacuuucaccaauauggaggcgcagcucauccgccagauggaaggugagggcguccugagcaaggccgaccuagaaaacccacgucuucccgagaaaaagauaacacaguggcuggagacgaaagggguugaacggcucaagagaauggcuauuucgggagaugacugcgugguaaagccuaucgaugacagguuugccaacgcacuguuggcuuuaaaugauaugggcaaagugcgcaaggacaucccacaauggcagccgucuaaagguuggcacgauuggcagcagguccccuucuguagucaucacuuccaugagcugauuaugaaggacgggcgaaaacucgugguuccuugccggccacaagacgaacuuauaggaagggccaggaucucccagggcgcaggcuggagccugcgcgagaccgccugucuagggaaggcguaugcucagauguggucacugauguacuuucacagacgggaucucagguuggccuccaacgcaauuugcucugccgugcccguccacugggugccuacuagccguacaaccuggaguauccaugcucaccaucaauggaugacuacagaagacaugcugaccguauggaaucgaguuuggauugaggauaacccauggauggaggacaagacgcccgugacaaccugggaaaaugucccuuaccuuggaaaacgcgaggaucaguggugugguucccugaucggccucacuagcagagccaccugggcacagaacauaccgacagcuauccagcaagugcggucuuuaauugggaaugaagaguuccuggacuauaugccaucaaugaagagguuucgcaaagaggaagagagugaaggagccaucugguga

SEQ ID NO: 15548 - RNA, 9873 nt, Artificial Sequence
  derived and/or modified CDS sequence (opt3) from DENV-3__FJ898469__SS-prME
accagccugugccucaugaugauccuucccgccgcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaagaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacaggucuucaaggggagacccugggagaaaaguggaagaaaaagcucaaucagcuaagcaggaaagaguucgaccuguauaagaaaucaggcauaacggagguugaucggaccgaagcaaaggaggguuugaaacgaggcgaaaucacacaucacgccgugaguagagggucugcuaagcugcagugguuugucgagcgcaacauggugauucccgaaggaaggguaaucgaccucggcugugggcggggaggcugguccuacuauugcgccggucuuaagaaagugacugagguucguggguacaccaagggaggcccuggccaugaggaaccggugcccaugagcacauacggguggaauauugucaaacugaugucaggaaaggauguguucuauuugccaccugagaaaugugacacucugcucugcgauaucggugaaaguagccccuccccuaccgucgaggagucuagaacaauuaggguguuaaagaugguugaaccauggcugaagaacaaucaguucuguaucaaaguacuuaaccccuacaugccuaccgugauagagcaccuggaacgccuacaacggaagcacggcgggaugcucguccgaaauccacugagcagaaacuccacucaugagauguauuggauuucaaauggaacgggcaacaucguggcaucuguuaauauggugaguagguugcugcucaaccgcuuuacaaugacccaccggagacccacuaucgaaaaagacgucgaucuuggugccgggacccgucaugugaacgcugagccggagacaccuaauauggacguaauuggagaaaggauaaagcggaucaaagaggaacacaacucgacguggcacuacgacgaugagaauccauauaagaccugggcguaccauggcagcuaugaagugaaggccacuggcuccgcaucuucaaugauuaacgggguugucaaacuguuaacaaagcccugggacguggugccuauggucacccagauggcuaugacugauacaaccccauucggacagcaacgcguuuuuaaagagaagguggacacacgaacucccagaagcaugccggguaccaggcggguaaugggcaucacggccgaguggcuguggcgcaccuuggggagaaauaaaaagccuaggcucugcacacgagaagaguucacuaagaaagugcggaccaacgcagccaugggagcugucuuuacagaagagaaucagugggauuccgccaaggcggcaguggaagacgaggauuucuggaaacugguugaccgugagagagaacuacacaaacuuggcaaaugugguaguugcguguacaacaugauggggaagcgcgagaaaaagcugggagaauuuggcaaggccaaaggcucuagggcuauuugguacauguggcucggggcccgguaucuggaguucgaggcauugggauuucugaaugaagaucauugguucagcagagagaacucauacuccggugucgaaggcgaggggcuccacaaacuuggauauauccugcgcgacauaaguaaaauccccggcggugcuauguacgccgaugacacugcugggugggacaccaggauuacggaagaugacuuacauaaugaggagaagaucacacagcagauggauccagaacaccgacaacuggccaacgcaauuuuuaaauugaccuaucagaauaaggugguaaagguucagcggccuacucccacaggaaccgugauggacaucauaagcagaaaagaucagaggggcucuggccaagucgggacuuacggacucaacaccuucacaaauauggaggcgcagcugauucgccagauggaaggugagggcgugcuauccaaggccgaccuugaaaacccacaucugccagagaaaaagaucacgcaguggcucgagaccaaagggguggaacgucugaagcggauggcuaucucaggagaugacugcgucguuaagccuauugaugacagauuugccaacgcauuguuagcucugaaugauaugggcaaagugaggaaggacauaccacaauggcagccgagcaaagguuggcacgauuggcagcagguacccuucuguucgcaccauuuccacgagcucaucaugaaggacgggcgcaaacuuguggucccuugccgaccacaagacgaacugauuggacgggccagaaucucucagggcgcaggcuggagucuaagggagacugccugucuggggaaggcguaugcucagauguggucccucauguacuuucaccgcagagauuugcggcuggccagcaacgcaauuugcucagccgugcccguucauugggugccuacauccaggaccacuuggucuauccacgcucaucaccaauggaugacaaccgaagacaugcuuacggucuggaaucguguguggauagaggauaacccauggauggaggacaagacacccguaaccacuugggaaaauguuccuuaccugggaaaacgagaggaucaguggugugguagccucaucggcuuaaccagucgcgccacaugggcacagaacauuccgacugcuauccagcaagugagaucccugauugggaaugaagaguucuuggacuauaugccaagcaugaagcgguuuaggaaagaggaagagucugaaggagccaucugguga

SEQ ID NO: 15549 - RNA, 9873 nt, Artificial Sequence
  derived and/or modified CDS sequence (opt3) from DENV-3__FJ898470__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuacggcaauggcgugguuaccaaaaacgggggauaugugucugguaucgcacaaacaaaugcugaaccagacggccccacgccugaguuagaagaggaaauguucaagaaaagaaaccugacuauuauggaucuccacccagggaguggaaagaccaggaaauacuugcccgccaucguccgugaggcuauaaagcgccggcugagaacacucauucuggcaccuaccagggugguagccgccgagauggaagaggcucuuaagggccugccgauccgauaucagacuacagcgaccaaauccgaacauacgggucgggagaucguggacuugaugugccacgcaacuuuuacaaugcgccuacugagccccguuagagucccaaauuacaaccucauuaucauggaugaagcccauuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaucagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauacaucuucacuggccagccccugaacaaugaugaagaccacgcacauuggacggaggccaagaugcuccuggacaacauuaauaccccugaaggaaucaucccggcucuuuucgagccagagagggaaaagagugccgcaauugauggcgaguaucgccuaaaaggggaaagccguaagacauuugucgagcugaugagacggggagacuugcccgugugguuagcgcacaaaguagccuccgaagguauaaaguacacugauaggaaauggugcuucgacggccagcgcaacaaucagauccuggaggagaacauggauguggaaauuuggaccaaggagggggagaaaaagaagcuccgaccuagauggcuggacgcucggacauauucugauccccuugcccugaaagaguuuaaggacuucgcagcuggaaggaaaucgaucgcccucgauuugguuaccgaaauuggccgcgucccaacucaccuggcacauagaacaaggaaugcccuagacaaccuggugaugcuccacacgagcgagcauggugggaaggcuuaccggcacgcgguggaggaacuuccugagaccauggaaacucuguuauugcugggccucaugauccugcuuacaggaggcgccaugcuguuucucauaucagggaaaggaaucgguaagaccuccauuggcuugaucugugucauugcaaguucugggaugcuguggauggcugagauccccuuacaauggauagccagcgccauuguucuagaguucuuuaugauggugcugcucaucccagaaccugagaagcagcguaccccgcaggauaaucaacuugcauauguagugauuggaauccugacauuggcugccauaaucgcggcuaacgaaaugggccugcucgagacuacgaaacgcgaccuggguauguccaaggaacccggggucgugucaccaaccucuuaccuugauguugaccuccacccugccagcgcauggacacuguacgccguggcuacuaccgucauuacacccauguugcgacauaccaucgagaauaguacugcaaacguaucccuggccgcgauugcuaaccaggccgugguuuuaaugggccuagacaaaggauggccaaucagcaagauggaucugggcgugccucuccuugcacuggggugcuauucucaggucaaucccuugacgcugacagccgcugugcuccugcuuauaacccacuacgccauuaucggaccgggcuuacaggcaaaagcuacuagagaggcccaaaagaggaccgcggccgguaucaugaagaacccaacagucgacgggauuaugacuaucgaucuggacccugugauauaugauucaaaauucgaaaagcagcucggacagguuauguugcuggugcuaugugcaguacagcugcuccuuaugcggaccuccugggcucugugcgaggccuugacacuggcaacgggccccauuaccacucucugggaagguaguccaggcaaauuuuggaauacaaccaucgcugugagcauggccaacauuuuccgcgggucguaccuggccggagcgggcuuagcuuuuucuaucaugaaguccgucgggacuggaaaaagaggcacagguagccaaggggagacccuuggagaaaaguggaagaaaaagcugaaucagcucucaaggaaagaguucgaccuauauaagaaaaguggcauaacggagguugaucggaccgaagcaaaggagggucugaaacgaggcgaaaucacacaucacgccgugucuagaggguccgcuaaguugcagugguuugucgagcgcaacauggugauucccgaaggaaggguaaucgaccugggcugugggcggggaggcuggagcuacuauugcgccggucucaagaaagugacugagguucguggguacaccaagggaggcccuggccaugaggaaccggugcccaugucaacauacggguggaauauugucaaacuuaugaguggaaaggauguguucuaucugccaccugagaaaugugacacuuugcugugcgauaucggugaaagcucccccucuccuaccgucgaggagagcagaacaauuagggugcucaagaugguugaaccaugguuaaagaacaaucaguucuguaucaaaguacugaaccccuacaugccuaccgugauagagcaccuugaacgccugcaacggaagcacggcgggaugcuaguccgaaauccacucuccagaaacucaacucaugagauguauuggauuucuaauggaacgggcaacaucguggcaaguguuaauauggugucgaggcuguugcugaaccgcuuuacaaugacccaccggagacccacuaucgaaaaagacgucgaucucggugccgggacccgucaugugaacgcugagccggagacaccuaauauggacguaauuggagaaaggauaaagcggaucaaagaggaacacaacagcacguggcacuacgacgaugagaauccauauaagaccugggcguaccauggcuccuaugaagugaaggccacuggcucugcaucaagcaugauuaacgggguugucaaacuucugacaaagcccugggacguggugccuauggucacccagauggcuaugacugauacaaccccauucggacagcaacgcguuuuuaaagagaagguggacacacgaacucccagauccaugccggguaccaggcggguaaugggcaucacggccgagugguuauggcgcacccuggggagaaauaaaaagccuagguugugcacacgagaagaguucacuaagaaagugcggaccaacgcagccaugggagcugucuuuacagaagagaaucagugggauagugccaaggcggcaguggaagacgaggauuucuggaaacucguugaccgugagagagaacugcacaagcuaggcaaaugugguucuugcguguacaacaugauggggaagcgcgagaagaaacuuggagaauuuggcaaagccaaaggcagcagggcuauuugguacauguggcugggggcccgguaucucgaguucgaggcacugggauuuuugaaugaagaucauugguucucaagagagaacuccuacaguggugucgaaggcgaggggcugcacaagcucggauauauccuucgcgacauaagcaaaauccccggcggugcuauguacgccgaugacacugcugggugggacaccaggauuacggaagaugaccugcauaaugaggagaagaucacacagcagauggauccagaacaccgacaauuagccaacgcaauuuuuaaacugaccuaucagaauaaggugguaaagguucagcggccuacucccgcgggaacagugauggacaucauaucuagaaaagaucagaggggcuccggccaagucgggaccuacggauugaacacuuucaccaauauggaggcccagcucauucgccagauggaaggugagggcgugcugucaaaggcugaccuagaaaacccacaccuucccgagaaaaagaucacacaguggcuggagacgaaagggguggaacgucucaagcggauggccaucagcggagaugacugcgucguuaagccuauugaugacagauuugcaaacgcucuguuggccuuaaaugauaugggcaaagugaggaaggacauaccacaauggcagccgucgaaagguuggcaugauuggcagcagguacccuucuguucucaccauuuccacgagcugaucaugaaggacgggcgcaaacucguggucccuugccgaccacaagacgaacuuauuggacgggcaagaaucagucagggcgccggcuggucccugagggagaccgcgugucuagggaaggcuuaugcccagauguggagccugauguacuuucaccgcagagaucuccgguuggcaucaaacgccauuugcuccgcugugcccguucauugggugccuacuucuaggacaaccuggagcauccacgcccaucaccaauggaugacuacagaagacaugcugaccgucuggaaucguguguggauagaggauaacccauggauggaggacaagacgcccguaacaaccugggaaaauguuccuuaccuuggaaaacgagaggaucaguggugugguagucugaucggccucacuucccgcgcaaccugggcucagaacauuccgacagccauccagcaagugaggagcuuaauugggaaugaagaguuccuggacuauaugccaucuaugaagcgguuuaggaaagaggaagagucagaaggagcgaucugguga

SEQ ID NO: 15550 - RNA, 9873 nt, Artificial Sequence
  derived and/or modified CDS sequence (opt3) from DENV-3__FJ898471__SS-prME
accagccugugccucaugaugauccuuccagcagcucuggcauuccacuugacuuccagggacggcgaaccuaggaugauuguggggaagaacgaacggggaaagucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucauacagaagguugugaucuucauuuuacugaugcuugucacuccaucgaugaccaugcgcugugugggcguagggaacagagacuuuguugaaggauugucaggugccacauggguggaugucgugcuggagcacggcgggugcgugaccacgauggcgaagaauaaacccacucuagacaucgagcuccagaagacagaagcaacccaacuggccacucuuaggaaacuguguauugagggaaagaucacaaacauaaccacggauagccggugcccuacccagggcgaagcugucuugccagaggaacaggaccagaauuauguuuguaaacacacauacguggaucgcgguugggggaacggaugcggccucuucggcaaggggagucugguaacuugcgccaaguuucaauguuuagagcccauugagggaaaagugguccaguaugaaaaucugaaguacaccgugaucauuacaguucauacuggugaccagcaccaggugggcaacgagacccaaggggucacagcagaaaucaccccucaggcuuccacuacggaggccauccucccagaauauggaacacuuggccuggagugcucuccgcgaaccgguuuggacuucaaugagaugauucuacugacuaugaaaaacaaggcguggauggugcauagacagugguuuuucgaucucccccugccuuggaccagcggggccacaaccgaaacuccaacauggaauaggaaagagcuucugguaacguuuaagaacgcacacgcuaaaaagcaagaaguuguggucuugggcucccaggagggagccaugcacaccgcucucacuggcgccacagaaauacaaaauucagggggaaccaguaucuucgcaggucaucugaagugucgguuaaaaauggacaagcuggagcuaaaaggcaugagcuacgccaugugcacaaacacuuuugugcucaagaaagaggucucugaaacccagcacgggacgauucugaucaagguggaguacaagggagaagauguucccuguaaaauaccuuucuccaccgaggacggccaagguaaggcucauaacgggcgucuuauuacagcgaauccagugguaacuaaaaaggaggaacccgucaacaucgaggcagaaccgccuuucggcgagucaaauaucgugauuggaaucggcgauaacgccuugaaaauuaauugguauaagaaggggagcaguauaggaaaaauguuugaagcuaccgcccgcggugcaagaaggauggccauccugggcgacacagcuugggauuucgggucuguuggaggcgugcucaacucccuggguaagaugguccaccagauuuuugggagcgccuacacugcacuuuucucgggcgugucuuggguaaugaaaaucggaaucggcgugcuguugaccuggauugggcucaauuccaagaacacgucaaugaguuuuagcugcauaguuaucggaauuaucacacuguauuuaggcgcggucgugcaggcugacauggguugugugauuaauuggaaagggaaggagcugaagugcggauccggcaucuucgucaccaacgagguucauacuuggacagaacaguacaaauuucaagccgauucucccaagcggcuagcaaccgccauagcuggugccugggagaauggcgugugugggauccgaagcacuacccgcauggaaaaccuccuguggaaacagauugcaaaugagcuuaacuauaucuugugggaaaauaacauuaagcugacagugguagucggagacaucauaggcgugcucgagcaggggaaaagaacgcugaccccacagccuauggaguuaaaguacucauggaaaacuuggggaaaggcuaagauuguuacagccgaaacccaaaacaguuccuucaucauugauggccccaauacaccagagugccccagcgcgucuagggccuggaacgugugggaagucgaggacuaugguuuugggguguucacuaccaauaucuggcugaaacuucgggaaguuuacacgcaguugugugaccaccgccucaugucagcugcagugaaggaugagagagccguacacgcugacaugggauacuggauagagagucagaaaaacggcagcuggaagcuggaaaaagccucccuaaucgaggucaagacaugcaccuggccuaagucucauacucuguggucgaauggugugcucgaaagcgauaugauuaucccaaaaucccuggcaggcccgauuucacagcacaacuauaggcccggguaccauacccaaacagcgggaccuuggcaccuuggcaaguuggagcuggacuuuaauuauugcgaggggacuaccguggucaucacagaaaacuguggaacgcguggcccaaguuuacggaccacuacaguuucugguaaacucauacacgaguggugcugucgaagcugcacccugcccccucuuagauacaugggggaagauggauguugguauggcauggagauuaggccaaucuccgaaaaggaggagaauauggugaaaucacugguaagcgccgguucuggcgaaguggacaacuucacuaugggggucuugugccucgcuauccuguuugaggaagugaugcgcggaaaguucggcaagaaacauaugauugccgggguuuucuuuacauucgugcuacugcucuccggacagaucaccuggcgggauauggcacacacgcugauuaugauaggcaguaaugcuagcgacagaauggguaugggggucacuuaccuugccuugaucgcaaccuuuaagauucagcccuuccuggccuuaggauuuuuccucaggaaacugacaucucgcgagaaccuucugcuaggcgugggccucgcuauggcgaccacucugcaauugccggaagauaucgagcagauggccaaugggauugcacugggauuaauggcucucaagcugaucacacaguuugagaccuaucagcuuuggacagcccugguuuccuugacuuguucaaacaccauauucacgcucacaguggccuggcgaaccgcuacucugauccuagccggugucagucugcuuccuguaugccaaagcucguccaugcggaaaaccgacuggcucccaaugacaguggccgcgaugggcguucccccucugcccuuguuuauuuucucucugaaggauacuuuaaagcguagaagcuggccacucaaugaaggggugauggcugucggacuggugucaauccuugccaguucccuguugaggaacgacguaccuauggcaggcccccucguggccggugggcugcuaauugcuuguuacgucaucaccggaacgucugcagaucugacaguugagaaagccgcggacgugaccugggaagaggaagcugagcagacuggcgugagccauaaccuuaugauaacagucgacgaugacggcaccaugcgcauuaaggaugacgagacugaaaauauccucacagugcuguugaaaaccgccuuacugaucguuuccgggauuuuuccauacucaauaccggcaacgcuccugguauggcacacuuggcagaagcagacccaacggagcggagugcuuugggaugucccuagucccccagagacacagaaagccgaacuggaggaggguguguauagaaucaagcagcagggcauuuucgggaaaacccaaguuggagugggcguccagaaggaagguguguuucauacaauguggcacguaacuagaggggcugucuugaccuacaacggaaagcgacuagagcccaauugggccucugugaaaaaggaccugaucuccuauggcggcggguggcgccucagcgcacaguggcaaaaaggagaagagguucaggugauugcugucgaaccugguaagaaccccaagaauuuccagacgaugcccggcacauuccagacuaccacaggggagaucggagccauagcgcuggauuuuaagccuggcaccucggguucaccgaucauuaaccgggaggggaaggugguuggacuuuacggcaauggcguggucacuaaaaacgggggauaugugucugguaucgcccaaaccaaugcagaaccagacggccccacaccugaguuagaagaggaaauguucaagaaaagaaaccugacgauuauggaucuccacccagggaguggaaagacuaggaaauacuugcccgcuaucguacgugaggccauaaagcgccggcugagaacccucauucuggcuccuacaagggugguugcagccgagauggaagaggcccuuaagggccugccgauccgauaucagaccacugcuacaaaauccgaacauaccggucgggagaucgucgacuugaugugccacgcgacguuuacuaugcgccuacugagccccgugagagugccaaauuacaaccucauuaucauggaugaagcacauuucacagacccugccucuauagcugccaggggguacauuagcacccgggucggaaugggcgaggcagccgcuaucuuuaugaccgcgacucccccaggcacagccgaugcauucccucaguccaaugcucccauucaggacgaggaacgagacaucccagagagaucauggaacagugggaaugaauggauaaccgauuuugccggaaagacaguaugguucgugccgagcauuaaagcagguaacgacaucgccaacuguuuacgcaagaauggcaaaaagguuauccaacugucuaggaagacuuuugauacggaguaucagaaaaccaaacuuaacgacugggauuucguggucacaacugacauuuccgagaugggggcuaauuuuaaagccgaucgugugaucgacccucggagaugccugaagcccguuauucucaccgauggaccagaaagggugauauuggcgggccccaugccugucacagcagccucagcugcccagcgccgagguagaguggggcggaacccacagaaagagaaugaccaauacaucuucaccggccagccccugaacaaugaugaagaccacgcucauuggacugaggcaaagaugcuccuggacaacauuaauacgccugaaggaaucaucccggcccuuuucgagccagagagggaaaagagugcugccauugauggcgaguaucgccuaaaaggggaaagccguaagaccuuuguagagcugaugagacggggagacuugcccgugugguuagcauacaaaguugcguccgaagguauaaaguauacagauaggaaauggugcuucgacggccagcgcaacaaucagauccuggaggagaacauggaugucgaaauuuggacuaaggagggggagaagaagaagcuccgaccuagauggcuggacgcccggaccuacucugauccccuugcucugaaagaguuuaaggacuucgccgcaggaaggaaaucgaucgcucucgauuuggugacagaaauuggccgcgugccaagccaccuggcccacagaaccaggaaugcacuagacaaccuggucaugcuccauacuucagagcacggugggaaggccuaucggcaugcuguugaggaacuuccugagacaauggaaacgcuguuauugcugggccucaugauccugcuuaccggaggcgcgaugcuguuucucauauccgggaaaggaaucgguaagacaaguauuggcuugaucugugugauugccucuagcgggaugcuguggauggcagagauccccuuacaauggauagcuuccgccauuguacuagaguucuuuaugauggugcugcucaucccagaaccugagaagcagcguacaccgcaggauaaucaacuugccuacgucgugauuggaauccugaccuuggcagcuauaaucgccgcgaacgaaaugggccugcucgagaccacaaaacgcgaccuggguaugucaaaggaacccgggguugugucuccaacuagcuaccuugaugucgaccuccacccugcuagugccuggacgcuguaugcaguagccaccacagugauuacucccauguugcgacacaccaucgaaaauuccacagcuaacguuagccuggcagccauugcgaaccaggcuguggucuuaaugggccuagacaaaggauggccaaucucuaagauggaucugggcgugccucuccuugcccuggggugcuacucacaggucaaucccuugacccugacugcagccgugcuccugcuuauaacgcauuaugcuauuaucggaccgggcuuacaggccaaagcaacaagagaggcucaaaagaggaccgccgcggguaucaugaagaacccaacuguugacgggauuaugaccaucgaucuggacccugugauauacgauuccaaauucgagaagcagcucggacagguaauguugcuggugcuaugugccguccagcugcuccuuaugcggacaaguugggcacugugcgaggcuuugacucuggccaccggccccauuacaacgcucugggaagguagcccaggcaaauuuuggaauaccacuaucgcaguuucgauggcuaacauuuuccgcgggucuuaucuggccggagccggcuuagcguuuuccaucaugaaaagcguggggacaggaaaaagaggcaccgguucacaaggggagacucuuggagaaaaguggaagaaaaagcugaaucagcucaguaggaaagaguucgaccuauacaagaaaucuggcauaacagaggucgaucggaccgaagcuaaggagggucugaaacgaggcgaaaucacgcaccaugcaguguccagagggagcgccaaguugcagugguuuguagagcgcaacauggugauucccgaaggaaggguuaucgaccugggcugugggcggggaggcuggucauauuacugcgcuggucucaagaaagugaccgagguccguggguacacaaagggaggcccuggccacgaggaaccggugcccaugaguacuuauggguggaauauugucaaacuuaugagcggaaaggauguguucuaccugccaccugagaaaugugacaccuugcugugcgauaucggugaauccucucccagcccuacaguugaggaguccagaacuauuaggguacucaagaugguggaaccaugguuaaagaacaaucaguucuguaucaaaguccugaaccccuauaugccuaccgugauagagcaucuugaacgccugcaacggaagcacggcgggaugcuaguucgaaauccacucucaagaaacucuacacacgagauguacuggauuaguaauggaaccggcaacaucguggccucggucaauauggugagcaggcuguugcugaaccgcuuuacuaugacgcaucggagacccacaaucgaaaaagacguagaucucggugcagggacccgucacgugaacgccgagccggagacuccuaauauggacguuauuggagaaaggauaaagcggaucaaagaggaacauaacuccaccuggcacuaugacgaugagaauccauacaagacaugggcuuaucacggcucuuacgaagucaaggcgacgggcucagccagcuccaugauuaacgggguggugaaacuucugaccaagcccugggacgucguuccuauggugacucagauggcaaugacagauaccacuccauucggacagcaacgcguauuuaaagagaagguggacacacgaacccccagaaguaugccggguacaaggcgggucaugggcaucacugcugagugguuauggcgcacccuggggagaaauaaaaagccuagguugugcacgcgagaagaguucaccaagaaagugcggacaaacgccgcaaugggagccguuuuuacugaagagaaucagugggauucugcuaaggccgcgguggaagacgaggauuucuggaaacucgucgaccgugagagagaacugcauaagcuaggcaaaugugguagcugcguguacaacaugauggggaagcgcgagaagaaacuuggagaauuuggcaaagcaaaaggcucaagggccauuugguauauguggcugggggcucgguaccucgaguucgaggcccugggauuuuugaaugaagaucacugguucuccagagagaacaguuauagcgguguagaaggcgaggggcugcauaagcucggauacauccuucgcgacauaucuaaaauccccggcggugcaauguaugcugaugacaccgccgggugggacacaaggauuacugaagaugaccugcacaaugaggagaagaucacccagcagauggauccagaacaucgacaauuagcuaacgccauuuuuaaacugacguaccagaauaagguugugaagguccagcggccuacacccaccggaacugugauggacaucauauccagaaaagaucagaggggcucaggccaaguggggacauauggauugaacaccuucacuaauauggaggcacagcucauucgccagauggaaggugagggcguccugagcaaggcggaccuagaaaacccacaccuucccgagaaaaagaucacccaguggcuggagacaaaagggguugaacgucucaagcggauggccaucucgggagaugacugcgugguaaagccuauugaugacagauuugcuaacgcccuguuggcauuaaaugauaugggcaaagugaggaaggacauaccacaauggcagccgucuaaagguuggcacgauuggcagcagguccccuucuguagucaucacuuccaugagcugaucaugaaggacgggcgcaaacucgugguuccuugccgaccacaagacgaacuuauuggacgggcuagaaucucccagggcgccggcuggagccugagggagacggcaugucuagggaaggccuacgcgcagauguggucacugauguacuuucaccgcagagaucuccgguuggcuuccaacgccauuugcucugcagugcccguccacugggugccuaccagcaggacuacauggaguauccaugcccaccaucaauggaugaccacugaagacaugcugacaguauggaaucguguuuggauagaggauaacccauggauggaggacaagacccccgugacgacaugggaaaaugucccuuaucuuggaaaacgagaggaucaguggugugguucccugaucggccucaccagccgcgcuacuugggcccagaacauuccgaccgcaauccagcaagugagaucuuuaauugggaaugaagaguuccuggacuacaugccaucaaugaagcgguuuaggaaagaggaagagagugaaggagcuaucugguga

SEQ ID NO: 15551 - RNA, 9873 nt, Artificial Sequence
  derived and/or modified CDS sequence (opt3) from DENV-3__FJ898472__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguuccuaaccuuuguucugcuccuguccggacagauuacguggcgggauauggcucacacucuuaucaugauuggcaguaaugccagcgacagaauggguaugggggugaccuacuuggcacugauagccacauucaagauccagcccuuuuuagcucucggauucuuucugaggaaacuuaccucucgcgagaaccugcuacucggcgucggccuggcgauggccacuacauugcaacugccggaagauauugagcagauggcaaaugggaucgcuuuaggacucauggcccugaagcuuauuacccaguucgagacauaucagcuguggacugccuugaucucccucaccuguucaaacacgauauuuacacugaccguggcuuggcgaacugcaacccuaauccuggccgguguuagucuucucccugugugccaaagcucguccaugcggaaaacagacuggcugccaaugacugucgcggcuaugggcguacccccuuugccccuguucauuuuuaauuuaaaggauacccucaagcguagaucuuggccacugaacgaaggggugauggccguuggacuugugagcauccuggcaucaaguuugcucaggaacgacgucccuauggccggcccccugguggcuggugggcuacugauugcauguuacguaaucacgggaacauccgccgaucuuaccguggagaaagcggcugacgucacuugggaagaggaagccgagcagacaggcguuucucauaaucucaugauaaccguggacgaugacggcacuaugcgcauuaaggaugacgagacagaaaacauccugaccguguuguuaaaaacggcacugcucaucgucagcgggauuuucccauacuccauaccggccacucugcuuguguggcacaccuggcagaagcagacacaacggucaggaguucugugggauguaccuagccccccagagacccagaaagcugaauuggaggaggguguguauagaaucaagcagcagggcauuuuugggaaaacacaagucggagugggcguucagaaggaagguguguuccauacuauguggcacgucaccaggggggccgugcuaacguacaauggaaagcgacuggagcccaacugggcaaguguaaaaaaggaccucaucucuuauggcggcggguggcgccuguccgcucaguggcaaaaaggagaagagguccaggugauugccguugaaccugguaagaauccaaaaaacuuucagacaaugcccggcacuuuccagaccacaaccggggagaucggagcgauagcccuugauuucaagccuggcacuagcgguucgccgaucauuaaucgggaggggaagguggucggauuauacggcaacggcgugguuaccaaaaaugggggauaugugucagguaucgcacaaacaaacgcugaaccagacggccccacgccugagcuggaagaggaaauguuuaagaaaagaaaucucacuauuauggauuugcacccagggucuggaaagaccaggaaauaccugcccgccaucguccgugaggcuauaaagcgccggcucagaacacugauucuugcaccuaccagggugguagccgccgagauggaagaggcucugaagggcuugccgauccgauaucagacuacagcgaccaaaagugaacauacgggucgggagaucguggaccuaaugugccacgcaacuuucacaaugcgccugcucucccccguuagagucccaaacuacaauuuaauuaucauggaugaagcccauuuuaccgacccugcuagcauagccgcaaggggguacauuucuacccgggugggaaugggcgaggccgcugcgaucuucaugacugccacacccccaggcaccgcagaugcuuuuccucagagcaacgcccccauucaggacgaggaacgagacaucccagagagauccuggaauucagggaacgaauggauaacagauuucgcaggaaagacugugugguuugucccgaguauuaaagccgguaacgacaucgcuaauugucugcgcaagaacggcaaaaagguaauccaacuuagcaggaagacguucgauaccgaguaucagaaaacaaagcugaaugacugggauuuugugguuacuaccgacauuucugagaugggggccaacuucaaagcggaucgugugaucgacccucggagaugccucaagcccgucauuuugacagauggaccagaaagggugauacuggcaggccccaugccuguuaccgccgcuuccgccgcucagcgccgagguagaguggggcggaauccacagaaagagaacgaccaauacaucuuuacuggccagccccucaauaacgaugaagaccacgcacauuggacggaggccaagaugcugcuugacaauauuaacaccccugaaggaaucaucccggcucuauucgagccagagagggaaaagucagccgcaauugauggcgaguaucgccugaaaggggaaagucguaagacauucgucgaguugaugagacggggagacuuacccguguggcuggcgcacaaaguagccagcgaagguauaaaguacacugauaggaaauggugcuuugacggccagcgcaauaaccagauccucgaggagaauauggauguggaaauuuggaccaaggagggggaaaaaaagaagcugcgaccuagauggcuugacgcucggacauauuccgauccccuggcccucaaagaguucaaggacuuugcagcuggaaggaaaucuaucgccuuggaucugguuaccgaaauuggccgcgucccaacucaccuagcacauagaacaaggaacgcccuggacaaucucgugaugcuucacacgucggagcauggugggaaggcuuaccggcacgcgguggaggaacugccugagaccauggaaacuuuauugcugcucggccugaugauccuucugacaggaggcgccaugcucuucuugauaagcgggaaaggaaucgguaagaccucaauuggccugaucugugucauugcauccagugggauguuauggauggcugagaucccccuacaauggauagccucugccauuguucuggaguuuuucaugauggugcuccuuaucccagaaccugagaagcagcguaccccgcaggauaaccaacuggcauauguagugauuggaaucuugacacuggcugccauaaucgcggcuaaugaaaugggccuccuggagacuacgaaacgcgaccuugguaugagcaaggaacccggggucguguccccaaccucauaccucgauguugaccugcacccugccucugcauggacauuguacgccguggcuacuaccgucauuacacccaugcugcgacauaccaucgagaacagcacugcaaacguaaguuuagccgcgauugcuaaucaggccgugguucuaaugggccuggacaaaggauggccaaucuccaagauggaucucggcgugccucuucuggcauuggggugcuauagccaggucaacccccugacgcucacagccgcugugcugcuuuuaauaacccacuacgccauuaucggaccgggccugcaggcaaaagcuacuagagaggcccaaaagaggaccgcggccgguaucaugaagaauccaacagucgacgggauuaugacuaucgaucucgacccugugauauaugauucuaaauuugaaaagcaguugggacagguuaugcugcuagugcugugugcaguacagcuccuucugaugcggaccucaugggcuuugugcgaggcccugacacucgcaacgggccccauuaccacucugugggaagguuccccaggcaaauucuggaacacaaccaucgcugugaguauggccaauauuuuucgcgggagcuacuuagccggagcgggccuugcuuucucgaucaugaagucugucgggacuggaaaaagaggcacagguucccaaggggagacccugggagaaaaguggaagaaaaagcucaaccagcuaagcaggaaagaguuugaccuguauaagaaaucaggcauaacggagguugaucggaccgaagcaaaggaggguuugaaacgaggcgaaaucacacaucacgccgugaguagagggucugcuaagcugcagugguucgucgagcgcaauauggugauucccgaaggaaggguaaucgaccucggcugugggcggggaggcugguccuacuauugcgccggucuuaagaaagugacugagguucguggguacaccaagggaggcccuggccaugaggaaccggugcccaugagcacauacggguggaacauugucaaacugaugucaggaaaggauguguuuuauuugccaccugagaaaugugacacucugcucugcgauaucggugaaaguagccccuccccuaccgucgaggagucuagaacaauuaggguguuaaagaugguugaaccauggcugaagaauaaccaguucuguaucaaaguacuuaaucccuacaugccuaccgugauagagcaccuggaacgccuacaacggaagcacggcgggaugcucguccgaaacccacugagcagaaauuccacucaugagauguauuggauuucaaacggaacgggcaauaucguggcaucuguuaacauggugaguagguugcugcucaaccgcuucacaaugacccaccggagacccacuaucgaaaaagacgucgaucuuggugccgggacccgucaugugaaugcugagccggagacaccuaacauggacguaauuggagaaaggauaaagcggaucaaagaggaacacaauucgacguggcacuacgacgaugagaacccauauaagaccugggcguaccauggcagcuaugaagugaaggccacuggcuccgcaucuucaaugauuaaugggguugucaaacuguuaacaaagcccugggacguggugccuauggucacccagauggcuaugacugauacaaccccauuuggacagcaacgcguuuucaaagagaagguggacacacgaacucccagaagcaugccggguaccaggcggguaaugggcaucacggccgaguggcuguggcgcaccuuggggagaaacaaaaagccuaggcucugcacacgagaagaguuuacuaagaaagugcggaccaaugcagccaugggagcugucuucacagaagagaaccagugggauuccgccaaggcggcaguggaagacgaggauuuuuggaaacugguugaccgugagagagaacuacacaagcuuggcaaaugugguaguugcguguacaauaugauggggaagcgcgagaaaaagcugggagaauucggcaaggccaaaggcucuagggcuauuugguacauguggcucggggcccgguaucuggaguuugaggcauugggauuccugaacgaagaucauugguuuagcagagagaauucauacuccggugucgaaggcgaggggcuccacaagcuuggauauauccugcgcgacauaaguaaaauccccggcggugcuauguacgccgaugacacugcugggugggacaccaggauuacggaagaugacuuacauaacgaggagaagaucacacagcagauggauccagaacaccgacaacuggccaaugcaauuuucaaauugaccuaucagaacaaggugguaaagguucagcggccuacucccacaggaaccgugauggacaucauaagcagaaaagaucagaggggcucuggccaagucgggacuuacggacucaauaccuuuacaaacauggaggcgcagcugauucgccagauggaaggugagggcgugcuauccaaggccgaccuugaaaacccacaccugcccgagaaaaagaucacgcaguggcucgagaccaaagggguggaacgucugaagcggauggcuaucucaggagaugacugcgucguuaagccuauugaugacagauucgccaaugcauuguuagcucugaacgauaugggcaaagugaggaaggacauaccacaauggcagccgagcaaagguuggcaugauuggcagcagguacccuuuuguucgcaccauuuccacgagcucaucaugaaggacgggcgcaaacuuguggucccuugccgaccacaagacgaacugauuggacgggccagaaucucucagggcgcaggcuggagucuaagggagacugccugucuggggaaggcguaugcucagauguggucccucauguacuuccaccgcagagauuugcggcuggccagcaaugcaauuugcucagccgugcccguucauugggugccuacauccaggaccacuuggucuauccacgcucaucaccaauggaugacaaccgaagacaugcuuacggucuggaaccguguguggauagaggauaauccauggauggaggacaagacacccguaaccacuugggaaaacguuccuuaccugggaaaacgagaggaucaguggugugguagccucaucggcuuaaccagucgcgccacaugggcacagaauauuccgacugcuauccagcaagugagaucccugauugggaacgaagaguuuuuggacuauaugccaagcaugaagcgguucaggaaagaggaagagucugaaggagccaucugguga

SEQ ID NO: 15552 - RNA, 9873 nt, Artificial Sequence
  derived and/or modified CDS sequence (opt3) from DENV-3__FJ898474__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugccuugccagaggaacaggaccagaauuaugucuguaaacacacuuacguugaucgcgguugggggaacggaugcggccucuucggcaaggggagucuggugaccugcgcaaaguuucaauguuuagagcccauagagggaaaaguagugcaguaugaaaaucugaaguacacagucauuaucacugugcauaccggugaccagcaccagguuggcaacgagacacaaggggugaccgcugaaauuacuccucaggccuccacgacagaggcgauccucccagaauauggaacccuuggccuggagugcucuccgcgaacugguuuggacuucaaugagaugauccuacugaccaugaaaaacaaggccuggaugguccauagacagugguuuuucgaucucccccugccuuggacaagcggggcaaccacugaaacaccaacguggaauaggaaagagcuucuggugaccuuuaagaacgcucacgccaaaaagcaagaaguaguuguguugggcucccaggagggagcuaugcacacugcccucacaggcgcaaccgaaauucagaauucagggggaacaaguauauucgccggucaucugaagugucgguuaaaaauggacaagcuggagcuaaaaggcaugagcuacgcuaugugcacuaacaccuuuguccucaagaaagaggugucugaaacgcagcacgggaccauccugauuaaggucgaguacaagggagaagaugugcccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacauuaucggcguacucgagcaggggaaaagaacccugacuccacagccuauggaguuaaaguacucauggaaaacauggggaaaggcgaagauaaugaccgccgaaacacaaaacaguuccuucauuaucgauggccccaauacuccagagugccccagcgcuucuagggcauggaacgucugggaaguggaggacuaugguuuugggguuuucaccacgaauauuuggcugaaacuucgggaaguguacacacaguugugugaccaccgccucaugucagccgcuaucaaggaugagagagccguccacgcagacaugggauacuggauagagagucagaaaaacggcagcuggaagcuggaaaaagcgucccuaaucgaggugaagaccugcacuuggccuaagucucauacccuguggucgaaugguguucucgaaagcgauaugauuaucccaaaaggccuggccgggccgauuucccagcacaaccauaggcccggauaucacacacaaacugcuggcccuuggcaccuugggaaguuggagcuggacuuuaauuacugcgagggaaccacagugguaaucacggaaaacuguggcacccgugguccaucauuacggacuacaaccgucagugggaaacucauacaugaguggugcugucgaucuugcacucugcccccucuuagauauauuggagaagauggcuguugguacgguauggagaucaggccaaucagcgaaaaggaggagaauauggugaaaucccuggugucagccggcagcgggaaggucgacaacuucacaaugggaguuuugugccucgcaauucuguuugaagaggugaugcgcggcaaguucgggaaaaagcacaugaucgcuggaguauucuuuaccuucgugcuacugcucucuggccagauuacguggcgggauauggcccauacucugauaaugaucgguuccaaugcaagugacagaauggggaugggagucaccuaucuugccuugauugcuacauuuaaaauccagcccuuccuggcguuaggcuuuuuccucaggaagcugaccagccgcgaaaaccuucugcuaggcguggggcucgccauggcaacuacacugcaauugccggaggauauugaacagauggcuaauggaaucgcccuggguuuaauggcccucaaacugauaacccaguuugagacauaccagcuuuggacugcucugaucucuuugaccuguuccaacacgauuuucacacucaccguugcauggcgaacugccacccugauccuagcgggcgugucacugcuuccugucugccaaaguagcucgaugcggaagacagacuggcucccaauggcuguggccgcaauggggguucccccucugcccuuguuuauuuucucccugaaggauacuuuaaaacguagaucuuggccacucaaugagggagugauggccgucggccugguaagcauccuugcuucaagucuguugaggaacgacgugccuauggcagguccccucguugccgggggacugcuaauagcguguuaugugauuaccggcacguccgcugaucugacagucgaaaaggccgcagacaucaccugggaggaagaggccgaacagacuggcgugucucacaaccuuaugaucacaguagacgaugacgggaccaugcgcauuaaagaugacgagacugagaauauacucacagugcuguugaagaccgcuuuacugaucgucagcggaauuuuuccauacuccaucccggccacgcuccugguuuggcauacuuggcagaaacagacccaacggucaggugugcuuugggaugugccuagccccccagaaacacagaaggcagagcuggaagagggcgucuacagaauuaaacagcaggggaucuucggaaagacccaagugggcguugguguacagaaggaggggguguuucacacaauguggcacgucacuaggggagcuguguugaccuauaacggcaaacgacuagaacccaauugggccaguguuaagaaagaccugauaucuuacggcgggggauggcgccucuccgcgcaguggcaaaagggugaggaagugcaggucaucgccguggagccuggcaaaaacccaaagaauuuccagacgaugcccgggacauuccagacuauuaccggagaaaucggcgcaauugcucuggauuuuaagccugguacaagcgggucgccgaucauaaaccgggagggaaaaguagucggccuuuauggcaauggggugguuaccaagaacggagguuacgugucaggcauugcccaaacuaaugcugagccagacgggcccaccccugaauuagaggaagagauguucaaaaagagaaaccugacaaucauggaucuccauccaggaucuggcaaaacgaggaaguauuugcccgcaaucguccgugaagccauuaagcgccggcugagaacucucauccuggccccuaccagggugguugcugcggagauggaggaagcacuuaaaggucugccgauacgauaccagacaaccgccacuaagagugagcacacagggcgggaaauuguggacuugaugugccaugcuaccuuuacgaugcgccuacugucccccgucagagugccaaauuauaaccucaucauuauggaugaggcccacuucacugacccugcaagcaucgccgcuaggggauacauaucuacacggguaggcaugggcgaagcggccgcaauuuuuaugaccgcuacccccccagggacugccgaugcauucccucagagcaaugcccccauccaggacgaggagcgagacaucccagaaagauccuggaacucaggaaaugaguggauuacagauuuugcugguaaaaccgugugguucguuccgaguaucaaggccggcaacgacauugcgaacuguuuacgcaaaaaugggaagaaggucauacaacugagcaggaaaacauuugauacugaauaccagaagacgaaacuuaacgacugggauuucguggugaccacagacaucucugagaugggagcaaauuuuaaggccgaucgugucauugacccucggagaugccugaaacccguaauccucacugauggcccagagagggugaucuuggcuggucccaugccuguuaccgccgcuuccgcagcccagcgccgagggagagugggccggaacccacagaaggaaaaugaccaauauauuuucacaggacagccccugaacaaugaugaggaccaugcucacuggaccgaagccaagaugcuccuggacaacauaaauacuccugagggcaucauuccggcacuuuucgaaccagagagggagaaaucagcggccaucgauggggaauaccgccuaaagggagagagucguaaaacguuugucgaacugaugagacggggugacuugcccgugugguuagcucacaagguugccagcgagggcauuaaauauaccgauaggaaguggugcuucgacgggcagcgcaacaaucagauccuggaagagaacauggauguggagauauggacaaaagaaggagagaagaagaaacuccgaccuagauggcuggacgcacggacuuacuccgauccccuugcucugaaggaauuuaaagacuucgccgcaggcaggaagucuaucgcccucgauuuggucaccgagauuggucgcgugccaucgcaucuggcucacagaacaaggaaugcgcuagacaaccugguaaugcuccauaccagcgaacacgggggccgggccuaucgucacgcaguggaggagcuuccugaaacuauggagacacuguuauugcugggacucaugauccugcuuacgggcggggcuaugcuguuucucauuucaggaaaagguaucggcaagaccuccauaggguugauuuguguuaucgccaguucuggaaugcuguggauggccgaaauucccuuacaauggaucgcaagcgcuauaguccuagaguucuuuaugauggugcugcucaucccagagccugaaaagcagcgcacuccgcaggauaaucaacuugccuacguggucauuggcauccugacauuggcggcuauuaucgccgcaaacgagaugggucugcucgaaaccaccaaacgagaccuggggauguccaaggagcccggcguugugucaccaacaucuuaucuugauguagaccuccauccugccagcgcuuggacucuguacgcaguggccacgaccgucauaacacccauguugagacacacuauugaaaauaguaccgcgaacgugucccuggcugccaucgcaaaccaggccguuguguuaaugggacuagacaaaggcuggccaaucagcaagauggaucugggggucccucuccuugcucugggaugcuacucucagguaaaucccuugacacugaccgccgcagugcuccugcuuauuacucauuaugcuaucauaggcccggguuuacaggccaaagcgacgagggaggcccaaaagcggacagcagcugggauuaugaagaacccaaccguugacggaaucaugacuauugaucuggacccugugaucuacgauucaaaauucgagaagcagcucggccaggucauguugcuggugcuaugugccguccagcugcuccuuaugcgcaccuccugggcacugugcgaagcuuugacacuggccacuggucccauaaccacacucugggagggcaguccagggaaauuuuggaauacgaccaucgccgugagcauggcgaacauuuucagaggaucguaucuggcuggcgcaggguuagccuuuucuaucaugaaguccguuggaacuggcaaaagggguacagggagccaaggagaaacccuuggcgagaaguggaagaaaaagcugaaucagcucucacggaaagaauucgaccuauacaagaaaagugguauuacugagguggaucgaacagaggcuaaggaaggccugaaaagaggggagaccacgcaccaugccguaucucgcggauccgcaaaguugcagugguuuguggaaaggaacauggucauccccgagggccggguuauugaccugggguguggacguggcgguuggagcuauuacugcgccgggcucaagaaagugaccgaagucagaggauauacaaagggcggcccugggcacgaggagccggugcccaugucaacuuacggauggaauaucguaaaacuuaugagugguaaggauguguucuaccugccaccugaaaaaugugacaccuugcugugcgauauaggcgagagcucccccucuccuacaguugaagagagcaggacuauucgcgugcucaagauggucgagccaugguuaaagaacaaucaguucuguaucaaagugcugaaccccuauaugccuaccgucaucgaacaccuugagcggcugcaacgaaagcaugggggaaugcuagugagaaauccacucuccaggaacucaacacacgaaauguacuggauuucuaauggcaccgguaacauaguugcuaguguaaauauggugucgcgccuguugcugaaccgguuuacuaugacgcauagacgucccacaaucgagaaagacgucgaucucggggcgggaaccaggcacgugaacgccgaaccggagacuccuaauauggacguuauuggcgagcggaucaagcgcauuaaagaagagcacaacagcaccuggcauuaugacgaugaaaauccauacaagacaugggcauaucacggcuccuacgaggugaaggcuacggggucugccucaagcaugaucaacggagucgugaaacuucugaccaagcccugggacguagugccuaugguuacucagauggcaaugacagauaccacuccauucggucagcaacgagucuuuaaagaaaagguggacacaagaacccccagguccaugccgggcacacggcgcgugauggggauaacugccgagugguuauggagaacccugggaaggaauaaaaagccucgauugugcacgcgggaggaauucaccaagaaaguccguacaaacgcugccaugggcgcgguuuuuacugaggaaaaucagugggauagugcaaaggccgcuguggaggacgaagauuucuggaaacucguagacagagagcgcgagcugcauaagcuagguaaaugugggucuugcguguauaacaugaugggaaagagggaaaaaaagcuuggcgaguuuggcaaggccaaagggagccgggcaaucugguacauguggcugggagcuagauaccucgaauucgaggcccuggguuuuuugaaugaggaucacugguucucacgcgaaaacuccuauaguggcgucgagggggaaggacugcauaagcucggcuacauucuuagggacaucagcaaaauucccgguggggcuauguaugccgaugacaccgcaggaugggacacacgaaucacugaggaugaccugcacaaugaagagaagauaacccagcagauggauccagagcaccggcaauuagcgaacgccauuuuuaaacugacguaccagaauaaggugguuaaggugcagagaccuacacccaccggcacugucauggacaucaucucuaggaaagaucagcgcggcuccgggcaagugggaacauaugguuugaacaccuucacuaauauggaagcucagcucauucgucagauggagggcgaagggguacugucaaaggccgaccuagagagcccacaucuucccgaaaaaaagauaacccaguggcuggagacaaaaggaguugagcggcucaagagaauggcaaucucgggcgaugacugcguggucaagccuauugaugacagguuugcuaacgcccuguuggcauuaaacgauauggguaaagugcgcaaggacaucccacaauggcagccgucuaaaggguggcacgauuggcagcaggugcccuucuguagucaucacuuccacgaacugauuaugaaggacggacgaaaacucgucguuccuugccggccacaagacgagcuuaucggcagagccaggauaucccagggcgcgggguggagccugcgcgaaacggcuugucuaggaaaggccuacgcacagauguggucacugauguauuuucauagacgggaucucagguuggccuccaaugcuaucugcucugccgugcccguacacugggugccuaccagccguacuacauggaguauucaugcacaccaucaauggaugaccacugaggacaugcugacagucuggaaccgaguguggaucgaagauaauccauggauggaggacaagacccccguuacgacaugggagaacgugccuuaccuugguaaacgcgaagaucagugguguggcucccugauugggcucaccagcagagcuacuugggcccagaauaucccgaccgcgauucagcaaguccggucuuuaauaggaaacgaggaauuccuggacuacaugccaucaaugaagagguuucgcaaagaggaggaaagugagggcgcuaucugguga

SEQ ID NO: 15553 - RNA, 9873 nt, Artificial Sequence
  derived and/or modified CDS sequence (opt3) from DENV-3__EU529688__SS-prME
accagccugugccucaugaugauccuucccgccgcucuggcauuccacuugaccuccagggacggagaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucucucugaaggauacguuaaagcguagaagcuggccacucaaugaaggggugauggccguuggacuggugucaauucuugcaaguucccuguugaggaacgacgucccuauggccggcccccucguggcuggugggcugcuaaucgcauguuacguaauuacaggaaccucugccgaucugacuguggagaaagcggcugacgucacaugggaagaggaagccgagcagaccggcguuagccauaaccuuaugaucacuguggacgaugacggcacaaugcgcauaaaggaugacgagaccgaaaauauucucacggugcuguugaaaacugcauuacugaucgucuccgggaucuuuccauacucaauuccggccacccuccugguguggcacacauggcagaagcagacccaacggagcggaguucuuugggauguaccuagucccccagagacacagaaagcugaacuggaggaggguguguauagaauaaagcagcagggcaucuucgggaaaacucaagucggagugggcguucagaaggaagguguguuucauaccauguggcacgucacgagaggggccguguugacauacaacggaaagcgacuagagcccaauugggcaucugucaagaaggaccugauuuccuauggcggcggguggcgccucagcgcucaguggcaaaaaggagaagagguccaggugaucgccguugaaccugguaagaaccccaagaauuuccagacuaugcccggcaccuuccagacaaccacuggggagauuggagcgaucgcccuggauuuuaagccuggcaccucggguucaccgauaaucaaccgggaggggaagguggucggacuuuacggcaauggcgugguuaccaagaacgggggauaugugucugguauugcacaaacgaaugcugaaccagacggccccacuccugaguuagaagaggaaauguucaagaaaagaaaccugaccaucauggaucuccacccagggaguggaaagacaaggaaauacuugcccgccauuguccgugaggcuaucaagcgccggcugagaacccucauacuggcaccuacuagggugguagccgccgagauggaagaggcucuuaagggccugccgauucgauaucagacaaccgcgacgaaauccgaacauacuggucgggagaucguggacuugaugugccacgcaacauuuaccaugcgccuacugagccccguuagagucccaaauuacaaccucaucauuauggaugaagcccauuucaccgacccugcuucuaucgccgcaaggggguacauaagcacucgggugggaaugggcgaggccgcugcgauuuuuaugacagccacaccaccaggcacagcagaugcuuucccucaguccaaugcccccauccaggacgaggaacgagacauuccagagagaucauggaacagugggaaugaauggaucacugauuuugcaggaaagacggugugguucgucccgagcauaaaagccgguaacgacauugcuaacuguuuacgcaagaauggcaaaaagguaauccaacugucuaggaagaccuuugauacagaguaucagaaaacuaaacuuaacgacugggauuucgugguuaccacagacaucuccgagaugggggccaauuuuaaagcggaucgugugauugacccucggagaugccugaagcccgucauccucaccgauggaccagaaagggugauuuuggcaggccccaugccuguuacugccgcuucagccgcucagcgccgagguagaguggggcggaacccacagaaagagaaugaccaauacauauucacgggccagccccugaacaaugaugaagaccacgcacauuggaccgaggccaagaugcuccuggacaacaucaauacaccugaaggaauuaucccggcucuuuucgagccagagagggaaaagagugccgcaaucgauggcgaguaucgccuaaaaggggaaagccguaagacuuuugucgagcugaugagacggggagacuugcccgugugguuagcgcacaaaguagccuccgaagguauuaaguacaccgauaggaaauggugcuucgacggccagcgcaacaaucagauacuggaggagaacauggauguggaaaucuggacaaaggagggggagaaaaagaagcuccgaccuagauggcuggacgcucggaccuauucugauccccuugcccugaaagaguuuaaggacuucgcagcuggaaggaaaucgauugcccucgauuugguuacugaaaucggccgcgucccaagccaccuggcacauagaacaaggaaugcccuagacaaccuggugaugcuccacacgucagagcauggugggaaggcuuaccggcacgcgguggaggaacuuccugagaccauggaaacucuguuauugcugggccucaugauucugcuuacaggaggcgccaugcuguuucucaucuccgggaaaggaauagguaagaccaguaucggcuugauuugugucaucgcaucuagcgggaugcuguggauggcugagauucccuuacaauggaucgccuccgccauaguucuagaguucuuuaugauggugcugcucauuccagaaccugagaagcagcguaccccgcaggauaaucaacuugcauauguagugaucggcauucugacauuggcugccaucauagcggcuaacgaaaugggccugcucgagacuacgaaacgcgaccuggguaugucaaaggaacccggggucgugucuccaaccagcuaccuugauguugaccuccacccugccagugcauggacacuguacgccguggcuacuaccgucaucacacccauguugcgacauaccauugaaaauuccacugcaaacguaagccuggccgcgaucgcuaaccaggccgugguuuuaaugggccuagacaaaggauggccaauuucuaagauggaucugggcgugccucuccuugcacuggggugcuauucacaggucaaucccuugacgcugacagccgcugugcuccugcuuaucacccacuacgccauaauuggaccgggcuuacaggcaaaagcuacuagagaggcccaaaagaggaccgcggccgguaucaugaagaacccaacagucgacgggaucaugacuauugaucuggacccugugaucuaugauuccaaauucgagaagcagcucggacagguuauguugcuggugcuaugugcaguacagcugcuccuuaugcggaccaguugggcucugugcgaggccuugacacuggcaacgggccccauaaccacucucugggaagguagcccaggcaaauuuuggaauacaaccauugcugugucgauggccaacaucuuccgcgggucuuaccuggccggagcgggcuuagcuuuuuccauuaugaaaagcgucgggacuggaaaaagaggcacagguucacaaggggagacccuuggagaaaaguggaagaaaaagcugaaucagcucaguaggaaagaguucgaccuauauaagaaaucuggcaucacggagguugaucggaccgaagcaaaggagggucugaaacgaggcgaaauaacacaucacgccguguccagagggagcgcuaaguugcagugguuugucgagcgcaacauggugauccccgaaggaaggguaauugaccugggcugugggcggggaggcuggucauacuauugcgccggucucaagaaagugacugagguucguggguacaccaagggaggcccuggccaugaggaaccggugcccaugaguacauacggguggaauaucgucaaacuuaugagcggaaaggauguguucuaucugccaccugagaaaugugacacuuugcugugcgauauuggugaauccucucccagcccuaccgucgaggaguccagaacaaucagggugcucaagaugguugaaccaugguuaaagaacaaucaguucuguauuaaaguacugaaccccuacaugccuaccgugaucgagcaccuugaacgccugcaacggaagcacggcgggaugcuaguccgaaauccacucucaagaaacucuacucaugagauguauuggauaaguaauggaacgggcaacauuguggcaucgguuaauauggugagcaggcuguugcugaaccgcuuuacaaugacccaccggagacccacuaucgaaaaagacgucgaucucggugccgggacccgucaugugaacgcugagccggagacaccuaauauggacguaaucggagaaaggauuaagcggauaaaagaggaacacaacuccacguggcacuacgacgaugagaauccauauaagaccugggcguaccauggcucuuaugaagugaaggccacuggcucagcaagcuccaugaucaacgggguugucaaacuucugacaaagcccugggacguggugccuauggucacccagauggcuaugacugauacaaccccauucggacagcaacgcguuuuuaaagagaagguggacacacgaacucccagaaguaugccggguaccaggcggguaaugggcauuacggccgagugguuauggcgcacccuggggagaaauaaaaagccuagguugugcacacgagaagaguucacuaagaaagugcggaccaacgcagccaugggagcugucuuuacagaagagaaucagugggauucugccaaggcggcaguggaagacgaggauuucuggaaacucguugaccgugagagagaacugcacaagcuaggcaaaugugguagcugcguguacaacaugauggggaagcgcgagaagaaacuuggagaauuuggcaaagccaaaggcucaagggcuaucugguacauguggcugggggcccgguaucucgaguucgaggcacugggauuuuugaaugaagaucauugguucuccagagagaacaguuacagcggugucgaaggcgaggggcugcacaagcucggauauauucuucgcgacaucucuaaaauacccggcggugcuauguacgccgaugacacugcugggugggacaccaggaucacggaagaugaccugcauaaugaggagaagauuacacagcagauggauccagaacaccgacaauuagccaacgcaaucuuuaaacugaccuaucagaauaaggugguaaagguucagcggccuacucccacaggaaccgugauggacauuaucuccagaaaagaucagaggggcucaggccaagucgggacuuacggauugaacaccuucacaaauauggaggcgcagcucauacgccagauggaaggugagggcgugcugagcaaggccgaccuagaaaacccacaccuucccgagaaaaagauuacgcaguggcuggagaccaaagggguggaacgucucaagcggauggcuaucucgggagaugacugcgucguuaagccuaucgaugacagauuugccaacgcacuguuggcuuuaaaugauaugggcaaagugaggaaggacauuccacaauggcagccgucuaaagguuggcaugauuggcagcagguacccuucuguagucaccauuuccacgagcugauaaugaaggacgggcgcaaacucguggucccuugccgaccacaagacgaacuuaucggacgggccagaauuucccagggcgcaggcuggagccugagggagacugccugucuagggaaggcguaugcucagauguggucacugauguacuuucaccgcagagaucuccgguuggccuccaacgcaaucugcucugccgugcccguucauugggugccuacaagcaggaccacuuggaguauucacgcucaucaccaauggaugacaaccgaagacaugcugacggucuggaaucguguguggaucgaggauaacccauggauggaggacaagacacccguaaccacuugggaaaauguuccuuaccuuggaaaacgagaggaucaguggugugguucccugauaggccucaccagccgcgccacaugggcacagaacaucccgacugcuauucagcaagugagaucuuuaaucgggaaugaagaguuccuggacuauaugccaucaaugaagcgguuuaggaaagaggaagagagugaaggagccauuugguga

SEQ ID NO: 15554 - RNA, 9873 nt, Artificial Sequence
  derived and/or modified CDS sequence (opt3) from DENV-3__EU482613__SS-prME
accagccugugccucaugaugauccuuccagccgcucuggcauuccacuugacauccagagacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacguacaacggaaagcgacuagagcccaauugggcaucugucaagaaggaccugaucuccuauggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagaucgugggacuuuacggcaauggcgucgugaccaaaaacgggggauauguuucugguauugcacaaacaaaugcugaaccagacggccccacgccugaguuagaagaggaaauguucaagaaaagaaaccugacuaucauggaucuccacccagggaguggaaagaccaggaaauacuugcccgccauagugcgugaggcuauuaagcgccggcugagaacacucauccuggcaccuaccagggucguggccgccgagauggaagaggcucuuaagggccugccgauccgauaucagacuacagcgaccaaauccgaacauacgggucgggagauuguagacuugaugugccacgcaacuuuuacaaugcgccuacugagccccgugagaguuccaaauuacaaccucaucauaauggaugaagcccauuucaccgacccugcuucuauugccgcaaggggguacaucagcacccgggucggaaugggcgaggccgcugcgauuuuuaugacugccacacccccaggcaccgcagaugcuuucccucaguccaaugcccccauccaggacgaggaacgagacauaccagagagaucauggaacagugggaaugaauggauuacagauuuugcaggaaagacugugugguucgugccgagcaucaaagccgguaacgacaucgcuaacuguuuacgcaagaauggcaaaaaggucauucaacugucuaggaagacguuugauaccgaguaucagaaaacaaaacuuaacgacugggauuucguagugacuaccgacaucuccgagaugggggccaauuuuaaagcggaucguguuauugacccucggagaugccugaagcccgugauacucacagauggaccagaaagggucaucuuggcaggccccaugccugugaccgccgcuucagccgcucagcgccgagguagaguugggcggaacccacagaaagagaaugaccaauacauuuucacuggccagccccugaacaaugaugaagaccacgcacauuggacggaggccaagaugcuccuggacaacaucaauaccccugaaggaaucauuccggcucuuuucgagccagagagggaaaagagugccgcaauagauggcgaguaucgccuaaaaggggaaagccguaagacauuuguggagcugaugagacggggagacuugcccgucugguuagcgcacaaaguggccuccgaagguaucaaguacacugauaggaaauggugcuucgacggccagcgcaacaaucagauucuggaggagaacauggauguagaaaucuggaccaaggagggggagaaaaagaagcuccgaccuagauggcuggacgcucggacauauucugauccccuugcccugaaagaguuuaaggacuucgcagcuggaaggaaaucgauugcccucgauuuggugaccgaaaucggccgcguuccaacucaccuggcacauagaacaaggaaugcccuagacaaccuggucaugcuccacacgagcgagcauggugggaaggcuuaccggcacgcgguggaggaacuuccugagaccauggaaacucuguuauugcugggccucaugauacugcuuacaggaggcgccaugcuguuucucaucucagggaaaggaauugguaagaccuccaucggcuugauuugugugaucgcaaguucugggaugcuguggauggcugagauacccuuacaauggauugccagcgccaucguccuagaguucuuuaugaugguucugcucauuccagaaccugagaagcagcguaccccgcaggauaaucaacuugcauaugugguaaucggaauacugacauuggcugccaucauugcggcuaacgaaaugggccugcucgagacuacgaaacgcgaccuggguauguccaaggaacccgggguggucucaccaaccucuuaccuugauguggaccuccacccugccagcgcauggacacuguacgccguugcuacuaccgugaucacacccauguugcgacauaccauugagaauaguacugcaaacgucucccuggccgcgaucgcuaaccaggccguaguguuaaugggccuagacaaaggauggccaauaagcaagauggaucugggcguuccucuccuugcacuggggugcuauucucaggugaaucccuugacgcugacagccgcuguccuccugcuuauuacccacuacgccaucaucggaccgggcuuacaggcaaaagcuacuagagaggcccaaaagaggaccgcggccgguauuaugaagaacccaacaguggacgggaucaugacuauagaucuggacccugucauuuaugauucaaaauucgaaaagcagcucggacaggugauguugcugguucuaugugcagugcagcugcuccuuaugcggaccuccugggcucugugcgaggccuugacacuggcaacgggccccaucaccacucucugggaagguaguccaggcaaauuuuggaauacaaccauugcuguaagcauggccaacaucuuccgcgggucguaccuggccggagcgggcuuagcuuuuucuauaaugaaguccguggggacuggaaaaagaggcacagguagccaaggggagacccuuggagaaaaguggaagaaaaagcugaaucagcucucaaggaaagaguucgaccuauauaagaaaaguggcaucacggaggucgaucggaccgaagcaaaggagggucugaaacgaggcgaaauuacacaucacgccguuucuagaggguccgcuaaguugcagugguuuguggagcgcaacauggucauccccgaaggaagggugauugaccugggcugugggcggggaggcuggagcuacuauugcgccggucucaagaaaguaacugaggugcguggguacaccaagggaggcccuggccaugaggaaccgguucccaugucaacauacggguggaauaucgugaaacuuaugaguggaaaggaugucuucuaucugccaccugagaaaugugacacuuugcugugcgauauuggugaaagcucccccucuccuaccguggaggagagcagaacaaucaggguccucaagaugguggaaccaugguuaaagaacaaucaguucuguauaaaaguucugaaccccuacaugccuaccguaauugagcaccuugaacgccugcaacggaagcacggcgggaugcuagugcgaaauccacucuccagaaacucaacucaugagauguauuggaucucuaauggaacgggcaacaucgucgcaagugugaauaugguuucgaggcuguugcugaaccgcuuuacaaugacccaccggagacccacuauugaaaaagacguggaucucggugccgggacccgucaugucaacgcugagccggagacaccuaauauggacgugauaggagaaaggaucaagcggauuaaagaggaacacaacagcacguggcacuacgacgaugagaauccauauaagaccugggcguaccauggcuccuaugaaguaaaggccacuggcucugcaucaagcaugaucaacggggugguuaaacuucugacaaagcccugggacgucgugccuauggugacccagauggcuaugacugauacaaccccauucggacagcaacgcgucuuuaaagagaagguugacacacgaacucccagauccaugccggguaccaggcgggugaugggcauuacggccgagugguuauggcgcacccuggggagaaauaaaaagccuagguugugcacacgagaagaguucacuaagaaaguacggaccaacgcagccaugggagcuguguuuacagaagagaaucagugggauagugccaaggcggcagucgaagacgaggauuucuggaaacucguggaccgugagagagaacugcacaagcuaggcaaaugugguucuugcguuuacaacaugauggggaagcgcgagaagaaacuuggagaauuuggcaaagccaaaggcagcagggcuaucugguacauguggcugggggcccgguaucucgaguucgaggcacugggauuuuugaaugaagaucauugguucucaagagagaacuccuacagugguguggaaggcgaggggcugcacaagcucggauauauacuucgcgacaucagcaaaauucccggcggugcuauguacgccgaugacacugcugggugggacaccaggaucacggaagaugaccugcauaaugaggagaagauuacacagcagauggauccagaacaccgacaauuagccaacgcaaucuuuaaacugaccuaucagaauaaggucgugaagguacagcggccuacucccacaggaaccguuauggacauaauuucuagaaaagaucagaggggcuccggccaaguggggacuuacggauugaacaccuucacaaauauggaggcgcagcucauccgccagauggaaggugagggcguccugucaaaggccgaccuagaaaacccacaccuucccgagaaaaagaucacgcaguggcuggagaccaaagggguggaacgucucaagcggauggcuauuagcggagaugacugcguggucaagccuauagaugacagauuugccaacgcacuguuggcuuuaaaugauaugggcaaaguuaggaaggacaucccacaauggcagccgucgaaagguuggcaugauuggcaacaggugcccuucuguucucaccauuuccacgagcugauuaugaaggacgggcgcaaacucguagugccuugccgaccacaagacgaacuuaucggacgggccagaauuagucagggcgcaggcuggucccugagggagacugccugucuagggaaggcguaugcucagauguggagccugauguacuuucaccgcagagaucuccgguuggccucaaacgcaaucugcuccgccguccccgugcauuggguuccuacaucuaggaccacuuggagcauacacgcucaucaccaauggaugacaaccgaagacaugcugacgguguggaaucgugucuggaucgaggauaacccauggauggaggacaagacacccgugaccacuugggaaaauguaccuuaccuuggaaaacgagaggaucaguggugugguagucugauuggccucaccucccgcgccacaugggcacagaacaucccgacugcuauucagcaaguuaggagcuuaaucgggaaugaagaguuccuggacuauaugccaucuaugaagcgguuuaggaaagaggaagagucagaaggagccauuugguga

SEQ ID NO: 15555 - RNA, 9873 nt, Artificial Sequence
  derived and/or modified CDS sequence (opt3) from DENV-3__EU529690__SS-prME
accagccugugccucaugaugauccuucccgccgcucuggcauuccacuugaccuccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacacugguugugugaucaauuggaaagggaaggagcugaagugcggauccggcauuuucgugacaaacgagguccauaccuggacugaacaguacaaauuucaagcagauucucccaagcggcuagccaccgcuaucgccggugcaugggagaauggcguuugugggauacgaagcacaacgcgcauggaaaaccuccuguggaaacagaucgcuaaugagcuuaacuauauuuugugggaaaauaacaucaagcugaccguggugguaggagacauuaucggcguccucgagcaggggaaaagaacucugacaccacagccuauggaguuaaaguacucauggaaaaccuggggaaaggccaagauagugacagcggaaacucaaaacaguuccuucauuaucgauggccccaauaccccagagugccccagcgccucuagggcuuggaacguuugggaaguggaggacuaugguuuuggggucuucacgacaaauauuuggcugaaacuucgggaaguguacacccaguugugugaccaccgccucaugucagcagccguuaaggaugagagagcugugcacgccgacaugggauacuggaucgagagucagaaaaacggcagcuggaagcuggaaaaagcaucccuaauagagguaaagacuugcaccuggccuaagucucauacacuguggucgaaugguguccucgaaagcgauaugaucauuccaaaaucccuggcgggcccgaucucacagcacaacuauaggcccggguaccauacucaaaccgccggaccuuggcaccuuggcaaguuggagcuggacuuuaauuauugcgaggggacaacgguggugauuaccgaaaacuguggaacucguggcccaaguuuacggacaaccacugucucugguaaacucauccacgaguggugcugucgaagcugcacacugcccccucuuagauacaugggggaagauggauguugguauggcauggagauaaggccaauuuccgaaaaggaggagaauaugguuaaaucacuggugagcgcugguucuggcgaaguagacaacuucaccauggggguguugugccucgccauccuguuugaggaagucaugcgcggaaaguucggcaagaaacauaugaucgcagggguguucuuuacguucguucuacugcucuccggacagauuacuuggcgggauauggcucacacccugaucaugauuggcaguaaugccagcgacagaauggguaugggggugacauaccuugcauugauagccaccuuuaagauccagcccuuccuggcuuuaggauuuuuccucaggaaacugacuucucgcgagaaccuucugcuaggcgucggccucgcgauggccacaacccugcaauugccggaagauauugagcagauggcaaaugggaucgcucugggauuaauggcccucaagcugauuacacaguuugagacuuaucagcuuuggaccgcccugaucuccuugacguguucaaacacaauauucacccucacuguggcuuggcgaaccgcaacacugauccuagccgguguuagucugcuuccugugugccaaagcucguccaugcggaaaacugacuggcucccaaugaccgucgcggcuaugggcguacccccucugcccuuguuuauuuucaaucugaaggauacguuaaagcguagaucuuggccacucaacgaaggggugauggccguuggacuggugagcauccuugcaucaagucuguugaggaacgacgucccuauggccggcccccucguggcuggugggcugcuaauugcauguuacguaaucacaggaaccuccgccgaucugacuguggagaaagcggcugacgucacaugggaagaggaagccgagcagaccggcguuucucauaaucuuaugauaacuguggacgaugacggcacaaugcgcauuaaggaugacgagaccgaaaacauccucacggugcuguugaaaacugcauuacugaucgucagcgggauuuuuccauacuccauaccggccacccuccugguguggcacacauggcagaagcagacccaacggucaggaguucuuugggauguaccuagcccaccagagacacagaaagcugaacuggaggaggguguguauagaaucaagcagcagggcauuuucgggaaaacucaagucggagugggcguucagaaggaagguguguuucauaccauguggcacgucacgagaggggccguguugacauacaauggaaagcgacuagagcccaacugggcaagugucaagaaggaccugaucucuuauggcggcggguggcgccucuccgcucaguggcaaaaaggagaagagguccaggugauugccguugaaccugguaagaaucccaagaauuuccagacuaugcccggcaccuuccagacaaccacuggggagaucggagcgauagcccuggauuuuaagccuggcaccagcgguucgccgaucauuaaucgggaggggaagguggucggacuuuacggcaacggcgugguuaccaaaaaugggggauaugugucagguaucgcacaaacgaacgcugaaccagacggccccacuccugaguuagaagaggaaauguucaagaaaagaaaucugaccauuauggaucuccacccagggucuggaaagacaaggaaauacuugcccgccaucguccgugaggcuauaaagcgccggcugagaacccucauucuggcaccuacuagggugguagccgccgagauggaagaggcucuuaagggccugccgauccgauaucagacaaccgcgacgaaaagugaacauacuggucgggagaucguggacuugaugugccacgcaacauuuaccaugcgccuacugucccccguuagagucccaaacuacaaucucauuaucauggaugaagcccauuucaccgacccugcuagcauagccgcaaggggguacauuucuacucgggugggaaugggcgaggccgcugcgaucuuuaugacagccacacccccaggcacagcagaugcuuucccucagagcaacgcccccauucaggacgaggaacgagacaucccagagagauccuggaacucagggaacgaauggauaacugauuuugcaggaaagacggugugguucgucccgaguauuaaagccgguaacgacaucgcuaauuguuuacgcaagaacggcaaaaagguaauccaacugagcaggaagaccuuugauacagaguaucagaaaacuaaacuuaaugacugggauuucgugguuaccacagacauuucugagaugggggccaacuuuaaagcggaucgugugaucgacccucggagaugccugaagcccgucauucucaccgauggaccagaaagggugauauuggcaggccccaugccuguuacugccgcuuccgccgcucagcgccgagguagaguggggcggaauccacagaaagagaacgaccaauacaucuucacgggccagccccugaauaacgaugaagaccacgcacauuggaccgaggccaagaugcuccuggacaauauuaacacaccugaaggaaucaucccggcucuuuucgagccagagagggaaaagucagccgcaauugauggcgaguaucgccuaaaaggggaaagucguaagacuuuugucgagcugaugagacggggagacuugcccgugugguuagcgcacaaaguagccagcgaagguauaaaguacaccgauaggaaauggugcuucgacggccagcgcaauaaccagauccuggaggagaauauggauguggaaauuuggacaaaggagggggagaaaaagaagcuccgaccuagauggcuggacgcucggaccuauuccgauccccuugcccugaaagaguuuaaggacuucgcagcuggaaggaaaucuaucgcccucgauuugguuacugaaauuggccgcgucccaacacaccuggcacauagaacgaggaacgcccuagacaaucuggugaugcuccacaccucggagcauggugggaaggcuuaccggcacgcgguggaggaacuuccugagacuauggaaacacuguuauugcugggccucaugauccugcuuaccggaggcgccaugcuguuucucauaagcgggaaaggaaucgguaagaccucaauuggcuugaucugugucauugcauccagugggaugcuguggauggcugagauccccuuacaauggauagccucugccauuguucuagaguucuuuaugauggugcugcucaucccagaaccugagaagcagcguacaccgcaggauaaccaacuugcauauguagugauuggaauccugacuuuggcugccauaaucgcggcuaaugaaaugggccugcucgagacgaccaaacgcgaccuggguaugagcaaggaacccggggucguguccccaacaucauaccuugauguugaccuccacccugccucugcauggacucuguacgccguggcuaccacagucauuacccccauguugcgacauacuaucgagaacagcacggcaaacguaagucuggccgcgauugcuaaucaggccgugguuuuaaugggccuagacaaaggauggccaaucuccaagauggaucugggcgugccucuccuugcacuggggugcuauagccaggucaaccccuugacacugaccgccgcugugcuccugcuuauaacucacuacgccauuaucggaccgggcuuacaggcaaaagcuaccagagaggcccaaaagaggacagcggccgguaucaugaagaauccaacugucgacgggauuaugaccaucgaucuggacccugugauauaugauucuaaauucgaaaagcagcucggacagguuauguugcuggugcuaugugcaguacagcugcuccuuaugcggacaucaugggcucugugcgaggccuugacgcuggcaaccggccccauuacuacacucugggaagguuccccaggcaaauuuuggaacaccacuaucgcugugaguauggccaauauuuuccgcgggagcuaccuggccggagcgggcuuagcuuuuucgaucaugaagucugucgggacaggaaaaagaggcaccgguucccaaggggagacgcuuggagaaaaguggaagaaaaagcugaaccagcucagcaggaaagaguucgaccuauauaagaaaucaggcauaaccgagguugaucggacagaagcaaaggagggucugaaacgaggcgaaaucacucaucacgccgugaguagagggucugcuaaguugcagugguuugucgagcgcaauauggugauucccgaaggaaggguaaucgaccugggcugugggcggggaggcugguccuacuauugcgccggucucaagaaagugaccgagguucguggguacacaaagggaggcccuggccaugaggaaccggugcccaugagcacuuacggguggaacauugucaaacuuaugucaggaaaggauguguucuaucugccaccugagaaaugugacaccuugcugugcgauaucggugaaaguagccccuccccuacagucgaggagucuagaaccauuagggugcucaagaugguugaaccaugguuaaagaauaaccaguucuguaucaaaguacugaaucccuacaugccuacugugauagagcaccuugaacgccugcaacggaagcacggcgggaugcuaguccgaaacccacucagcagaaauuccacgcaugagauguauuggauuucaaacggaacaggcaauaucguggcaucuguuaacauggugaguaggcuguugcugaaccgcuuuaccaugacucaccggagacccaccaucgaaaaagacgucgaucucggugccgggacacgucaugugaaugcugagccggagacgccuaacauggacguaauuggagaaaggauaaagcggaucaaagaggaacacaauucgaccuggcacuacgacgaugagaacccauauaagacuugggcguaccauggcagcuaugaagugaaggccacaggcuccgcaucuucaaugauuaaugggguugucaaacuucugaccaagcccugggacguggugccuauggucacucagauggcuaugacagauaccacaccauucggacagcaacgcguuuuuaaagagaagguggacacucgaacccccagaagcaugccggguacgaggcggguaaugggcaucaccgccgagugguuauggcgcacacuggggagaaacaaaaagccuagguugugcacucgagaagaguucaccaagaaagugcggacaaaugcagccaugggagcugucuuuacugaagagaaccagugggauuccgccaaggcggcaguggaagacgaggauuucuggaaacucguugaccgugagagagaacugcacaagcuaggcaaaugugguaguugcguguacaauaugauggggaagcgcgagaagaaacuuggagaauuuggcaaagccaaaggcucuagggcuauuugguacauguggcugggggcccgguaucucgaguucgaggcacugggauuuuugaacgaagaucauugguucagcagagaaaauucauacuccggugucgagggcgaggggcugcacaagcucggauauauccuucgcgacauaaguaaaauccccggcggugcuauguacgccgaugacaccgcugggugggacacgaggauuacagaagaugaccugcauaacgaggagaagaucacccagcagauggauccagaacaccgacaauuagccaaugcaauuuuuaaacugacuuaucagaacaaggugguaaagguucagcggccuacacccaccggaacugugauggacaucauaagcagaaaagaucagaggggcucuggccaagucgggaccuacggauugaauacauucacgaacauggaggcgcagcucauucgccagauggaaggugagggcgugcuguccaaggccgaccuagaaaacccacaccuucccgagaaaaagaucacccaguggcuggagacuaaagggguggaacgucucaagcggauggcuaucucaggagaugacugcgucguuaagccuauugaugacagauuugccaaugcacuguuggcuuuaaacgauaugggcaaagugaggaaggacauaccacaauggcagccgagcaaagguuggcaugauuggcagcagguacccuucuguucgcaccauuuccacgagcugaucaugaaggacgggcgcaaacucguggucccuugccgaccacaagacgaacuuauuggacgggccagaaucucucagggcgcaggcuggagucugagggagacagccugucuagggaaggcguaugcucagauguggucccugauguacuuucaccgcagagaucuccgguuggccagcaaugcaauuugcucagccgugcccguucauugggugccuaccuccaggacuacauggucuauccacgcucaucaccaauggaugaccacggaagacaugcugacagucuggaaccguguguggauagaggauaauccauggauggaggacaagacccccguaacuaccugggaaaacguuccuuaccuuggaaaacgagaggaucaguggugugguagccugaucggccucacaagucgcgccacuugggcacagaauauuccgaccgcuauccagcaagugagauccuuaauugggaacgaagaguuccuggacuauaugccaagcaugaagcgguuuaggaaagaggaagagucugaaggagccaucugguga

SEQ ID NO: 15556 - RNA, 9873 nt, Artificial Sequence
  derived and/or modified CDS sequence (opt3) from DENV-3__EU529691__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauucagggcgucuuauaacugcaaacccaguugugaccaaaaaggaggaacccguaaauauugaggccgaaccgccuuucggcgagagcaacaucgucaucggaauuggcgauaaugcuuugaaaaucaacugguauaagaaggggaguucuauuggaaaaauguuugaagccacagcacgcggugccagaaggauggcuauacugggcgacacugccugggauuucggguccgugggaggcguucucaauagccuggguaagauggugcaccagaucuuugggucggcauacaccgcgcuuuucucuggcgucuccugggugaugaaaauuggaaucggcguacuguugacguggaucgggcucaacucaaagaauacaaguaugagcuuuuccugcauugcugugggaauaaucacccuguauuuaggcgccguuguccaggcagacauggguugugugauuaacuggaaagggaaggagcugaagugcggaucuggcaucuucgugacuaaugagguccauacauggaccgaacaguacaaauuucaagccgauagccccaagcggcuagcuacugccauugcaggugcuugggagaacggcguuugugggauccgaucaaccacacgcauggaaaaucuccuguggaaacagauagccaacgagcuuaauuauaucuugugggaaaacaauauuaagcugacgguggugguaggagacaucauuggcguccucgagcaggggaaaagaacccugacuccacagccuauggaguuaaaguacaguuggaaaacauggggaaaggcgaagaucgugaccgccgaaacacaaaacuccagcuucauaauugauggccccaacacuccagagugccccucugcuucaagggcauggaauguuugggaaguggaggacuaugguuuuggggucuucaccacgaacaucuggcugaaacuucgggaaguguacacacaguugugugaccaccgccucaugagugccgcuguuaaggaugagagagccgugcacgcagacaugggauacuggauugagagccagaaaaauggcuccuggaagcuggaaaaagcgucucuaaucgagguaaagaccugcacuuggccuaagucgcauacccuguggagcaacgguguccucgaauccgauaugauaaucccaaaaucacuggccggcccgauuagucagcacaaucauaggcccggguaucacacacaaacugcuggaccuuggcaccuuggcaaguuggagcuggacuuuaacuacugcgaggggaccacaguggugaucacggaaaauuguggaacccguggcccaucuuuacggacuacaaccgucagcgguaaacucauucaugaguggugcugucgauccugcacucugcccccucuuagauauaugggggaagauggauguugguacggcauggagaucaggccaauaucagaaaaggaggagaacaugguuaaaagccuggugucugccgguuccggcaagguagacaauuucacaauggggguguugugccucgcaauucuguuugaagaggucaugcgcggaaaguucggcaaaaagcacaugaucgcugggguguucuuuaccuucguucuacugcucaguggacagaucacguggcgggauauggcccauacucugauuaugaucggcagcaacgcaucugacagaauggguaugggggugaccuaucuugccuugauugcuacauuuaaaauacagcccuuccuggcguuaggauuuuuccucaggaagcugaccucccgcgaaaaucuucugcuaggcgucggccucgccauggcaacuacacugcaauugccggaggauaucgaacagauggcuaacgggauugcccugggauuaauggcccucaaacugaucacccaguuugagacauaccagcuuuggacugcucugauuucauugaccuguaguaauacgauguucacacucaccguggcauggcgaacugccacccugauccuagcggguguuagccugcuuccugugugccaaucguccucuaugcggaagacagacuggcucccaauggcugucgccgcaaugggcguacccccucugcccuuguuuauauucagccugaaggauacuuuaaaacguagaucauggccacucaacgagggggugauggccguuggacuggugaguauccuugcuuccucucuguugaggaaugacgucccuauggcaggcccccucguggccggugggcugcuaauugcguguuauguaaucaccggaacgagcgcugaucugacaguggaaaaggccgcagacauuaccugggaggaagaggccgaacagacuggcgucucccacaaccuuaugaucacaguugacgaugacggcaccaugcgcauaaaagaugacgagacugagaacauucucacagugcuguugaagaccgcuuuacugaucgugucaggggucuuuccauacagcaucccggccacgcuccugguguggcauacuuggcagaaacagacccaacggaguggaguucuuugggauguaccuucucccccagaaacacagaaggcagagcuggaagaggguguguacagaauuaaacagcagggcauauucgggaagacccaagucggagugggcguucagaaggaggguguguuucacacaauguggcacgucacuaggggggcuguguugaccuauaauggaaaacgacuagaacccaacugggccuccguaaagaaagaccugaucagcuacggcggcggguggcgccucucggcgcaguggcaaaagggagaggaaguccaggugauugccguugagccugguaaaaauccaaagaacuuccagacgaugcccggcacauuccagacuaccacaggggaaaucggagcaauugcucuggauuuuaagccuggcaccucagguucuccgaucauaaaucgggaggggaaaguggucggacuuuauggcaacggcgugguuacuaagaaugggggauacgugagugguaucgcccaaaccaacgcugagccagacggccccacaccugaauuagaggaagagauguucaaaaagagaaaucugacgauuauggaucuccauccaggguccggaaaaacuaggaaguauuugcccgcaaucguccgugaagccauuaagcgccggcugagaacccucauccuggccccuacaagggugguagcugcggagauggaggaagcacuuaaaggccugccgauacgauaccagaccacugccacaaagagcgagcacaccggucgggaaauuguggacuugaugugccaugcuacguuuacuaugcgccuacugucucccguuagagucccaaacuauaaucucaucaucauggaugaggcccacuucacagacccugcaagcauugccgcuaggggguacaucuccacccgggugggaaugggcgaagcggccgcaauauuuaugaccgcuacucccccaggcacagccgaugcauucccucagucaaacgcccccauucaggacgaggagcgagacaucccagaaagaaguuggaauagcgggaacgaguggauuaccgauuuugcuggaaaaacagugugguucgucccgucuaucaaggccgguaaugacauagcgaacuguuuacgcaaaaacggcaagaagguaauucaacuguccaggaaaacuuuugauacggaauaccagaagaccaaacuuaaugacugggauuucgugguuacaacugacaucucagagaugggggcaaacuuuaaggccgaucgugugaucgacccucggagaugccugaaacccgucauucucaccgauggaccagagagggugaucuuggcuggccccaugccuguuacagccgcuagugcagcccagcgccgagguagaguggggcggaauccacagaaggaaaacgaccaauauauuuucaccggccagccccugaauaacgaugaggaccaugcucacuggacugaagccaagaugcuccuggacaauauaaacacgccugagggaaucauuccggcacuuuucgaaccagagagggagaaaagcgcggccaucgauggcgaauaccgccuaaagggggagucccguaaaaccuuugucgaacugaugagacggggagacuugcccgugugguuagcucacaagguagccucugaggguaucaaauauacagauaggaaguggugcuucgacggccagcgcaauaaccagauucuggaagagaauauggauguggagauauggacuaaagaaggggagaagaagaaacuccgaccuagauggcuggacgcacggaccuacucggauccccuugcucugaaggaauuuaaagacuucgccgcaggaaggaagagcaucgcccucgauuugguuacagagauuggccgcgucccaucacaucuggcucacagaaccaggaacgcgcuagacaaucuggugaugcuccauacuuccgaacacggugggcgggccuaucgucacgcaguggaggagcuuccugaaacaauggagacgcuguuauugcugggccucaugauccugcuuaccggaggcgcuaugcuguuucucauuagugggaaaggaaucgguaagacuucuauaggcuugaucugugucauugccagcuccgggaugcuguggauggccgaaauccccuuacaauggauugcaucagcuaucguucuagaguucuuuaugauggugcugcucauaccagagccugaaaagcagcgcacaccgcaggauaaccaacuugccuacguagugauuggaauccugaccuuggcggcuauuaucgccgcaaaugagaugggccugcucgaaaccacaaaacgagaccuggguaugucuaaggagcccggggucgugagcccaacuaguuaucuugauguugaccuccauccugccuccgcuuggacgcuguacgcaguggccaccacagucauaacucccauguugagacacaccaucgaaaacagcacagcgaauguaucucuggcugccauugcaaaccaggccgugguuuuaaugggccuagacaaaggauggccaaucucaaagauggaucugggcgugccucuccuugcucuggggugcuacucccaggucaaccccuugacccugacugccgcagugcuccugcuuauuacgcauuaugcuaucauaggaccgggcuuacaggccaaagcgacaagggaggcccaaaagcggaccgcagcugguauuaugaagaauccaacugucgacgggaucaugaccaucgaucuggacccugugauuuacgauaguaaauucgagaagcagcucggacagguuauguugcuggugcuaugugccguacagcugcuccuuaugcgcacaagcugggcacugugcgaagcuuugacucuggccaccggccccaucacaacgcucugggaggguucgccaggcaaauuuuggaacaccacuauagccgugucuauggcgaauauuuucagaggguccuaucuggcuggagcaggcuuagccuuuagcaucaugaagucagucgggacaggaaaaaggggcaccgguagucaaggggaaacucuuggagagaaguggaagaaaaagcugaaccagcucucucggaaagaauucgaccuauacaagaaauccggcauuacagagguugaucgaaccgaggcuaaggaaggucugaaaagaggcgagacgacccaccaugccgugagccgcgggucagcaaaguugcagugguuugucgaaaggaauauggugauccccgagggacggguaauagaccugggcugugggcguggaggcuggaguuauuacugcgccggucucaagaaagugacagaaguuagaggguauacuaagggaggcccuggccacgaggagccggugcccaugagcaccuacggguggaacaucgucaaacuuauguccggaaaggauguguucuaccugccaccugaaaaaugugacacauugcugugcgauauuggugagucuagccccuccccuacugucgaagagucaaggaccauccgcgugcucaagaugguugagccaugguuaaagaauaaccaguucuguauuaaaguacugaaucccuauaugccuacagugaucgaacaccuugagcggcugcaacgaaagcauggcgggaugcuagucagaaacccacucucuaggaauaguacccacgaaauguacuggauuucgaacggaacuggcaauaucguggcuagcguuaacauggugucccgccuguugcugaaucgguuuacgaugacacauagacgucccaccauagagaaagacgucgaucucggugcggggacuaggcacgugaacgccgaaccggagaccccuaacauggacguaauuggagagcggaucaagcgcaucaaagaagagcacaauucuacauggcauuaugacgaugaaaacccauacaagacgugggcauaucacggcucauacgaggugaaggcuaccggcagcgccuccaguaugauuaaugggguugucaaacuucugacuaagcccugggacguggugccuauggucacacagauggcaaugaccgauacuacaccauucggacagcaacgaguuuuuaaagaaaagguggacaccagaacacccaggucuaugccggguacucggcgcguaaugggcauaaccgccgagugguuauggagaacgcuggggaggaacaaaaagccucgauugugcacccgggaggaauucacaaagaaagugcguacuaaugcugccaugggagcggucuuuaccgaggaaaaccagugggauagcgcaaaggccgcuguggaggacgaagauuucuggaaacucguugacagagagcgcgagcugcauaagcuaggcaaaugugguucaugcguguauaauaugauggggaagagggaaaaaaagcuuggagaguuuggcaaggccaaaggcucccgggcaaucugguacauguggcugggggcuagauaccucgaauucgaggcccugggauuuuugaacgaggaucacugguucagucgcgaaaauagcuauucuggugucgagggcgaagggcugcauaagcucggauacauucuuagggacaucuccaaaauucccggcggugcuauguaugccgaugacacagcagggugggacacucgaaucaccgaggaugaccugcacaacgaagagaagauaacgcagcagauggauccagagcaccggcaauuagcgaaugccaucuuuaaacugacauaccagaacaaggugguaaagguucagagaccuacccccacuggaacagugauggacauuaucucaaggaaagaucagcgcggcagcggccaagucgggaccuauggauugaauacuuucaccaacauggaagcucagcucauucgucagauggagggugaaggcgugcugucgaaggccgaccuagagaauccacaucuucccgaaaaaaagaucacacaguggcuggagacgaaagggguggagcggcucaagagaauggcaauaucuggagaugacugcgucguuaagccuauugaugacagguuugcuaacgcccuguuggcauuaaacgauaugggcaaagugcgcaaggacaucccacaauggcagccgaguaaagguuggcacgauuggcagcagguacccuucuguucccaucacuuccacgaacugaucaugaaggacgggcgaaaacucguggucccuugccggccacaagacgagcuuauuggaagagccaggauaagccagggcgcgggcuggucacugcgcgaaaccgcuugucuagggaaggccuacgcacagauguggucccugauguauuuucauagacgggaucucagguuggccucuaaugcuaucugcagcgccgugcccguucacugggugccuacuagucguacaaccugguccauucaugcacaccaucaauggaugacuacagaggacaugcugaccgucuggaaccgaguguggaucgaagauaauccauggauggaggacaagacgcccguaacaaccugggagaacguuccuuaccuuggaaaacgcgaagaucaguggugugguagccugauuggccucacuucuagagcuaccugggcccagaauaucccgacagcgauacagcaagugcggucauuaaucgggaacgaggaauuccuggacuacaugccaaguaugaagagguuucgcaaagaggaggaauccgagggagcuauuugguga

SEQ ID NO: 15557 - RNA, 9873 nt, Artificial Sequence
  derived and/or modified CDS sequence (opt3) from DENV-3__EU569689__SS-prME
accagccugugccucaugaugauccuucccgcagcucuggcauuccacuugacauccagggacggcgagccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaagccuggggaaaggcgaagauagugacagccgaaacccaaaacaguuccuucauuaucgauggccccaauacaccagagugccccagcgcuucuagggcauggaacguuugggaaguggaggacuaugguuuuggggucuucacuaccaauauuuggcugaaacuucgggaaguguacacgcaguugugugaccaccgccucaugucagccgcuguuaaggaugagagagccgugcacgcagacaugggauacuggaucgagagucagaaaaacggcagcuggaagcuggaaaaagcgucccuaauagagguaaagacaugcaccuggccuaagucucauacucuguggucgaaugguguccucgaaagcgauaugaucauuccaaaaucccuggccggcccgaucucacagcacaacuauaggcccggguaccauacccaaacagcuggaccuuggcaccuuggcaaguuggagcuggacuuuaauuauugcgaggggacuaccguggugauuacagaaaacuguggaacgcguggcccaaguuuacggaccacuacagucucugguaaacucauccacgaguggugcugucgaagcugcacccugcccccucuuagauacaugggggaagauggauguugguauggcauggagauaaggccaauuuccgaaaaggaggagaauaugguuaaaucacuggugagcgccgguucuggcgaaguagacaacuucacuauggggguguugugccucgcaauccuguuugaggaagucaugcgcggaaaguucggcaagaaacauaugaucgcugggguguucuuuacauucguucuacugcucuccggacagauuaccuggcgggaucuggcccacacgcuuaucaugauuggcaguaaugcaagcgacagaauggguaugggggugacuuacuuggcccugauagcuaccuuuaagauccagcccuucuuagcgcucggauuuuuccugaggaaacuuacaucucgcgagaaccugcuacucggcgucggccuggccauggcaaccacuuugcaacugccggaagauauugagcagauggcuaaugggaucgccuuaggacucauggcccugaaacuuauuacacaguuugagaccuaucagcuguggacagcuuugaucucccucacuuguucaaacaccauauucacgcugacaguggcauggcgaaccgccacucuaauccuggcggguguuagucuucucccugugugccaaagcucguccaugcggaaaaccgacuggcugccaaugacagucgcugccaugggcguacccccuuugccccuguuuauuuucucuuuaaaggauacucucaagcguagaagcuggccacugaaugaaggggugauggcaguuggacuugugucaauccuggccaguuccuugcucaggaacgacgucccuauggcuggcccccugguggccggugggcuacugauugccuguuacguaaucaccggaacgucugcggaucuuacaguggagaaagcugccgacgucaccugggaagaggaagcagagcagacuggcguuagccauaaccucaugauaacaguggacgaugacggcaccaugcgcauuaaggaugacgagacugaaaauauccugacaguguuguuaaaaaccgcccugcucaucgucuccgggauuuuuccauacucaauaccggcuacgcugcuuguguggcacacuuggcagaagcagacccaacggagcggaguucugugggauguaccuagucccccagagacacagaaagccgaauuggaggaggguguguauagaaucaagcagcagggcauuuucgggaaaacccaagucggagugggcguucagaaggaagguguguuucauacaauguggcacgucacuagaggggcagugcuaaccuacaacggaaagcgacuggagcccaauugggcuucugucaagaaggaccucaucuccuauggcggcggguggcgccugagcgcccaguggcaaaaaggagaagagguccaggugauugcgguugaaccugguaagaaccccaagaauuuccagacgaugcccggcacauuccagacuaccacaggggagaucggagccauagcacuugauuuuaagccuggcaccucggguucaccgaucauuaaccgggaggggaagguggucggauuauacggcaauggcgugguuacuaaaaacgggggauaugugucugguaucgcucaaaccaaugccgaaccagacggccccacaccugagcuggaagaggaaauguucaagaaaagaaaccucacgauuauggauuugcacccagggaguggaaagacuaggaaauaccugcccgcuaucguccgugaggcaauaaagcgccggcucagaacccugauucuugccccuacaagggugguagccgcugagauggaagaggcgcugaagggcuugccgauccgauaucagaccacugcaacaaaauccgaacauaccggucgggagaucguggaccuaaugugccacgccacguuuacuaugcgccugcucagccccguuagagucccaaauuacaacuuaauuaucauggaugaagcucauuucacagacccugccucuauagcagccaggggguacauuagcacccgggugggaaugggcgaggcugcggccaucuuuaugaccgcaacucccccaggcacagcugaugccuucccucaguccaaugcacccauucaggacgaggaacgagacaucccagagagaucauggaacagugggaaugaauggauaaccgauuuugccggaaagacagugugguucgucccgagcauuaaagcugguaacgacaucgccaacugucugcgcaagaauggcaaaaagguaauccaacuuucuaggaagacuuuugauacggaguaucagaaaaccaagcugaacgacugggauuucgugguuacaacugacauuuccgagaugggggcgaauuuuaaagcagaucgugugaucgacccucggagaugccucaagcccgucauuuugaccgauggaccagaaagggugauacuggccggccccaugccuguuacagcugccucagcugcacagcgccgagguagaguggggcggaacccacagaaagagaaugaccaauacaucuucaccggccagccccucaacaaugaugaagaccacgcccauuggacugaggcuaagaugcugcuugacaacauuaauacgccugaaggaaucaucccggcccuauucgagccagagagggaaaagagugcagcgauugauggcgaguaucgccugaaaggggaaagccguaagaccuuugucgaguugaugagacggggagacuuacccguguggcuggcccacaaaguagcuuccgaagguauaaaguacacagauaggaaauggugcuucgacggccagcgcaacaaucagauccucgaggagaacauggauguggaaauuuggacuaaggagggggagaagaagaagcugcgaccuagauggcuugacgcccggaccuauucugauccccuggcacucaaagaguuuaaggacuucgcugccggaaggaaaucgaucgcauuggaucugguuacagaaauuggccgcgucccaacccaccuagcccauagaacuaggaaugcucuggacaaccucgugaugcuucacacaagcgagcauggugggaaggcguaccggcacgccguggaggaacugccugagacgauggaaaccuuauugcugcucggccugaugauccuucugacuggaggcgcaaugcucuuuuugauaucagggaaaggaaucgguaagacauccauuggccugaucugugucauugcuaguucugggauguuauggauggccgagaucccccuacaauggauagccagcgcaauuguucuggaguucuuuaugauggugcuccuuaucccagaaccugagaagcagcguaccccgcaggauaaucaacuggcuuauguagugauuggaaucuugacccuggccgcgauaaucgcugccaacgaaaugggccuccuggagacaacuaaacgcgaccuugguauguccaaggaacccggggucgugucaccaacgucuuaccucgauguugaccugcacccugcaagcgccuggaccuuguacgcuguggcaacaacugucauuacccccaugcugcgacauacaaucgagaauaguaccgccaacguauccuuagcggcuauugccaaccaggcagugguucuaaugggccuggacaaaggauggccaaucagcaagauggaucucggcgugccucuucuggccuuggggugcuauucucaggucaauccccugacucucacggcugccgugcugcuuuuaauaacacacuacgcaauuaucggaccgggccugcaggcuaaagccaccagagaggcgcaaaagaggacugccgcagguaucaugaagaacccaaccgucgacgggauuaugacaaucgaucucgacccugugauauaugauucaaaauucgaaaagcaguugggacagguuaugcugcuagugcugugugcuguacagcuccuucugaugcggacuuccugggccuugugcgaggcacugacccucgcuacaggccccauuacgacccugugggaagguaguccaggcaaauuuuggaauacuacaaucgccgugagcauggccaacauuuuccgcgggucguacuuagcgggagcuggccuugcauuuucuaucaugaaguccgucgggaccggaaaaagaggcacugguagccaaggggagacacugggagaaaaguggaagaaaaagcucaaucagcuaucaaggaaagaguucgaccuguauaagaaaaguggcauaaccgagguugaucggacggaagccaaggaggguuugaaacgaggcgaaaucacccaucacgcugugucuagaggguccgccaagcugcagugguuugucgagcgcaacauggugauucccgaaggaaggguaaucgaccucggcugugggcggggaggcuggagcuacuauugcgcaggucuuaagaaagugacagagguucguggguacacuaagggaggcccuggccaugaggaaccggugcccaugucaaccuacggguggaauauugucaaacugaugaguggaaaggauguguucuauuugccaccugagaaaugugacacacugcucugcgauaucggugaaagcucccccucuccuacugucgaggagagcagaaccauuaggguguuaaagaugguugaaccauggcugaagaacaaucaguucuguaucaaaguacuuaaccccuacaugccuacagugauagagcaccuggaacgccuacaacggaagcacggcgggaugcucguccgaaauccacuguccagaaacucaacccaugagauguauuggauuucuaauggaacuggcaacaucguggccaguguuaauauggugucgagguugcugcucaaccgcuuuacgaugacacaccggagacccaccaucgaaaaagacgucgaucuuggugcugggacucgucaugugaacgcggagccggagaccccuaauauggacguaauuggagaaaggauaaagcggaucaaagaggaacacaacagcacauggcacuacgacgaugagaauccauauaagacgugggccuaccauggcuccuaugaagugaaggcaaccggcucugcuucaagcaugauuaacgggguugucaaacuguuaacuaagcccugggacguggugccuauggucacacagauggccaugaccgauacuacaccauucggacagcaacgcguuuuuaaagagaagguggacacccgaacacccagauccaugccggguacuaggcggguaaugggcaucaccgcagaguggcuguggcgcacguuggggagaaauaaaaagccuaggcucugcacccgagaagaguucacaaagaaagugcggacuaacgccgcuaugggagccgucuuuaccgaagagaaucagugggauagugcgaaggcagccguggaagacgaggauuucuggaaacugguugaccgugagagagaacuacacaaacuuggcaaaugugguucuugcguguacaacaugauggggaagcgcgagaaaaagcugggagaauuuggcaaggcuaaaggcagcagggccauuugguacauguggcucggggcacgguaucuggaguucgaggcuuugggauuucugaaugaagaucauugguucucaagagagaacuccuacaguggugucgaaggcgaggggcuccacaaacuuggauauauccugcgcgacauaagcaaaauccccggcggugccauguacgcugaugacacagccgggugggacacuaggauuaccgaagaugacuuacauaaugaggagaagaucacgcagcagauggauccagaacaccgacaacuggcaaacgcgauuuuuaaauugacauaucagaauaaggugguaaagguucagcggccuacccccacuggaacagugauggacaucauaucuagaaaagaucagaggggcuccggccaagucgggaccuacggacucaacacuuucaccaauauggaggcccagcugauucgccagauggaaggugagggcgugcuaucaaaggcugaccuugaaaacccacaucugccagagaaaaagaucacacaguggcucgagacgaaagggguggaacgucugaagcggauggccaucagcggagaugacugcgucguuaagccuauugaugacagauuugcaaacgcuuuguuagcccugaaugauaugggcaaagugaggaaggacauaccacaauggcagccgucgaaagguuggcacgauuggcagcagguacccuucuguucucaccauuuccacgagcucaucaugaaggacgggcgcaaacuuguggucccuugccgaccacaagacgaacugauuggacgggcaagaaucagucagggcgccggcuggucccuaagggagaccgcgugucuggggaaggcuuaugcccagauguggagccucauguacuuucaccgcagagauuugcggcuggcaucaaacgccauuugcuccgcugugcccguucauugggugccuacuucuaggacaaccuggagcauccacgcccaucaccaauggaugacuacagaagacaugcuuaccgucuggaaucguguguggauagaggauaacccauggauggaggacaagacgcccguaacaaccugggaaaauguuccuuaccugggaaaacgagaggaucaguggugugguagucucaucggcuuaacuucccgcgcaaccugggcucagaacauuccgacagccauccagcaagugagaagccugauugggaaugaagaguucuuggacuauaugccaucuaugaagcgguuuaggaaagaggaagagucagaaggagcgaucugguga

SEQ ID NO: 15558 - RNA, 9873 nt, Artificial Sequence
  derived and/or modified CDS sequence (opt3) from DENV-3__EU482614__SS-prME
accagccugugccucaugaugauccuuccagccgcucuggcauuccacuugacuuccagggacggcgaaccuaggaugauuguggggaagaacgaacggggaaaaucuuuacuguuuaagacugccucagguauaaauauguguacgcuaaucgcgauggaucucggcgagaugugcgacgauaccguaacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagauguucccuguaaaaucccuuucuccacagaggacggccaagguaaggcucauaacgggcgucuuauaacugcgaauccagugguaaccaaaaaggaggaacccgucaacauugaggcagaaccgccuuucggcgagucaaauaucgugaucggaauuggcgauaacgccuugaaaaucaauugguauaagaaggggagcaguauuggaaaaauguuugaagcuacagcccgcggugcaagaaggauggccauacugggcgacacugcuugggauuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgacauggguugugugaucaauuggaaagggaaggagcugaagugcggauccggcauuuucgugacuaacgagguccauacauggaccgaacaguacaaauuucaagcagauucucccaagcggcuagccacugcuaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacauuaucggcguccucgagcaggggaaaagaacccugacuccacagccuauggaguuaaaguacucauggaaaacauggggaaaggccaagauagugaccgcggaaacacaaaacaguuccuucauuaucgauggccccaauacuccagagugccccagcgccucuagggcuuggaacguuugggaaguggaggacuaugguuuuggggucuucaccacgaauauuuggcugaaacuucgggaaguguacacacaguugugugaccaccgccucaugucagcagccguuaaggaugagagagcugugcacgccgacaugggauacuggaucgagagucagaaaaacggcagcuggaagcuggaaaaagcaucccuaauagagguaaagaccugcacuuggccuaagucucauacccuguggucgaaugguguccucgaaagcgauaugaucauuccaaaaucccuggcgggcccgaucucacagcacaacuauaggcccggguaccauacacaaacugccggaccuuggcaccuuggcaaguuggagcuggacuuuaauuauugcgaggggaccacaguggugauuacggaaaacuguggaacccguggcccaaguuuacggacuacaaccgucucugguaaacucauccacgaguggugcugucgaagcugcacucugcccccucuuagauacaugggggaagauggauguugguauggcauggagauaaggccaauuuccgaaaaggaggagaauaugguuaaaucacuggugagcgcugguucuggcgaaguagacaacuucacaauggggguguugugccucgccauccuguuugaggaagucaugcgcggaaaguucggcaagaaacauaugaucgcagggguguucuuuaccuucguucuacugcucuccggacagauuacguggcgggauauggcucacacucugaucaugauuggcaguaaugccagcgacagaauggguaugggggugaccuaccuugcauugauagccacauuuaagauccagcccuuccuggcuuuaggauuuuuccucaggaaacugaccucucgcgagaaccuucugcuaggcgucggccucgcgauggccacuacacugcaauugccggaagauauugagcagauggcaaaugggaucgcucugggauuaauggcccucaagcugauuacccaguuugagacauaucagcuuuggacugcccugaucuccuugaccuguucaaacacgauauucacacucaccguggcuuggcgaacugcaacccugauccuagccgguguuagucugcuuccugugugccaaagcucguccaugcggaaaacagacuggcucccaaugacugucgcggcuaugggcguacccccucugcccuuguuuauuuucucucugaaggauaccuuaaagcguagaagcuggccacucaaugaaggggugauggccguuggacuggugucaauccuugcaaguucccuguugaggaacgacgucccuauggccggcccccucguggcuggugggcugcuaauugcauguuacguaaucacgggaacaucugccgaucugaccguggagaaagcggcugacgucacuugggaagaggaagccgagcagacaggcguuagccauaaccuuaugauaaccguggacgaugacggcacuaugcgcauuaaggaugacgagacagaaaauauccucaccgugcuguugaaaacggcauuacugaucgucuccgggauuuuuccauacucaauaccggccacucuccugguguggcacaccuggcagaagcagacacaacggagcggaguucuuugggauguaccuagucccccagagacccagaaagcugaacuggaggaggguguguauagaaucaagcagcagggcauuuucgggaaaacacaagucggagugggcguucagaaggaagguguguuucauacuauguggcacgucaccagaggggccguguugacgcacaacggaaagcgacuagagcccaauugggcaucugucaagaaggaccugaucuccuacggcggcggguggcgccucagcgcucaguggcaaaaaggagaagagguccaggugauugccguugaaccugguaagaaccccaagaauuuccagacaaugcccggcacuuuccagaccacaaccggggagaucggagcgauagcccuggauuuuaagccuggcacuucggguucaccgaucauuaaccgggaggggaagguggucggacuuuauggcaauggcgugguuaccaaaaacgggggauacgugucugguaucgcacaaacaaaugcugaaccagacggccccacgccugaguuagaagaggaaauguucaagaaaagaaaccugacuauuauggaucuccauccagggaguggaaagaccaggaaauauuugcccgccaucguccgugaggcuauaaagcgccggcugagaacacucauucuggcaccuaccagggugguagccgccgagauggaagaggcucuuaagggccugccgauccgauaccagacuacagcgaccaaauccgaacacacgggucgggagaucguggacuugaugugccaugcaacuuuuacaaugcgccuacugagccccguuagagucccaaauuauaaccucauuaucauggaugaagcccacuucaccgacccugcuucuauagccgcaaggggguacauuagcacccgggugggaaugggcgaggccgcugcgaucuuuaugacugccacacccccaggcaccgcagaugcuuucccucaguccaaugcccccauucaggacgaggaacgagacaucccagagagaucauggaacagugggaaugaauggauaacagauuuugcaggaaagacugugugguucgucccgagcauuaaagccgguaacgacaucgcuaacuguuuacgcaagaauggcaaaaagguaauccaacugucuaggaagacguuugauaccgaguaccagaaaacaaaacuuaacgacugggauuucgugguuacuaccgacauuuccgagaugggggccaauuuuaaagcggaucgugugaucgacccucggagaugccugaagcccgucauucucacagauggaccagaaagggugauauuggcaggccccaugccuguuaccgccgcuucagccgcucagcgccgagguagaguggggcggaacccacagaaagagaaugaccaauauaucuucacuggccagccccugaacaaugaugaagaccaugcacacuggacggaggccaagaugcuccuggacaacauuaauaccccugaaggaaucaucccggcucuuuucgagccagagagggaaaagagugccgcaauugauggcgaguaccgccuaaaaggggaaagccguaagacauuugucgagcugaugagacggggagacuugcccgugugguuagcgcacaaaguagccuccgaagguauaaaguauacugauaggaaauggugcuucgacggccagcgcaacaaucagauccuggaggagaacauggauguggaaauuuggaccaaggagggggagaagaagaagcuccgaccuagauggcuggacgcucggacauacucugauccccuugcccugaaagaguuuaaggacuucgcagcuggaaggaaaucgaucgcccucgauuugguuaccgaaauuggccgcgucccaagccaucuggcacacagaacuaggaaugcccuagacaaccuggugaugcuccauacaucagagcacggugggaaggcuuaucggcacgcgguggaggaacuuccugagacgauggaaacccuguuauugcugggccucaugauccugcuuacuggaggcgccaugcuguuucucauauccgggaaaggaaucgguaagacaaguauuggcuugaucugugucauugcaucuagcgggaugcuguggauggcugagauccccuuacaauggauagccuccgccauuguucuagaguucuuuaugauggugcugcucaucccagaaccugagaagcagcguaccccgcaggauaaucaacuugcauacguagugauuggaauccugaccuuggcugccauaaucgcggcuaacgaaaugggccugcucgagacaacuaaacgcgaccuggguaugucaaaggaacccggggucgugucuccaacgagcuaucuugauguugaccuccauccugccagugcauggacccuguacgccguggcuacaacugucauuacccccauguugcgacacacaaucgaaaauuccaccgcaaacguaagccuggccgcgauugcuaaccaggccgugguuuuaaugggccuagacaaaggauggccaaucucuaagauggaucugggcgugccucuccuugcacuggggugcuacucacaggucaaucccuugacucugacggccgcugugcuccugcuuauaacacauuaugccauuaucggaccgggcuuacaggcaaaagcuaccagagaggcccaaaagaggacugcggccgguaucaugaagaacccaaccgucgacgggauuaugacaaucgaucuggacccugugauauacgauuccaaauucgagaagcagcucggacagguuauguugcuggugcuaugugcaguacagcugcuccuuaugcggacaaguugggcucugugcgaggccuugacccuggcaacaggccccauuacgacccucugggaagguagcccaggcaaauuuuggaauacuacaaucgcugugucgauggccaacauuuuccgcgggucuuaucuggccggagcgggcuuagcuuuuuccaucaugaaaagcgucgggaccggaaaaagaggcacugguucacaaggggagacacuuggagaaaaguggaagaaaaagcugaaucagcucaguaggaaagaguucgaccuauacaagaaaucuggcauaaccgagguugaucggacggaagcaaaggagggucugaaacgaggcgaaaucacccaccaugccguguccagagggagcgcuaaguugcagugguuugucgagcgcaacauggugauucccgaaggaaggguaaucgaccugggcugugggcggggaggcuggucauauuacugcgccggucucaagaaagugacagagguucguggguauacuaagggaggcccuggccacgaggaaccggugcccaugaguaccuacggguggaauauugucaaacuuaugagcggaaaggauguguucuaccugccaccugagaaaugugacacauugcugugcgauaucggugaauccucucccagcccuacugucgaggaguccagaaccauuagggugcucaagaugguugaaccaugguuaaagaacaaucaguucuguaucaaaguacugaaccccuauaugccuacagugauagagcaccuugaacgccugcaacggaagcauggcgggaugcuaguccgaaauccacucucaagaaacucuacccacgagauguacuggauuaguaauggaacuggcaacaucguggcaucgguuaauauggugagcaggcuguugcugaaccgcuuuacgaugacacaucggagacccaccaucgaaaaagacgucgaucucggugccgggacucgucacgugaacgcugagccggagaccccuaauauggacguaauuggagaaaggauaaagcggaucaaagaggaacacaacuccacauggcauuaugacgaugagaauccauacaagacgugggcguaucacggcucuuacgaagugaaggccaccggcucagcaagcuccaugauuaacgggguugucaaacuucugacuaagcccugggacguggugccuauggucacacagauggcuaugaccgauacuacaccauucggacagcaacgcguuuuuaaagagaagguggacacccgaacacccagaaguaugccggguacuaggcggguaaugggcaucaccgccgagugguuauggcgcacgcuggggagaaauaaaaagccuagguugugcacccgagaagaguucacaaagaaagugcggacuaacgcagccaugggagcugucuuuaccgaagagaaucagugggauucugccaaggcggcaguggaagacgaggauuucuggaaacucguugaccgugagagagaacugcauaagcuaggcaaaugugguagcugcguguauaacaugauggggaagcgcgagaagaaacuuggagaauuuggcaaagccaaaggcucaagggcuauuugguacauguggcugggggcccgguaccucgaguucgaggcacugggauuuuugaaugaagaucacugguucuccagagagaacaguuauagcggugucgaaggcgaggggcugcauaagcucggauacauccuucgcgacauaucuaaaauccccggcggugcuauguaugccgaugacacagcugggugggacacuaggauuaccgaagaugaccugcacaaugaggagaagaucacgcagcagauggauccagaacaccgacaauuagccaacgcaauuuuuaaacugacauaccagaauaaggugguaaagguucagcggccuacccccacuggaacagugauggacaucauauccagaaaagaucagaggggcucaggccaagucgggaccuauggauugaacacuuucaccaauauggaggcgcagcucauucgccagauggaaggugagggcgugcugagcaaggccgaccuagaaaacccacaucuucccgagaaaaagaucacacaguggcuggagacgaaagggguggaacgucucaagcggauggcuaucucgggagaugacugcgucguuaagccuauugaugacagauuugccaacgcacuguuggcuuuaaaugauaugggcaaagugaggaaggacauaccacaauggcagccgucuaaagguuggcacgauuggcagcagguacccuucuguagucaucacuuccacgagcugaucaugaaggacgggcgcaaacucguggucccuugccgaccacaagacgaacuuauuggacgggccagaaucucccagggcgcaggcuggagccugagggagaccgccugucuagggaaggcguacgcucagauguggucacugauguauuuucaucgcagagaucuccgguuggccuccaacgcaauuugcucugccgugcccguucacugggugccuacuagcaggacaaccuggaguauccaugcucaccaucaauggaugacuacagaagacaugcugaccgucuggaaucguguguggauagaggauaacccauggauggaggacaagacgcccguaacaaccugggaaaauguuccuuaccuuggaaaacgagaggaucaguggugugguucccugaucggccucacuagccgcgccaccugggcacagaacauuccgacagcuauccagcaagugagaucuuuaauugggaaugaagaguuccuggacuacaugccaucaaugaagcgguuuaggaaagaggaagagagugaaggagccaucugguga

SEQ ID NO: 15559 - RNA, 9873 nt, Artificial Sequence
  derived and/or modified CDS sequence (opt3) from DENV-3__EU569690__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacgugguccaggaaagagcuucugguaaccuuuaagaaugcacacgcuaaaaagcaagaaguuguggucuugggcucacaggagggagccaugcacacugcucucacaggcgccaccgaaauucagaacagugggggaacaagcauauucgcaggucaucugaagugucgguuaaaaauggacaagcuggagcuaaaaggcaugucuuacgccaugugcacuaauaccuuugugcucaagaaagaggucuccgaaacgcagcacgggaccauccugauuaagguggaguacaagggagaagauguucccuguaaaaucccuuucucaacagaggacgagcaaggcaaggcucauaacggucgucuuauaacugcgaacccagugguaaccaaaaaggaagagcccgucaauauugaagcagagccgccuuucggggaaagcaacaucgugaucggcauuggagauaaugccuugaaaaucaacugguauaagaagggcaguucuauugggaaaauguuugaggcuacagcccgcggagcaagaaggauggccauacugggugacacugcuugggauuucggcuccguugggggagugcucaauagccugggcaagaugguccaccagaucuuugguucggccuacaccgcacuuuucucugggguguccuggguaaugaaaauuggcaucggagugcuguugacguggaucggccucaacucaaagaauacaaguaugagcuuuuccugcauugcgauagggaucauuacccuguauuuaggagcuguuguccaggccgacaugggcugugugaucaacuggaaagguaaggagcugaagugcgggucuggaauuuucgugacuaaugaaguccauacauggaccgagcaguacaaauuucaagcagauagccccaagcggcuagccacugcuaucgccggcgcaugggaaaacgguguuuguggcauacgaucaaccacacgcauggagaaucuccuguggaaacagaucgcuaacgaacuuaauuauauuuugugggagaacaauaucaagcugacgguggugguaggggacauuaucggaguccucgagcagggcaaaagaacccugauaccacagccuauggaauuaaaguacaguuggaaaacuugggggaaggccaagauugugacagcggagacccaaaacuccagcuucaucauugauggacccaacacaccagaaugccccucugccucaagggcuuggaauguuugggagguggaagacuauggcuuuggugucuucacuaccaacaucuggcugaaacuucgggagguguacacgcaguugugugaccaccgccucaugagugcagccguuaaggaugagagagcugugcacgccgacaugggguacuggauagaaagccagaaaaauggauccuggaagcuggagaaagcaucucuaaucgaaguaaagacaugcaccuggccuaagucgcauacucuguggagcaacggcguccucgaguccgauaugauuaucccaaaaucacuggcggguccgauuagucagcacaauuauaggcccggcuaccauacccaaacagccgggccuuggcaccuuggaaaguuggagcuggacuuuaacuauugcgaaggcacuaccguggugaucacagagaauugugggacgcguggaccaucuuuacggaccacuacagucagcggcaaacucauacacgaauggugcugucgauccugcacccugcccccucuuagauacaugggugaggauggguguugguauggaauggaaauuaggccaaucucagagaaggaggaaaacaugguuaaaagccuggugucugcuggcuccggugagguagacaauuucacuaugggcguguugugccucgccauccuguuugaagaggucaugcgcgggaaguucggaaagaaacauaugauugcaggcguguucuuuacauucguucuacugcucagugggcagaucaccuggcgggauauggcucacacgcugauuaugauaggaagcaacgccucugacagaaugggcaugggugugacuuaccuugcauugaucgccaccuuuaagauucagcccuuccuggcuuuaggguuuuuccucaggaaacugacaucccgcgaaaaucuucugcuaggagucggccucgcgauggccaccacucugcaauugccggaggauaucgagcagauggcaaacggcauugcucugggguuaauggcccucaagcugaucacacaguuugaaaccuaucagcuuuggacagcccugauaucauugacuuguaguaauaccaucuucacgcucacaguggcuuggcgaaccgcaacucugauucuagccggaguuagccugcuuccugugugccaaucguccucuaugcggaaaaccgacuggcucccaaugacagucgcggcuauggguguacccccucugcccuuguuuaucuucagccugaaggauacuuuaaagcguagaucauggccacucaacgagggcgugauggccguugggcuggugaguauucuugcauccucucuguugaggaaugacgucccuauggccggaccccucguggcuggcggucugcuaaucgcauguuacguaauaaccgggacgagcgccgaucugacaguggaaaaagcggcugacgucaccugggaggaagaggccgagcagacuggaguuucccauaaccuuaugauuacaguggacgaugacggcaccaugcgcaucaaggaugacgaaacugagaacauccucacagugcuguugaaaaccgcauuacugauugucucaggcauauuuccauacagcaucccggccacgcuccugguguggcacacuuggcagaagcagacccaacggagugggguucuuugggauguaccuucucccccagaaacacagaaagcugagcuggaggaaggaguguauagaauuaagcagcaggguaucuucggcaaaacccaagucggggugggaguucagaaggagggcguguuucauacaauguggcacgucacuaggggugccguguugaccuacaaugggaagcgacuagaacccaacugggcauccguaaaaaaggaccugauuagcuauggaggcggcuggcgccucucggcucaguggcaaaaaggggaggaaguccaggugaucgccguugagccuggaaagaauccaaaaaacuuccagacgaugcccgguacauuccagacuaccacaggcgagauaggggcgaucgcccuggauuuuaagccuggaaccucaggcucuccgauuaucaaucgggaagguaagguggucgggcuuuacggaaacggcgugguuacuaaaaauggcggguaugugaguggaauugcacaaaccaacgcugagccagacggucccacaccugaauuagaggaagagauguucaagaaaagaaaucugacgaucauggaucuccacccaggcuccgggaagacuaggaaauacuugcccgccauaguccgugaggcuauuaagcgccggcugagaacccucauccuggcaccuacaagggugguagccgccgaaauggaggaagcucuuaagggacugccgauccgauaucagaccacugcgacaaaaagcgagcauaccggccgggaaauuguggacuugaugugccacgcaacguuuacuaugcgccuacugucucccguuagagucccaaacuacaaucucaucauaauggaugaggcccauuucacagacccugcuagcauugccgcaagggguuacaucuccacccggguggggaugggagaggccgcugcgauuuuuaugaccgccacucccccaggcacagcagaugcuuucccucagucaaacgcccccauccaggacgaagagcgagacauaccagaaagaaguuggaauagcggcaacgaguggauuaccgauuuugcagggaagacagugugguucgucccgucuaucaaagccggaaaugacaucgcuaacuguuuacgcaagaacgguaaaaagguaauucaacuguccaggaagacuuuugauacggaguaucagaaaaccaagcuuaaugacugggauuucgugguuacaacugacaucucagaaaugggcgccaacuuuaaagcggaucgugugauugacccucggagaugccugaagcccgucauacucaccgaugggccagagagggugaucuuggcaggacccaugccuguuacagccgcuagugccgcucagcgccgaggcagagugggucggaauccacagaaagaaaacgaccaauacauuuucaccgggcagccccugaauaacgaugaggaccacgcacauuggacugaagccaagaugcuccuggacaauaucaacacgccugagggcaucauuccggcucuuuucgagccagaaagggagaagagcgccgcaauagauggagaauaucgccuaaaaggcgagucccguaagaccuuugucgaacugaugagacggggggacuugcccgugugguuagcgcacaaaguagccucugagggaaucaaguacacagauaggaaauggugcuucgacggucagcgcaauaaccagauucuggaggaaaauauggauguggagaucuggacuaaggaaggcgagaaaaagaagcuccgaccuagauggcuggacgcucggaccuauucggauccccuugcccugaaagaauuuaaggacuucgcagcugggaggaaaagcauugcccucgauuugguuacagagaucggacgcgucccaacccaccuggcacauagaacuaggaacgcccuagacaaucuggugaugcuccacacaucagagcauggcgguaaggcuuaccggcacgcgguggaagagcuuccugaaacgauggagacccuguuauugcuggggcucaugauacugcuuacuggcggagccaugcuguuucucaucuccggcaaagggauuggaaagacaaguaucgguuugauuugugucaucgcaucuagcggcaugcuguggauggcugagauacccuuacaauggauugccuccgccaucguucuagaauucuuuaugauggugcugcucauuccagagccugaaaagcagcguaccccgcaggauaaccaacuugcauauguagugaucgggauacugaccuuggcugccaucauugcggcuaaugagaugggacugcucgaaacaacuaaacgcgaccugggcaugucaaaggagcccggugucgugucuccaacgagcuaccuugauguugaccuccacccugccagugcauggacccuguacgccguggcuacaacugucaucacccccauguugcgacauacaauugagaacuccaccgcaaauguaagccuggccgcgaucgcuaaccaggccgugguuuuaauggggcuagacaaaggcuggccaauaucuaagauggaucugggagugccucuccuugcacugggcugcuauucacaggucaaccccuugacucugacggccgcugugcuccugcuuauuacacacuacgccaucaucgggccgggauuacaggcaaaagcuaccagagaagcccaaaagaggacugcggccggcauuaugaagaauccaaccgucgacgguaucaugacaauagaucuggacccugugauuuaugauuccaaauucgagaagcagcucgggcagguuauguugcuggugcuaugugcaguacagcugcuccuuaugcggacuaguugggcucugugcgaagccuugacccuggcaacaggacccaucacgacccucugggagggcagcccagguaaauuuuggaacacuacaauugcugugucgauggccaauaucuuccgcggcucuuaccuggccggggcgggauuagcuuuuuccauaaugaagagcgucggcaccgggaaaagaggaacuggcucacaaggugaaacacuuggggagaaguggaagaaaaagcugaaccagcucaguaggaaagaguucgaccuauauaagaaaucuggaaucaccgaaguugaucggacggaggcaaaggaaggccugaaacgaggugagauuacccaucacgccguguccagaggcagcgcuaaguugcagugguuugucgaacgcaauauggugauccccgaggggaggguaauugaccugggauguggccgggggggauggucauacuauugcgccggccucaagaaagugacagagguucgugguuacacuaaggggggaccuggccaugaagagccggugcccaugaguaccuacggcuggaacaucgucaaacuuaugagcgggaaggauguguucuaucugccaccugaaaaaugugacacauugcugugcgauauuggagaguccucucccagcccuacugucgaggaauccagaaccaucagggugcucaagaugguugagccaugguuaaagaauaaccaguucuguauaaaaguacugaaucccuacaugccuacagugauugaacaccuugagcgccugcaacggaagcacgguggcaugcuaguccgaaacccacucucaagaaauucuacccaugaaauguauuggaucaguaacgggacuggaaauaucguggcaucgguuaacauggugagcaggcuguugcugaaucgcuuuacgaugacacaccggagacccaccauugagaaagacgucgaucucggcgccgguacucgucaugugaacgcugagccggaaaccccuaacauggacguaauaggggagaggaucaagcggauuaaagaagagcacaauuccacauggcacuacgacgaugaaaacccauauaagacgugggcguaccauggaucuuaugaggugaaggccaccggcucagcaagcuccaugaucaauggcguugucaaacuucugacuaagcccugggacguggugccuauggucacacagauggcuaugaccgauacuacaccauucgggcagcaacgcguuuuuaaagagaagguggacacccgaacacccagaaguaugccgggaacuaggcggguaauggguauuaccgccgaaugguuauggcgcacgcugggcagaaacaaaaagccuagguugugcacccgagaggaauucacaaagaaagugcggacuaaugcagccaugggggcugucuuuaccgaggaaaaccagugggauucugccaaggcggcaguggaggacgaggauuucuggaaacucguugaccgugaaagagagcugcacaagcuaggaaaauguggcagcugcguguacaauaugauggguaagcgcgaaaaaaagcuuggggaguuuggaaaggccaaaggcucaagggcuaucugguacauguggcugggcgcccgguaucucgaguucgaagcacugggguuuuugaacgaggaucauugguucuccagagaaaauaguuacagcggagucgagggugaaggccugcacaagcucggguauauacuucgcgacaucucuaaaauucccggaggcgcuauguacgccgaugacacagcugguugggacacuaggaucaccgaggaugaccugcauaacgaggaaaagauuacgcagcagauggauccagagcaccgacaauuagccaaugcaaucuuuaaacugacauaucagaacaaggugguaaagguucagcggccuacccccacugggacagugauggacauaauuuccagaaaagaucagaggggaucaggccaagucggcaccuacggguugaauacuuucaccaacauggaagcgcagcucauccgccagauggagggagaaggugugcugagcaaggccgaccuagagaauccacaccuucccgagaaaaagaucacacaguggcuggaaacgaaaggcguggagcgucucaagcggauggcuauuucgggggaugacugcgucguuaagccuauagaugacagauuugccaacgcacuguuggcuuuaaacgauaugggaaaagugaggaaggacaucccacaauggcagccgucuaaaggcuggcaugauuggcagcagguacccuucuguagucaccauuuccacgaacugauuaugaaggacggucgcaaacucguggucccuugccgaccacaagacgagcuuaucgggcgggccagaauuucccagggagcaggcuggagccugagggaaaccgccugucuaggcaaggcguaugcucagauguggucacugauguacuuucaccgcagagaucuccgguuggccuccaaugcaaucugcucugccgugcccguucauugggugccuacuagcaggacaaccuggaguauacacgcucaucaccaauggaugacuacagaggacaugcugaccgucuggaaccguguguggaucgaggauaauccauggauggaagacaagacgcccguaacaaccugggagaacguuccuuaccuugggaaacgagaagaucagugguguggaucccugauuggucucacuagccgcgccaccugggcacagaauaucccgacagcuauucagcaagugagaucuuuaaucggcaacgaggaguuccuggacuauaugccaucaaugaagcgguuuaggaaagaagaggaaagugagggggccauuugguga

SEQ ID NO: 15560 - RNA, 9873 nt, Artificial Sequence
  derived and/or modified CDS sequence (opt3) from DENV-3__EU569691__SS-prME
accagccugugccucaugaugauccuucccgccgcucuggcauuccacuugacauccagagacggcgagccuaggaugauuguggggaagaacgaacggggaaaaucuuuacuguuuaagacugccucagguacgaauauguguacccuaauagcgauggaucucggcgagaugugcgacgauacagucacuuacaaauguccacauaucaccgaaguugagccggaagacauugauugcugguguaaccugacaaguaccugggugacuuaugggacaugcaaucaggcuggagagcaccgccgagacaagcguagcguagcccuugcaccccaugugggcaugggucuggauaccagaacgcaaacuuggauguccgccgagggggcuuggaggcaggucgaaaaaguggagaccugggcauugcggcacccuggauucacaauccucgcccuguuucuggcucauuacauuggcacuucucucacccagaagguugugaucuucauauuacugaugcuugucacaccaucgaugaccaugcgcugugugggcguagggaacagagacuuuguugaaggauugucaggugccacguggguggaugucgugcuggagcacggcgggugcgugacuacaauggcgaagaauaaacccacccuagacaucgagcuccagaagacugaagcaacacaacuggccacccuuaggaaacuguguauugagggaaagaucacgaacauuaccacagauagccggugcccuacucagggcgaagcugucuugccagaggaacaggaccagaauuauguuuguaaacacaccuacguggaucgcgguugggggaacggaugcggccucuucggcaaggggagucugguaacaugcgccaaguuucaauguuuagagcccaucgagggaaaagugguccaguaugaaaaucugaaguacacugugauaauuaccguucauacaggugaccagcaccaggugggcaacgagacccaaggggucacugcagaaaucacgccucaggcuuccacaaccgaggccauucucccagaauauggaacucuuggccuggagugcucuccgcgaaccgguuuggacuucaaugagaugauccuacugacaaugaaaaacaaggcguggauggugcauagacagugguuuuucgaucucccccugccuuggaccagcggggccacuacagaaacgccaaccuggaauaggaaagagcuucugguaacuuuuaagaacgcacacgcuaaaaagcaagaaguuguggucuugggcucccaggagggagccaugcacacagcucucaccggcgccacagaaauccagaauucagggggaacuaguauuuucgcaggucaucugaagugucgguuaaaaauggacaagcuggagcuaaaaggcaugagcuacgccaugugcaccaacacguuugugcucaagaaagaggucucugaaacccagcacgggacaauacugaucaagguggaguacaagggagaagauguucccuguaaaauuccuuucuccacugaggacggccaagguaaggcucauaacgggcgucuuaucaccgcgaauccagugguaacaaaaaaggaggaacccgucaacauagaggcagaaccgccuuucggcgagucaaauauugugaucggaaucggcgauaacgccuugaaaauuaauugguauaagaaggggagcaguaucggaaaaauguuugaagcuacugcccgcggugcaagaaggauggccauucugggcgacaccgcuugggauuucgggucuguuggaggcgugcucaacucccuggguaagaugguccaccagauauuugggagcgccuacacggcacuuuucucgggcgugucuuggguaaugaaaaucggaauuggcgugcuguugacauggaucgggcucaauuccaagaacaccucaaugaguuuuagcugcaucgcgauuggaauaaucacucuguauuuaggcgcuguuguccaggccgacauggguugugugauuaauuggaaagggaaggagcugaagugcggauccggcaucuucgugacaaacgagguccauaccuggacugaacaguacaaauuucaagcagauucucccaagcggcuagccaccgcuauugccggugcaugggagaauggcguuugugggauccgaagcacaacgcgcauggaaaaccuccuguggaaacagauagcuaaugagcuuaacuauaucuugugggaaaauaacauuaagcugaccguggugguaggagacaucauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccaguugugugaccaccgccucaugucagcagccguuaaggaugagagagcugugcacgccgacaugggauacuggauugagagucagaaaaacggcagcuggaagcuggaaaaagcaucccuaaucgagguaaagacuugcaccuggccuaagucucauacacuguggucgaaugguguccucgaaagcgauaugauaaucccaaaaucccuggcgggcccgauuucacagcacaacuauaggcccggguaccauacucaaaccgccggaccuuggcaccuuggcaaguuggagcuggacuuuaauuauugcgaggggacaacgguggugaucaccgaaaacuguggaacucguggcccaaguuuacggacaaccacugucucugguaaacucauucacgaguggugcugucgaagcugcacacugcccccucuuagauacaugggggaagauggauguugguauggcauggagaucaggccaauauccgaaaaggaggagaauaugguuaaaucacuggugagcgcugguucuggcgaaguagacaacuucaccauggggguguugugccucgccauucuguuugaggaagucaugcgcggaaaguucggcaagaaacauaugaucgcagggguguucuuuacguucguucuacugcucuccggacagaucacuuggcgggauauggcucacacccugauuaugaucggcaguaaugccagcgacagaauggguaugggggugacauaccuugcauugauugccaccuuuaagauacagcccuuccuggcuuuaggauuuuuccucaggaaacugacuucucgcgagaaccuucugcuaggcgucggccucgcgauggccacaacccugcaauugccggaagauaucgagcagauggcaaaugggauugcucugggauuaauggcccucaagcugaucacacaguuugagacuuaucagcuuuggaccgcccugauuuccuugacguguucaaacacaaucuucacccucacuguggcuuggcgaaccgcaacacugauacuagccgguguuagucugcuuccugugugccaaagcucguccaugcggaaaacugacuggcucccaaugaccgucgcggcuaugggcguacccccucugcccuuguuuaucuucacgcugaaggauacauuaaagcguagaucuuggccacucaaugaaggggugauggccguuggacuggugagcauucuugcaucaagucuguugaggaacgacgucccuauggccggcccccucguggcuggugggcugcuaaucgcauguuacguaauuaccggaacuuccgccgaucugacaguggagaaagcggcugacgucaccugggaagaggaagccgagcagacuggcguuucucauaaccuuaugaucacaguggacgaugacggcaccaugcgcauaaaggaugacgagacggaaaauauucucacugugcuguugaaaaccgcauuacugaucgucagcgggaucuuuccauacuccauuccggccacacuccugguguggcacaccuggcagaagcagacacaacggucaggaguucuuugggauguaccuagccccccagagacucagaaagcugaacuggaggaggguguguauagaauaaagcagcagggcaucuucgggaaaacccaagucggagugggcguucagaaggaagguguguuucauacgauguggcacgucacaaggggggccguguugacucacaacggaaagcgacuagagcccaauugggcaaguguaaaaaaggaccugauuucuuacggcggcggguggcgccucuccgcucaguggcaaaaaggagaagagguccaggugaucgccguugaaccugguaagaacccaaaaaauuuccagaccaugcccggcacauuccagaccacuaccggggagauuggagcgaucgcccuggauuuuaagccuggcacaagcgguucgccgauaaucaaccgggaggggaagguggucggacuuuauggcaauggcgugguuacgaaaaacgggggauacgugucagguauugcacaaacuaaugcugaaccagacggccccaccccugaguuagaagaggaaauguucaagaaaagaaaccugacaaucauggaucuccauccagggucuggaaagaccaggaaauauuugcccgccauuguccgugaggcuaucaagcgccggcugagaacucucauacuggcaccuacaagggugguagccgccgagauggaagaggcucuuaagggccugccgauucgauaccagaccacggcgacuaaaagugaacacacaggucgggagaucguggacuugaugugccaugcaaccuuuaccaugcgccuacugucccccguuagagucccaaauuauaaccucaucauuauggaugaagcccacuucacugacccugcuagcaucgccgcaaggggguacauaucuacacgggugggaaugggcgaggccgcugcgauuuuuaugaccgccacacccccaggcacugcagaugcuuucccucagagcaaugcccccauccaggacgaggaacgagacauuccagagagauccuggaacucagggaaugaauggaucacggauuuugcaggaaagaccgugugguucgucccgaguauaaaagccgguaacgacauugcuaacuguuuacgcaagaauggcaaaaagguaauccaacugagcaggaagacauuugauacugaguaccagaaaaccaagcuuaacgacugggauuucgugguuacaaccgacaucucugagaugggggccaauuuuaaagcggaucgugugauugacccucggagaugccugaagcccgucauccucacugauggaccagaaagggugauuuuggcaggccccaugccuguuacggccgcuuccgccgcucagcgccgagguagaguggggcggaacccacagaaagagaaugaccaauauauauucaccggccagccccugaacaaugaugaagaccaugcacacuggacagaggccaagaugcuccuggacaacaucaauacuccugaaggaauuaucccggcucuuuucgagccagagagggaaaagucagccgcaaucgauggcgaguaccgccuaaaaggggaaagucguaagaccuuugucgagcugaugagacggggagacuugcccgugugguuagcgcacaaaguagccagcgaagguauuaaguauacagauaggaaauggugcuucgacggccagcgcaacaaucagauacuggaggagaacauggauguggaaaucuggaccaaggagggggaaaaaaagaagcuccgaccuagauggcuggacgcucggacuuacuccgauccccuugcccugaaagaguuuaaggacuucgcagcuggaaggaaaucuauugcccucgauuugguuacagaaaucggccgcgucccaacgcaucuggcacacagaaccaggaaugcccuagacaaccuggugaugcuccauacuucggagcacggugggaaggcuuaucggcacgcgguggaggaacuuccugagacaauggaaacccuguuauugcugggccucaugauucugcuuaccggaggcgccaugcuguuucucaucagcgggaaaggaauagguaagacaucaaucggcuugauuugugucaucgcauccagugggaugcuguggauggcugagauucccuuacaauggaucgccucugccauaguucuagaguucuuuaugauggugcugcucauuccagaaccugagaagcagcguacuccgcaggauaaucaacuugcauacguagugaucggaauucugacguuggcugccaucauagcggcuaacgaaaugggccugcucgagaccacaaaacgcgaccuggguaugagcaaggaacccggggucguguccccaacuucauaucuugauguugaccuccauccugccucugcauggacccuguacgccguggcuacaaccgucaucacucccauguugcgacacacgauugagaauagcacagcaaacguaagucuggccgcgaucgcuaaccaggccgugguuuuaaugggccuagacaaaggauggccaauuuccaagauggaucugggcgugccucuccuugcacuggggugcuacagccaggucaaucccuugacccugacugccgcugugcuccugcuuaucacccauuaugccauaauuggaccgggcuuacaggcaaaagcuacaagagaggcccaaaagaggacugcggccgguaucaugaagaacccaaccgucgacgggaucaugacaauugaucuggacccugugaucuacgauucuaaauucgaaaagcagcucggacagguuauguugcuggugcuaugugcaguacagcugcuccuuaugcggacgucaugggcucugugcgaggccuugacccuggcaacuggccccauaacaacccucugggaagguuccccaggcaaauuuuggaauacuacaauugcugugaguauggccaacaucuuccgcgggagcuaucuggccggagcgggcuuagcuuuuucgauuaugaagucugucgggaccggaaaaagaggcacggguucccaaggggagacccuuggagaaaaguggaagaaaaagcugaaucagcucagcaggaaagaguucgaccuauacaagaaaucaggcaucacagagguugaucggacugaagcaaaggagggucugaaacgaggcgaaauaacccaccaugccgugaguagagggucugcuaaguugcagugguuugucgagcgcaacauggugauccccgaaggaaggguaauugaccugggcugugggcggggaggcugguccuauuacugcgccggucucaagaaagugacagagguucguggguauacuaagggaggcccuggccacgaggaaccggugcccaugagcaccuacggguggaauaucgucaaacuuaugucaggaaaggauguguucuaccugccaccugagaaaugugacacauugcugugcgauauuggugaaaguagccccuccccuaccgucgaggagucuagaacuaucagggugcucaagaugguugaaccaugguuaaagaacaaucaguucuguauuaaaguacugaaccccuauaugccuacggugaucgagcaccuugaacgccugcaacggaagcauggcgggaugcuaguccgaaauccacucagcagaaacuccacacacgagauguacuggauaucaaauggaaccggcaacauuguggcaucuguuaauauggugaguaggcuguugcugaaccgcuuuacuaugacccaucggagacccacaaucgaaaaagacgucgaucucggugccgggacgcgucacgugaacgcugagccggagaccccuaauauggacguaaucggagaaaggauuaagcggauaaaagaggaacacaacucgacuuggcauuaugacgaugagaauccauaccgcacaugggcguaucacggcagcuacgaagugaaggccaccggcuccgcaucuucaaugaucaacgggguugucaagcuucugacuaaacccugggacguggugccuauggucacacagauggcuaugaccgauacaacuccauucggacagcaacgaguuuuuaaggagaaaguggacaccagaacgcccaggagcaugccggguacccggcgcguaaugggcauuacagccgagugguuauggagaacucuggggaggaauaagaaaccucgauugugcacccgggaagaguucacaaagaaggugcguacuaacgcagccaugggagcugucuuuaccgaagagaaucagugggauuccgccaaagcggcaguggaagacgaggauuucuggaagcucguugacagagagcgcgaacugcauaaacuaggcaagugugguaguugcguguauaacaugauggggaaaagggagaagaaacuuggagaauuuggcaaggccaagggcucucgggcuaucugguacauguggcugggggccagauaccucgaguucgaggcacugggauuuuugaaugaagaucacugguucagccgcgagaacucauauuccggugucgaaggcgaggggcugcauaaacucggauacauucuuagggacaucaguaagauacccggcggugcuauguaugccgaugacacggcugggugggacacacgaaucaccgaagaugaccugcacaaugaggagaaaauuacucagcagauggauccagaacaccggcaauuagccaacgcaaucuuuaagcugacauaccagaauaaagugguaaagguucagagaccuacccccacuggaaccgugauggacauuaucagcaggaaggaucagcgcggcucuggccaagucgggacauauggauugaacacguucaccaauauggaggcgcagcucauacgucagauggaaggugagggcgugcuguccaaagccgaccuagaaaacccacaucuucccgagaagaaaauuacucaguggcuggagacaaaggggguggaacggcucaaaagaauggcuaucucaggagaugacugcgucguuaagccuaucgaugacagguuugccaacgcacuguuggcuuuaaaugauaugggcaaggugcgcaaagacauuccacaauggcagccgagcaaggguuggcacgauuggcagcagguacccuucuguucgcaucacuuccacgagcugauaaugaaagacgggcgaaagcucguggucccuugccggccacaagacgaacuuaucggaagagccaggauuucucagggcgcaggcuggagucugcgcgagaccgccugucuagggaaagcguacgcucagauguggucccugauguauuuucauagacgggaucucagguuggccagcaacgcaaucugcucagccgugcccguucacugggugccuacuucccguacaaccuggucuauucaugcucaccaucaauggaugacgacagaagacaugcugaccgucuggaaucgaguguggaucgaggauaacccauggauggaggacaagacucccguaaccacaugggaaaauguuccuuaccuuggaaagcgcgaggaucaguggugugguagccugauaggccucacuaguagagccaccugggcacagaacaucccgacagcuauucagcaagugcgguccuuaaucgggaaugaagaguuccuggacuacaugccaagcaugaaaagguuucgcaaggaggaagagucugaaggagccauuugguga

SEQ ID NO: 15561 - RNA, 9873 nt, Artificial Sequence
  derived and/or modified CDS sequence (opt3) from DENV-3__EU482452__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccuggacacauuugugcuuaagaaagagguuucugagacucagcaugggaccauauugaucaagguggaauacaagggagaggaugcccccuguaaaauuccuuucuccacggaagacggccaagguaaggcucacaacgggcgucugaucaccgcgaacccaguagucacaaaaaaggaggagcccgugaauauagaagcagagccgccuuucggcgaaucaaacauuguuaucggaaucggcgauaaagcccucaagauuaauugguauaagaaagggagcaguaucggaaagauguuugaggcuacugcccgcggugcaagaaggauggccauucugggcgacaccgcuugggauuucgggucugugggaggcguccuuaacucccuggguaaaauggugcaucagauauuugggagcgccuacacagcauuguucucgggcguaucuuggaucaugaagauuggaaucggcgugcuccugacuuggaucggguuaaauuccaaaaacaccucaaugaguuuuagcugcauuguuauaggaaucauuacgcuguaucuaggcgcggucgugcaggcugacauggguugugugaucaauuggaaggggaaggaacucaaaugcggauccggcauuuucgucacaaacgagguucacaccuggacugagcaguacaaguuucaagccgauucucccaaacggcuggcaacagccaucgcuggugccugggaaaauggcgugugugggauacgaagcaccacucgcauggagaaccuuuuguggaagcagaucgcaaaugaacugaacuauauucucugggagaauaacaucaaacugaccgugguagucggagacgugauuggcguuuuagaacaggggaagagaacacugacgccacagccuauggagcuuaaauacucauggaagaccuggggaaaggcuaaaaucgugacugccgagacacaaaauaguuccuucauaauugacggcuugaacacccccgaaugcccaagcgcgucuagggccuggaacgucugggagguggaagauuaugguuuugggguuuucacaacuaauaucuggcucaagcugcgggagguguacacccagucaugugaccaucgccuaaugagugcugcaauuaaagaugaaagagccguacacgcugacaugggauacuggaucgagagccagaagaacggcuccuggaaacuggagaaggccucuuuuauagaagucaagacgugcacauggcccaaaucgcacacccucuggagcaauggugugcuggaguccgauaugaucauuccuaagucacuugcaggcccaaucagucagcauaaccacaggccgggguaucauacucaaaccgcgggacccuggcacuugggcaaacuggaauuagacuucaauuacugcgaggggacaacuguggucauuaccgagaacuguggaacacguggcccuucucuccggacgaccacuguuagcgguaagcugauccacgaauggugcugucgauccugcacacuuccaccccugagauauaugggggaggauggauguugguacggcauggaaauaaggccuauuaaugagaaagaagagaacauggugaagucauugguaagcgccgguucuggcaagguggacaauuuuaccauggggguccucugccuggcuauccuauucgaggaagugaugcgcggaaaauucggcaagaaacauaugaucgccgggguucuguuuacuuucgugcuccugcuuuccggacagauuacauggcgggauauggcacacaccuugaucaugauuggcaguaacgcuagcgacagaauggguaugggggucacguaucuggccuuaauagcaacuuuuaagauccagccauuccucgcccugggauuuuuccuuaggaaacugaccucucgcgagaaucuacuccugggcgugggcuuggcuauggcgacaacccugcaauuacccgaagauauugagcagauggccaacgggaucgcacucggacugaugacucuuaagcugauuacacaguuugaaaccuaccaguuguggacagcucucguuucccugacuuguucaaauaccaucuucacgcuaacaguggccuggcgaaccgccacucugauacuugcuggugucagucuccugccguugugccaaagcucguccaugcggaagaccgacuggcugccuaugacaguagcagccaugggcgugucuccauuaccccucuuuaucuucagccugaaagauacuccuaagcguagaucauggccccuuaacgaggggguuauggcggugggacuggucaguauuuuggcuuccucucuccugaggaaugacgugccaauggccggcccucuaguagcaggugggcugcuuaucgccuguuaugugauuaccggaacgagcgcugaccucacagucgagaaagcagccgauguuaccugggaagaggaagcggagcagacuggcgugucccauaaccugaugaucacaguggacgaugacggcaccaugcgcauaaaggaugacgaaacugagaacauuuugacagucuuacugaaaaccgcucuccugaucgugucagggaucuuucccuacagcauuccagccacgcuucugguuuggcacacuuggcagaagcagacccaacggaguggaguauugugggaugugccgucuccucccgagacacagaaagcagaacuagaggaaggugucuacagaauaaagcagcagggcaucuucgggaagacccaagugggaguuggcgugcagaaagagggugucuuucauacaauguggcacgugacuaggggggccguacugacccacaauggaaagcgacucgagccaaacugggcuuccgucaaaaaggaccugauuagcuauggcggcggguggcgccuuucggcccaguggcaaaaaggagaagaggugcagguuaucgcaguggaacccgguaagaauccuaagaacuuccagacgaugccaggcauuuuccagacaacuaccggggagaucggagcuauagccuuagauuuuaaacccggcacaucagguucuccuaucauuaaucgggaagggaaggucgugggacuguacggcaacggcguugugaccaaaaaugggggauaugucagugguaucgcgcaaacuaacgccgagccggacggcccaacccccgagcucgaagaggaaauguucaagaaaagaaauuugacaauuauggaucugcauccuggguccggaaagacgaggaaguaccucccagcaaucgugcgugaggcuauaaaacgccggcugagaacucuuauucuggcccccaccaggguaguggcugcagaaauggaggaggccuugaagggccuaccuauccgauaucagacaaccgccacuaaaagcgaacacacaggucgggagaucguugaccugaugugccaugcuaccuuuacgaugcgccucuuaucuccggucagagugcccaacuacaaucugauuaucauggaugaagcgcacuucacugacccagcaagcauagccgcuaggggguauauuuccacacgggugggaaugggcgaggccgcagccaucuuuaugaccgcuaccccucccggcacugcggaagccuucccacagucaaacgcaccuauucaggacgaggagcgagauauccccgaaagaaguuggaauagcgggaacgaguggauaacagacuuugucggaaagaccguaugguucgugccaucuauuaaagcugguaaugauaucgccaacugucuucgcaagaacggcaagaaaguuauccaacuguccaggaagacauuugacacugaauaccagaaaacgcgucucaaugauugggacuucguggucaccacagauauuucagagaugggggcaaacuuuaaggccgaccgggugaucgauccgagaaggugcuugaaaccuguuauucugacugacggacccgagcgcgugauacucgcuggcccaaugcccgucaccgccgcgagugcagcccagcgaagaggucggguggggaggaauccucagaaggaaaacgaucaauacaucuucacaggccagccacugaauaacgacgaggaccaugcucacuggaccgaagccaagaugcuucuagauaauauuaacacucccgagggaaucaucccugcucuguucgaaccggagcgcgagaaaagcgcagccauugacggcgaauaucguuugaagggggaguccagaaaaacguuuguagaauuaaugcggaggggagaucugccaguguggcucgcucacaagguugccucugaggguauaaaauacaccgaccgcaaguggugcuucgauggcgaacgaaauaaccagauccuggaggagaauauggacgucgaaauuuggacaaaagagggggaaagaaagaagcuucggcccagguggcuggaugcacgcacuuauucggacccucucgcguugaaagaguuuaaggauuucgccgcuggaagaaaaagcaucgcccuggaccuagugaccgaaauuggcagggugcccucacaucuggcauaccggacacguaacgcucucgauaaucuugucaugcugcacaccuccgagcauggugggcgcgccuaucgacacgcaguugaggaauuaccagagacuauggaaacauugcugcuccugggccuuaugauccugcucacgggaggcgccauguuguuucugauaagugggaagggaaucgguaaaaccucuauuggcuuaaucugugugauuguaagcuccgggaugcuauggauggcugacaucccucugcaguggauagcgucagccauugugcucgaguucuuuaugaugguccuucugauccccgagccagaaaagcaaagaacuccucaggauaaccaguuggcauacgugguuauuggaauccugacacucgcugccauaguggccgcaaaugagaugggccugcuugaaaccaccaagagggaccucgguaugucuaaagagccgggggucguaagccccacaaguuaucuggacguggauuugcacccagcuuccgccuggacucuguacgcgguugcuacgaccgugaucacaccuauguuacggcauacuauugaaaacagcaccgccaaugucucucuagcagccaucgcuaaccaagcagugguccugaugggccucgacaagggauggcccauuucaaaaauggaucuuggcgugccacuguuggcccuggggugcuacucccagguuaacccucucacacugaccgcggcugugcuuuuacugguaacucacuaugccaucauaggacccggccuccaggcaaaggccacgcgcgaggcucagaaaagaacagccgcagguauuaugaagaauccgaccguggacgggaucaugacuaucgauuuggacccagucauuuacgauaguaaguucgagaaacaacugggacagguuaugcuacuggugcucugugcuguccagcuucuguugaugaggaccagcugggcccugugcgaagcgcucacacuggccacuggcccuaucaccacauuaugggaggguucgcccggcaaguuuuggaacacgaccauagcagugucuauggcuaauauuuuccggggguccuaucuugccggagcaggccuggcuuuuagcaucaugaaaucaguagggacuggacgaagaggcacagguagucagggggaaacccucggagagaaguggaaaaagaagcuaaaccaacugucucgcaaagaauucgacuuguacaagaaauccggcauuacugagguggauaggacagaggccaaggaaggucugaaacggggcgagaccacgcaucacgccguuagccgugggucagcgaagcuccagugguuuguggaaagaaauauggucaucccagagggaagggugauagaccuuggcugugggcgcggaggcuggaguuauuacugcgcuggucugaaaaaggucaccgaagugcggggguauacaaagggaggccccggccaugaggagccuguuccgaugagcacuuacggguggaacaucguaaaauugauguccggaaaggauguguucuaccugcccccagaaaaaugugacacccucuuaugcgauauuggugagucuagcccuucccccacagucgaagagucacgaacuaucagagugcugaagaugguugagccuuggcuuaaaaauaaccaguucuguauuaaggugcugaauccauauaugcccaccgucaucgaacaccuagagaggcuccagcgcaaguacggcgggaugcuggugcggaacccuuugucuagaaauaguacacacgaaauguauuggauuucgaacggaaccggcaauaucguaagcuccgugaacaugguuucucgucugcuccuuaauagguuuacuaugacgcaucggcgcccaacaauagagaaagacgucgaccugggugcagggacccgacacgugaacgccgaacccgagacuccgaacauggaugugauuggagagagaaucaagaggaucaaagaagagcauucaagcaccuggcacuacgacgaugaaaauccuuauaagacaugggcuuaccacggcuccuaugaggucaaagccacgggcagugcaucuagcaugauuaacgggguugugaaguuacugaccaagccaugggacguagugcccauggucacucaaauggccaugacagauaccacuccuuucggacagcagcggguguuuaaagaaaagguugacacacgcaccccaagacccaugccggguacaaggaaagugauggagauaacugcugagugguuguggcgaacccucggccggaauaagaaaccucgucugugcacgagagaagaguucaccaagaagguccgcacaaacgcggccaugggggcaguguuuacugaagagaaucaaugggauucagcuagggccgcaguagaagacgaggaguucuggaaacuaguugaucgggaaagagagcuucauaagcugggaaaauguggcuccugcguguacaacaugauggguaagcgcgaaaaaaagcucggggaguuuggaaaagccaagggcaguagggcuaucugguacauguggcugggcgcccgauauuuggaguucgaagcgcugggguuucucaaugaggaccacugguucagccgggaaaacucuuacuccggagucgagggugaaggccuucauaagcugggguauauuuuaagagauaucucaaaaauucccggaggcgcaauguacgccgacgacaccgcugguugggauacaaggaucacugaggacgaucugcacaaugaggaaaagauaacccagcagauggacccagagcaucgccaguuggccaacgcaaucuuuaaacucacguaucaaaauaagguggugaaaguccagcguccuacacccaaggggaccguuauggauauuaucagccggaaggaccagagaggaucgggccaggugggcacuuacgggcugaacacauucaccaauauggaagcucaacuaguaaggcagauggagggagaaggugugcuuucuaaagccgaucuggagaacccacaccuccuggagaagaaaauuacucagugguuggaaaccaagggcgucgagcgcuuaaaacgaauggcuaucaguggggacgauugcgugguuaagcccauagacgaucgguuugccaaugcacugcucgcgcuuaacgacaugggaaaggugagaaaagauauuccucaguggcaaccauccaagggcuggcacgacuggcagcaggucccguucuguagccaucacuuccaugaacugaucaugaaagacgguaggaagcuagugguacccugccgcccucaggaugagcugaucgggagagcccggauuucacaaggagcuggcuggucccucaaagaaacagccuguuugggcaaggcauaugcucagauguggucucugauguacuuucacaggcgugaccuucgacuggccagcaacgcaauaugcagugccguuccagugcacuggauccccacgucccgcaccacuuggagcauucaugcgcaccaucaguggaugacaaccgaggauaugcucacugucuggaauagaguguggaucgaggacaacccuuggauggaagauaagacaccaguuaccacgugggaggacgugcccuacuuagggaaacgggaagaucaaugguguggaucucugauugguuugacaucaagggcuaccugggcccagaauauccugacugcaauacagcagguccgcagucucaucggcgacgaggaguuccuugauuauaugccuuccaugaagagauuucggaaagaagaggaaagcgagggggccauuugguga

SEQ ID NO: 15562 - RNA, 9873 nt, Artificial Sequence
  derived and/or modified CDS sequence (opt3) from DENV-3__EU482453__SS-prME
accagccugugccucaucaugaugcuucccgcaacacuggcuuuccacuugacuuccagagacggagaaccuaggaugauuguggggaagaacgaacggggaaaaucuuuacuguuuaagacggcaucagguauaaauauguguacccuaaucgccauggaucucggcgaaaugugcgacgauacagucacuuacaaauguccacugauugcggaaguugagccggaagacaucgauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauucuggcccuguuucucgcucacuacaucggcacaucuuuaacucagaagguugugauauucauccugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauagccggugcccuacacagggcgaagcuauacucccagaggaacaggaccagaauuaugucuguaaacacacuuacguugaucgcgguugggggaacggaugcggccuguucggcaaggggaguuuagugaccugcgccaaguuucaaugucuggagcccauugagggaaaaguagugcaguaugaaaaucucaaguacacagucaucauuacugugcacaccggugaccagcaucagguuggcaacgacacacaaggggugaccgucgagaucacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauucaaaauucagggggaaccaguauauucgccggucacuuaaagugucggcugaaaauggauaagcuagaacucaaaggcaugagcuacgcaaugugccugaacacauuugugcuuaagaaagagguuucugagacucagcaugggaccaucuugauuaagguggaauacaagggagaggacgcccccuguaaaaucccuuucuccacggaagauggccaagguaaggcucacaacgggcgucugauaaccgcgaauccaguagucacuaagaaggaggagcccgugaacauugaagcagagccgccuuucggcgaaucaaauaucguuaucggaauuggcgacaaagcccucaagaucaacugguauaagaaagggagcaguauuggaaagauguuugaggcuacugcccgcggugcaagaaggauggccauacugggcgauaccgcuugggacuucgggucugugggaggcguccuuaauucccuggguaaaauggugcaucagaucuuugggagcgccuacacagcauuguucucgggcguaucuuggauuaugaagaucggaaucggcgugcuccugacuuggauuggguuaaacuccaaaaauaccucaaugaguuuuagcugcauagcgaucggaauuaucacgcuguaucuaggcgcuguuguccaggccgauauggguugugcaauuaacuggaaggggaaggaacucaaaugcggauccggcaucuucgugacaaaugaggugcacaccuggacugagcaguacaaguuucaagccgacucucccaaacggcuggcuacagccauagccggugcuugggaaaacggcgucugugggauccgaagcaccacucgcauggagaaucuuuuguggaagcagauugccaacgaacugaauuauauccucugggagaacaauauuaaacugaccguuguggugggagauaucauaggcguauuagaacaggggaagagaacacugacgccacagccuauggagcuuaaauacucauggaagaccuggggaaaggcgaaaauugucacugccgagacacaaaacaguuccuucaucauugacggccccaacaccccagaaugccccagcgcuucuagggcauggaaugugugggagguugaagacuaugguuuugggguguucacaacuaacaucugguugaagcuccgggaggucuacacccagucaugugaucaucgccugaugagugccgcuauaaaagacgaaagagccgugcacgcagauaugggauacuggaucgagagccagaagaauggcuccuggaaacuagagaaggcgucuuuuauugaaguuaagacgugcacauggccuaaaucgcacacccuguggagcaacggugugcucgaguccgacaugaucauuccaaagucacuggccggcccgaucagucagcauaaucacaggcccggguaucauacucaaaccgcuggaccuuggcaccuuggcaaauuggaacuggauuucaacuacugcgaggggacaacuguagucauaaccgagaauuguggaacacguggcccaucuuuacggacgaccacugugagcgguaagcucauucacgaauggugcugucgauccugcacacugcccccucuuagauauaugggggaggacggauguugguacggcauggaaaucaggccaaccaacgagaaagaagagaauauggugaagucacuggucagcgccgguucuggcaagguugauaacuuuacuauggggguguugugccucgcaauccuguucgaggaaguaaugcgcggaaaauucggcaagaaacauaugauugcuggggugcuauuuacauucguccugcuccuguccggacagaucaccuggcgggacauggcccacacgcuuauuaugauaggcaguaaugcaagcgauagaauggguaugggggugacuuauuuggcccugaucgcuaccuuuaagauucagcccuucuuagcgcucggauuuuuccugaggaaacuuacaucucgcgagaaccugcuacucggcguuggccuggccauggcaaccacuuugcaacugccggaagacaucgagcagauggcuaaugggauugccuuaggacucaugacacugaaacuuaucacccaguuugaaacauaccagcuguggacugccuuggugucccucaccuguucaaacacgauauucacacugaccgucgcuuggcgaacugcaacccuaauccuggccggugugagucuucucccucugugccaaagcucguccaugcggaagacagauugguugccaaugacuguugcggcuaugggcgugcccccucugcccuuauuuauuuucucucucaaagacaccccaaagcguagaagcuggccucugaaugagggggucauggccguaggacuugugucaauccuggcaaguuccuugcucaggaacgauguucccauggccggcccacugguggcuggugggcuacugauugcauguuaugucaucacgggaacaucugccgaccuuaccguggagaaagcggcugacguaacuugggaagaggaagccgagcagacaggcgugagccauaaccucaugauaaccgucgaugacgauggcacuaugcgcauuaaggacgaugaaacagagaauauccugaccguuuuguuaaaaacggcacugcucaucguguccgggauuuuuccguacucaauaccugccacucugcuuguguggcacaccuggcagaagcagacacaacggagcggaguccugugggacgugcccaguccacccgagacccagaaagcugaauuggaggaagguguuuacagaaucaagcagcagggcauuuucgggaagacacaaguaggagugggcguccagaaagaggguguguuucauacuauguggcacguuacccgaggggcagugcuaacgcacaacggaaagaggcuggagccuaauugggcaucugucaaaaaggaucucaucuccuauggcggcggguggcgccugagcgcucaguggcaaaaaggagaagaggugcagguaauugccgucgaaccagguaagaaccccaagaauuuccagacaaugccuggcaucuuccagacuaccacaggggagauaggagcgaucgcccuugacuuuaaaccgggcaccucggguucaccaauuaucaaccgggaagggaaggugguuggauuauacggcaauggcguggucacuaaaaacgggggauaugugucugguauugcacaaaccaaugcugagcccgauggcccuacaccagagcuggaagaggaaauguucaagaaaagaaaccucacgaucauggacuugcaucccgggaguggaaagacuaggaaguaccugccugccauaguucgugaggcuauuaaacgccggcucagaacccugauccuugcaccgacaaggguggucgccgccgaaauggaggaggcucugaagggcuugcccauccgauaucagaccacugcgacaaaauccgaacacaccggucgggagauuguggaucuaaugugccaugcaacguuuacuaugcgccugcucagcccaguaagagugccuaauuacaacuuaaucauaauggacgaagcccacuucacagaucccgcuucuauugccgcaaggggguauaucagcacccggguuggaaugggcgaggccgcugcgauuuuuaugaccgccacuccaccuggcacagcagaggcuuucccccaguccaaugccccaauccaggacgaggagcgagacauaccggaaagaucauggaacagugggaaugaguggauuaccgauuuugucggaaagacagugugguucgugccuagcaucaaagcagguaacgacaucgccaacugucugcgcaagaauggcaagaaagucauucaacuuucuaggaagacuuuugauacggaauaccagaaaacccgucugaacgacugggauuucguagugacaacugacaucuccgagaugggggcuaauuuuaaggccgaucggguuauugaccccagaaggugccucaaaccagugauauugaccgauggacccgagcgcgucauccuggcgggcccuaugccagugacagcagccucagcugcccagcgaagaggucggguugggaggaacccccagaaggaaaaugaccaauacauuuucaccggccagccucucaacaaugaugaggaccaugcucacuggacugaagcaaagaugcugcuugacaacaucaauacgccggagggaaucauuccagcccuauucgaacccgagcgcgagaaaagugcugccauagauggcgaauaucgucugaagggggagagcagaaaaaccuuuguggaauugaugcggaggggagacuuaccugucuggcuggcacacaagguggcguccgaggguaucaaauacacagaucgcaaguggugcuucgacggcgaacgaaacaaucagauucucgaggagaacauggauguagaaaucuggacuaaagagggggaaagaaagaagcugcggcccagguggcuugacgcccgcaccuauucugauccacuggcucucaaagaguuuaaggacuucgccgcaggaagaaaaucgauugcuuuggaucuggugacagaaaucggcaggguuccuagccaucuagccuaccggacccguaaugcacuggacaaccucgucaugcuucacacuucagagcauggugggcgcgccuaucgacacgcuguggaggaacugcccgagacaauggaaacguuauugcugcucggccugaugauacuucugaccggaggcgcgaugcucuuuuugaucuccgggaagggaauugguaaaacaaguaucggccugauuugugugaucgucucuagcgggauguuauggauggccgauguuccacuacaguggauagcauccgcuauugugcuggaguucuuuaugaugguacuccuuaucccugagccggaaaagcaaagaacaccccaggacaaucagcuggccuacguggucauuggaaucuugacccuggccgcaauaguggcugccaacgagaugggccuccuggaaaccacaaagagggaucuugguaugucaaaagagccagggguugugucuccuacuagcuaucucgacgucgaccugcaccccgcgagugcuuggacguuguacgccguagcaaccacagugaucacuccaaugcugcggcauaccauugaaaauuccacagccaacguuagcuuagcugcaaucgccaaccaagcggugguccuaaugggccuggauaagggauggccuauuucuaaaauggaccucggcgugccccuucuggcuuuggggugcuacucacaggucaauccgcugacccucacugccgcagugcugcuuuuaguuacgcacuaugccaucauaggaccaggccugcaggcuaaggccacacgcgaggcacagaaaagaaccgcugccgguauuaugaagaacccuacuguggaugggaucaugaccaucgaccucgaucccguaauuuacgacuccaaguucgagaaacaauugggacaggugaugcugcuaguccugugugcgguucagcuccuucugaugaggacaaguugggccuugugcgaagcacugacucucgcuaccggcccaaucacaacgcugugggaggguagccccggcaaguuuuggaauaccacuauagccgugucgauggcaaacauuuuccgggggucuuauuuagcuggagccggccuugccuuuuccaucaugaaaagcgucgggacaggacgaagaggcaccgguucacagggggaaacucugggagagaaguggaaaaagaagcucaaucaacuaagucgcaaagaguucgaucuguacaagaaaucuggcauuacagagguggacaggaccgaggcgaaggaagguuugaaacggggcgagacgacccaucacgcuguaucccgugggagcgcaaagcugcagugguuuguggaaagaaacaugguuaucccugagggaagggugauagaucucggcugugggcgcggaggcuggucauauuacugcgccggucuuaaaaaggucacagaagugcggggguauacuaagggaggcccgggccaugaggagcccgucccaaugaguaccuacggguggaauaucgugaaacugaugagcggaaaggacguuuucuacuugccucccgaaaaaugugauacacugcucugcgacauuggugaguccucuccuagcccaacuguagaagagucccgaaccaucagaguguuaaagauggucgagcccuggcugaaaaacaaucaguucuguauuaaggugcuuaacccuuauaugccaacaguuaucgaacaccuggagaggcuacagcgcaaguacggcgggaugcucgugcggaauccccugucaagaaacucuacccacgaaauguauuggauuaguaauggaacuggcaacaucgucucgagcgugaauaugguaucccguuugcugcucaacagguuuacgaugacacaucggcgcccgaccauagagaaagauguggaccuuggugcugggacucgacacguuaacgccgaaccugagaccccaaauauggacgucauuggagagagaaucaagaggaucaaagaagaacacucuucaacauggcacuacgaugacgaaaaccccuauaagacgugggcauaccacggcagcuaugaggugaaagccaccggcuccgcuaguucuaugauuaaugggguggucaagcuguuaacuaagccuugggauguugugccaaugguaacacaaauggcgaugaccgacacuacacccuucggacagcagcggguguuuaaagaaaaggucgauacccgcacaccgagaccuaugcccgguacuaggaaagugauggagauaaccgccgaguggcuguggcgaacguugggccggaacaagaaaccacgucucugcaccagagaagaguucacaaagaagguucgcacuaaugcagcuaugggggccguguuuaccgaagagaaccaaugggacagcgcaagggccgcugucgaagaugaggaguucuggaaacugguggaccgggaaagagagcuacauaaacuuggaaaauguggcucaugcguauacaauaugauggguaagcgcgagaagaagcugggggaguuuggaaaagccaagggcuccagggcgaucugguacauguggcucggcgcacgauaucuggaguucgaagccuugggguuucugaacgaggaucacugguucagucgggaaaauagcuacucuggaguugagggugaaggccuccauaaacuuggguauauucugagagacaucuccaaaauuccuggaggcgcuauguacgccgaugacacagcagguugggacacuaggaucaccgaggaugacuuacacaacgaggaaaagauaacgcagcagauggaucccgagcaucgccagcuggcuaaugccaucuuuaaauugacauaucaaaacaagguggucaaagugcagcguccaacccccaaggggacugugauggacauuaucucacggaaggaucagagaggaagcggccaggucggcacauacgggcucaauaccuucacuaacauggaagcucaacugguuaggcagauggagggagaaggugugcuaucgaaagccgaccuugagaauccucaucugcucgagaagaaaauuacccaguggcuggaaacaaagggcguagagcgcuugaaacgaauggcaaucucuggggaugacugcguggucaagccaauagaugaccgguuugcgaacgccuuacuggcucucaacgauaugggaaaggugagaaaagacauuccgcaguggcaacccaguaagggcuggcacgauuggcagcagguuccuuucuguucccaucacuuccaugaacuuaucaugaaagacgguaggaagcugguggucccaugccgcccccaggacgagcuaaucgggagagcccggauuagccaaggagcaggcuggucacugaaagaaacggcuugucucggcaaggccuaugcacagaugugguccuugauguacuuucacaggcgugaucugcgacuugccucuaaugcgauaugcagcgcugugccuguacacuggaucccaaccagucgcacuacaugguccauucaugcccaccaucaguggaugaccacugaggacaugcugacaguuuggaacagaguguggaucgaggauaaucccuggauggaagacaagaccccugucacgacaugggaggaugugccguaccucgggaaacgggaagaccaaugguguggcagcuuaauuggucugaccucuagggcaacuugggcccagaacaucuugaccgcuauacagcagguucgcucacugaucggcgaugaggaguuccucgacuauaugccaaguaugaagagauuucggaaagaagaggaacuugagggggccauuugguga

SEQ ID NO: 15563 - RNA, 9873 nt, Artificial Sequence
  derived and/or modified CDS sequence (opt3) from DENV-3__EU482454__SS-prME
accagccugugccucaugaugaugcuucccgcaacucuggcuuuccacuugacuuccagagacggagagccuaggaugaucguggggaagaacgaacggggaaagucuuuacuguuuaagacggcaucagguauuaauauguguacccuaauagccauggaucucggcgagaugugcgacgauacagucacuuacaaguguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucagcuugccacacugaggaaauuguguauugagggaaagaucaccaacauuacgaccgauagccggugcccuacacagggcgaagcuacucucccagaggaacaggaccagaauuaugucuguaaacacaccuacguugaucgcgguugggggaacggaugcggccuguucggcaaggggaguuuagugacaugcgccaaguuucaaugucuggagcccaucgagggaaaaguagugcaguaugaaaaucucaaguacacugucauaauuaccgugcacacaggugaccagcaucagguuggcaacgacacccaaggggugacugucgagaucacgccucaggcauccacaguggaagcuguacuuccagaguauggaacccugggcuuggaaugcucuccgcgaacuggucuagauuucaaugagaugauucugcucaccaugaaaaacaaggccuggaugguucacagacagugguuuuucgaccugccccuuccuuggacaagcggggcgaccacugagacaccaacguggaauaggaaagaacuguuggugaccuuuaagaacgcccaugccaagaagcaagaggucgugguccucggcucccaggaaggagcuaugcacacugcccugacaggcgcuaccgagauccaaaauucagggggaacaaguaucuucgccggucacuuaaagugucggcugaaaauggauaagcuagaacucaaaggcaugagcuacgcaaugugccugaacacuuuugugcuuaagaaagagguuucugagacccagcaugggacgauuuugauaaagguggaauacaagggagaggacgcccccuguaaaaucccuuucuccaccgaagauggccaagguaaggcucacaacgggcgucugauuacagcgaauccaguagucacuaaaaaggaggagcccgugaacaucgaagcagagccgccuuucggcgaaucaaauauaguuauuggaaucggcgacaaagcccucaagaucaacugguauaagaaagggagcaguauuggaaagauguuugaggcuaccgccaaaggugcacgcagaauggccauccugggcgauacagcuugggacuucgggucugugggaggcguccuuaauucccuggguaagauggugcaucagauuuuugggagcgccuacacugcauuguucucgggcguaucuuggauaaugaaaaucggaauuggcgugcuccugaccuggaucggguuaaacuccaagaauacgucaaugaguuuuagcugcaucguuauuggaauaaucacacuguaucuaggcgcggucgugcaggcugauauggguugugugauuaacuggaaggggaaagaacucaagugcggauccggcaucuucgucaccaaugagguucacacuuggacagagcaguacaaauuucaagccgacucucccaagaggcuggcaaccgccauugcuggugccugggaaaacggcgugugugggauccggagcacuacccgaauggagaaucuuuuguggaaacagauagcaaacgaacugaauuauauccucugggagaacaauauuaagcugacagugguagucggagauaucauuggcguguuagaacaggggaaacgcacgcugaccccacagccuauggagcuuaaguacucauggaagacuuggggaaaagcuaagaucguuacagccgagacccaaaacaguuccuucauaauugacggccccaacacaccagaaugccccagcgcgucuagagccuggaaugugugggaggucgaagacuaugguuuugggguguucacuaccaacaucugguugaaacucagggagguuuacacgcagucaugugaucaucggcugaugagugcugcaauuaaggacgaacgcgccgugcacgcugauaugggauacuggaucgagagccagaaaaauggcuccuggaagcuagagaaggccucuuuuauagaaguaaaaacaugcaccuggccuaagucgcacacucuguggagcaacgguguccucgaguccgacaugaucauuccaaaaucacuggcaggcccgaucagucagcauaaucacagacccggguaucauacccaaacagcgggaccuuggcaccuuggcaaguuggaacuggauuucaacuacugcgaggggacuaccguggugauuacagagaauuguggaacgaggggcccaucuuuacguaccacuacagucagcgguaaacucauccacgaauggugcugucgguccugcacccugcccccucuucgauauaugggggaggacggauguugguacggcauggaaauaagaccaauuaacgagaaggaagagaauaugguuaagucacuggugagcgccgguucuggcaaaguagauaacuuuacuauggggguguugugccucgcuauccuguucgaggaagucaugaggggaaaguucggcaaaaagcauaugaucgccggggugcuauuuacauucguucugcuccuguccggacagauuaccuggcgcgacauggcacacacgcuuaucaugauuggcaguaaugcuagcgaucggauggguaugggggugacuuauuuggcccugauagcaaccuuuaaaauccagcccuucuuagcccucggauuuuuccugagaaaacuuacaucuagggagaaccugcuacucggcgucggccuggcuauggcgaccacuuugcaacugccggaagacauugagcagauggccaaugggaucgcauuaggacucaugacacugaaacuuauuacccaguuugaaacauaccagcuguggacugcuuuggugucccucaccuguucaaacacgaucuucacacugaccguugccuggcgcacugccacccuaauacuggcuggugugagucuucucccucugugccaaagcucguccaugcgaaaaacagauugguugccaaugacugucgcagccaugggcguacccccucugcccuuauuuaucuucucucucaaggacaccccaaaacggcguagcuggccucugaaugagggggugauggcgguuggacuugugucaauucuggcuaguuccuugcucagaaacgauguccccauggccggcccacugguggccggugggcuacugaucgccuguuauguaauuacgggaacaucugcugaccuuaccguggagaaggcagccgacgucacuuggguugaagaggcggaacagacaggcgugagccauaaccucaugaucaccguggaugacgauggcacuaugaggauaaaagacgaugagacagaaaauauucugaccgucuuguuaaagacggcucugcucaucguguccgggaucuuuccguacucaauuccugccacucugcuuguuuggcacaccuggcagaaacagacacaacgcagcggaguacugugggacgugcccaguccacccgagacccagaaggcagaguuggaagagggugucuaccggauaaagcagcagggcaucuucgggaaaacacaagugggaguuggcgugcagagagaaggugucuuucauacuauguggcacgugacccgaggggcaguacuaacgcacaacggaaagaggcuggagccuaauugggcuucugucaaaaaggaucucauuuccuauggcggcggguggcgccugagcgcccaguggcaaaaaggagaggaagugcagguuaucgcaguggagccagguaagaaccccaagaauuuccagacaaugccuggcacuuuccagaccacaaccggggaaauuggagcuaucgcccuugacuuuaaaccgggcacuucggguucaccaauaaucaaccgggaggggaaggucgugggauuauacggcaauggcguugugaccaaaaacgggggauaugucucugguauugcgcaaacaaaugccgaacccgauggcccuacgccagagcuggaggaagagauguucaagaaaagaaaccucacuaucauggacuugcaucccgggaguggaaagaccaggaaguaccugccugcaauugugcgugaagcuaucaaacgccggcucagaacacugauacuugccccgaccaggguaguggcugcagagauggaagaggcccugaagggcuugcccauucgauaucagacuacagccaccaaauccgagcacacgggucgggaaaucguugaucuaaugugccaugcuacuuuuacaaugcgccugcucagcccagucagagugccuaauuacaacuuaaucauuauggacgaggcgcacuucaccgaucccgcaucuaucgccgcuaggggguauauaagcacccgggugggaaugggcgaagccgcagccauuuuuaugacugcuacaccaccuggcaccgcggaggccuucccccaguccaaugcaccaauccaggacgaggaacgagacauuccggagagaucauggaacagugggaaugaauggaucacagauuuugucggaaagacuguaugguucgugccuagcauaaaagcugguaacgacauugccaacugucugcgcaagaauggcaagaaaguuauccaacuuucuaggaagacguuugauaccgaguaccagaaaacacgucugaacgacugggauuucguggucacuaccgacaucuccgaaaugggggcaaauuuuaaggccgaucgggugauugaccccagaaggugccucaaaccaguuaucuugacagauggacccgagcgcgugauucuggcuggcccuaugccagucaccgccgcgucagcagcccagcgaagaggucggguggggaggaacccccagaaggagaaugaccaauacauauucacuggccagccucucaacaaugaugaagaccaugcucacuggacggaggccaagaugcugcuugacaacaucaauaccccggaaggaauuaucccagcucuauucgagcccgaacgcgagaaaagugcagccaucgauggcgaguaucgucugaagggggaaagcagaaaaacauuuguagaguugaugcggaggggagacuuaccuguguggcuggcucacaagguugccuccgaagguauuaaauacacugaucgcaaguggugcuucgacggcgagcgaaacaaucagauacucgaagagaacauggaugucgagaucuggaccaaagaaggggagagaaagaagcugcggcccagguggcuugacgcacgcacauauucugauccacuggcgcucaaagaauuuaaggacuucgccgcuggaagaaaaucgauugccuuggaucuggugaccgagaucggcagggugccuagccaucuagcacaccggacucguaaugcucuggacaaccucgucaugcuucauaagucagaacacggugggcgcgccuaccgacacgcaguugaggagcugcccgaaacaauggagacguuauugcugcucggccugaugauucuucugaccggaggcgccaugcucuuuuugaucuccgggaaaggaauagguaagacaaguaugggccugaucugugugauuguaucuagcgggauguuauggauggcugaugugccacuacaguggaucgcguccgccauuguccuggaguucuuuaugauggugcuccuuaucccugagccggagaagcaaagaacaccccaggacaaucagcuggcauauguugugauaggaauuuugacccuggcugccaucgucgccgcaaacgaaaugggccuccuggagaccacaaaaagggaucuugguaugucaaaggaaccagggguagugucuccuacuagcuaccucgacguugaccugcaucccgcuagugccuggacguuguaugcgguggcuaccacagucauuacuccaaugcugcggcacaccaucgaaaauuccacagccaacgugagcuuagcagccauagcuaaccaagcagucgugcuaaugggccuggauaaaggauggccuaucucuaagauggaccucggcguuccccuucuggccuuggggugcuacucacaggugaauccgcugacccucacugcggcuguacugcuuuuagugacgcauuacgccauuaucggaccaggccugcaggcaaaagccacacgcgaagcucagaagagaaccgccgcagguauuaugaagaacccuacugucgaugggaucaugaccauagaccucgaucccguuauuuaugacuccaaauucgagaagcaauugggacaggugaugcugcuaguccugugugcugugcagcuccuucugaugaggacaaguugggccuugugcgaggcgcugacucucgccaccggcccaaucacaacgcugugggaagguagccccggcaaauuuuggaauaccacuaucgcaguaucgauggcuaacauuuuccgggggucuuacuuagccggagcaggccuugcuuuuuccaucaugaaaagcguggggacaggacgaagaggcaccgguucacagggggagacucugggagaaaaauggaagaagaaacucaaucaacuaagucgcaaggaguucgaucuguauaaaaagucuggcauaacagaaguugacaggaccgaggccaaagaggguuugaagcggggcgaaacgacccaccaugccgugucccgugggagcgcgaaacugcagugguuugucgagagaaacauggugauuccugaaggaagggucaucgaucucggcugugggcgcggaggcuggucauacuauugcgcuggucuuaagaaggugacagagguucggggguacacuaaaggaggcccgggccacgaagaacccguaccaaugaguaccuauggguggaauauugugaagcugaugagcggaaaagacgucuucuacuugccucccgagaagugugauacacugcucugcgacaucggugaauccucuccuagcccaacuguggaggaaucccgaaccauaagaguuuuaaaaaugguggagcccuggcugaagaacaaucaguucuguaucaagguccuuaacccuuacaugccaacagugauugagcaccuggaaaggcuacagcgcaaauauggcgggaugcucguacggaauccccugucaagaaacucuacccaugagauguacuggaucaguaauggaacuggcaacauugugucgagcguuaauauggucucccguuugcugcucaacagguuuacgaugacacaccggcgcccgaccaucgaaaaggauguggaccuuggugcagggacucgacaugugaacgccgagccugaaaccccaaauauggacgucauuggagagagaaucaaaaggauaaaggaggaacacucuucaacauggcacuaugaugacgagaaccccuacaaaacgugggcuuaucauggcagcuacgaaguuaaggccaccggcuccgcaaguucuaugauuaauggggugguaaagcuguuaacuaaaccuugggauguggucccaauggugacacaaauggccaugaccgacacuacacccuucggacagcagcggguuuuuaaggagaaaguggauacccgcacaccgagaccuaugcccgguacuaggaaggucauggaaaucaccgcugaguggcuguggcgaacguugggccggaacaaaaagccacgucucugcaccagagaggaguucacaaagaaagugcgcacuaaugcggccaugggggcaguauuuaccgaggaaaaccaaugggacagcgcuagggccgcaguugaggaugaagaguucuggaagcugguggaccgggagagagaacuacacaaacuuggaaaguguggcucaugcgucuauaauaugauggguaaacgcgagaagaaacugggggaauuuggaaaggccaagggcuccagggcuaucugguacauguggcucggcgcccgauaccuggaguucgaggcguugggguuucugaacgaagaucauugguucagucgggagaauagcuauucuggaguggaaggugagggccuccacaaacuuggguacauucugagagacauauccaagaucccuggaggcgcaauguaugccgaugacacagcugguugggacacuaggauuaccgaagaugacuuacauaacgaggagaaaaucacgcagcagauggaucccgaacaccgccagcuggccaaugcaauuuuuaaguugacauaccaaaacaaaguggucaagguucagcguccaacccccaaggggacugugauggacaucauaucacggaaagaucagagaggaagcggccagguaggcacauaugggcucaauaccuucacuaacauggaggcucaacuggugaggcagauggaaggagaggguguccuaucgaaggccgaccuugaaaauccucaucugcucgagaaacgcaucacccaguggcuggagacaaagggcguggaacgauugaaacggauggcuauuucuggggaugacugcguugugaagccaaucgaugacagauuugccaacgcauuacuggcgcucaacgauaugggaaaggucaggaaagacauuccgcaguggcaacccaguaagggcuggcaugauuggcaacaggugccuuucuguucccaccauuuccacgagcuuaucaugaaagacggucgcaagcugguaguuccaugcagaccccaggacgaacuaauagggcgggccaggauuagccaaggagcuggcuggucacugaaagagacggccugucucggcaaggcauacgcucagaugugguccuugauguauuuucaccgucgagaucugcgccuugccucuaaugcaaucugcagcgccgugccugcgcauuggaucccaaccaguagaacuacaugguccauucacgcucaucaccaguggaugaccacugaagacaugcugacagucuggaaccggguguggauagaggauaaucccuggauggaggacaagaccccuguuacgacaugggaagaugugccguaccucgggaaaagggaggaccaaugguguggcagcuuaaucggucugaccucucgcgccacuugggcacagaacauuuugaccgccauccagcaggucagaucacugauuggcgaugaagaguuccucgacuacaugccaaguaugaagcgguuuaggaaagaggaagaguccgaaggggcuaucugguga

SEQ ID NO: 15564 - RNA, 9873 nt, Artificial Sequence
  derived and/or modified CDS sequence (opt3) from DENV-3__EU482455__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugguugcggaaguggagccggaagacaucgauugcugguguaaccuuaccaguacauggguaaccuaugggacuugcaaucaggcuggagagcaucgccgagacaagcguagcguggcccuggcaccccacgucggcauggguuuggauacaagaacccaaacguggauguccgccgagggggcuuggaggcagguggaaaaaguugagacuugggcacuccggcauccuggauucaccauucuggcccuguuucucgcucacuacaucggcacaucuuuaacucagaagguggucauuuucauccugcuuauguuggugaccccaucgaugacaaugcgcuguguaggcguugggaacagagacuuuguggaaggacugucaggugccaccugggucgauguggugcuagagcauggcgggugcgucacgacuauggcgaagaauaaacccacacucgacauagagcugcagaagaccgaagcaacucaacuugccacacugaggaaauuguguaucgagggaaagauuaccaacaucacgaccgauagccggugcccuacacagggcgaagcuauucucccagaggaacaggaccagaauuauguuuguaaacacacuuacguggaucgcgguugggggaacggaugcggccuguucggcaaggggaguuuaguaaccugcgccaaguuucaaugucuggagcccaucgagggaaaagugguccaguaugaaaaucucaaguacacagugauaauuacuguucacaccggugaccagcaucaggugggcaacgacacacaaggggucaccguggagaucacuccucaggcauccacgguagaagcuguucuuccagaguauggaacacugggcuuggaaugcucuccgcgaaccggucuagauuucaaugagaugauucugcucacuaugaaaaacaaggccuggauggugcacagacagugguuuuucgaccugccccuuccuuggaccagcggggcgacaaccgagacuccaacauggaauaaaaaggaacuguuggucacguuuaaaaacgcccaugcaaagaagcaagagguggucgugcucggcucccaggaaggagcuaugcacaccgcccugacuggcgcuacagagauccagaauucagggggaaccaguaucuucgccggucacuuaaaauguaggcugaagauggauaaacuagaacucaagggcaugagcuacgcaaugugccugaacacauuuguucuuaaaaaggaggugucugagacucagcaugggaccauuuugauaaagguagaauacaaaggagaggacgcccccuguaagaucccuuucuccacggaagauggccaagguaaagcucacaacgggcggcugauuaccgcgaauccagucgugacaaagaaagaggagcccguuaacaucgaagcagagccgccuuucggcgaaucaaauauagugauuggaaucggcgacaaggcccucaagaucaacugguauaaaaaggggagcaguauuggaaaaauguuugaggcuacugcccguggugcacgcagaauggccauccugggcgauaccgcuugggacuucgggucugucggaggcgugcuuaauucccuggguaagaugguacaucagauuuuugggagcgccuacacagcauuguucucgggcgugucuuggauaaugaaaaucggaauuggcguucuccugacuuggaucggguuaaacuccaagaauaccucaaugaguuuuagcugcaucgucauuggaauaaucacgcuguaucuaggcgcgguggugcaggcugauauggguugugccauuaacuggaaggggaaagaacucaagugcggauccggcaucuucgucacaaaugagguucacaccuggacugagcaguacaaauuucaagcagacucucccaagaggcuggccacagcuauugccggugcaugggaaaacggcgugugugggauccggagcaccacucgaauggagaaucuuuuguggaaacagauagcuaacgaacugaauuauauccucugggagaacaauauuaagcugaccgugguagucggagauaucauuggcguguuagaacaggggaaacgcacacugacgccacagccuauggagcuuaaguacucauggaagaccuggggaaaagccaagaucguuacugcggagacacaaaacaguuccuucauaauugacggccccaacaccccagaaugccccagcgccucuagagcuuggaaugugugggaggucgaagacuaugguuuugggguguucacaacuaacaucugguugaaacucagggagguuuacacccagucaugugaucaucggcugaugagugcagccauuaaggacgaacgcgcugugcacgccgauaugggauacuggaucgagagccagaaaaauggcuccuggaagcuagagaaggcaucuuuuauagaaguaaaaacgugcacauggccuaagucgcacacccuguggagcaacgguguccucgaguccgacaugaucauuccaaaaucacuggcgggcccgaucagucagcauaaucacagacccggguaucauacucaaaccgccggaccuuggcaccuuggcaaguuggaacuggauuucaacuacugcgaggggacaacuguggugauuaccgagaauuguggaacaaggggcccaucuuuacguacgaccacugucagcgguaaacucauccacgaauggugcugucgguccugcacacugcccccucuucgauauaugggggaggacggauguugguacggcauggaaauaagaccaauuaacgagaaggaagagaauaugguuaagucacuggugagcgcugguucuggcaaaguagauaacuuuaccauggggguguugugccucgccauccuguucgaggaagucaugaggggaaaguucggcaaaaagcauaugaucgcaggggugcuauuuacuuucguucugcuccuguccggacagauuacauggcgcgacauggcucacacccuuaucaugauuggcaguaaugccagcgaucggauggguaugggggugacguauuuggcacugauagccacuuuuaaaauccagcccuucuuagcucucggauuuuuccugagaaagcuuaccucuagggagaaccugcuacucggcgucggccuggcgauggccacaaccuugcaacugccggaagacauugagcagauggcaaaugggaucgcuuuaggacucaugacucugaagcuuauuacacaguuugaaaccuaccagcuguggacagccuuggugucccucacuuguucaaacaccaucuucacgcugacaguugccuggcgcaccgcuacucuaauacuggcaggugugagucuucucccucugugccaaagcucguccaugcgaaaaaccgauugguugccaaugacagucgccgcgaugggcguacccccucugcccuuauuuaucuucucucucaaggacacuccaaaacggcguagcuggccucugaaugagggggugauggcuguuggacuugugucaauucuggccaguuccuugcucagaaacgauguccccauggcaggcccacugguggccggugggcuacugaucgcuuguuauguaauuaccggaacgucugcagaccuuacaguggagaaggccgcggacgucaccugggaagaggaagcugagcagacuggcguuagccauaaccucaugaucacaguggaugacgauggcaccaugaggauaaaagacgaugaaacugagaauauucugacaguguuguuaaagaccgcccugcucaucgucuccgggaucuuuccguacucaauuccugcaacgcugcuuguguggcacacuuggcagaaacagacccaacgcagcggaguucugugggacguacccaguccacccgagacacagaaggccgaauuggaggaagguguguaccggauaaagcagcagggcaucuucgggaaaacccaagucggagugggcguucagaaggaggguguguuucauacaauguggcacgucacuagaggggcugugcuaacccacaacggaaaaaggcuggagccuaauugggccucuguaaagaaagaucucauuuccuauggcggcggguggcgacugagcgcacaguggcaaaagggagaagagguccaggugaucgcuguugaaccagguaagaaccccaaaaauuuccagacgaugccuggcauuuuccagacaacuaccggggagaucggagccauagcgcuugacuuuaagccgggcacaucggguucaccaaucauuaaccgcgaagggaaaguggucggauuauacggcaauggcgugguuaccaagaacgggggauaugugucugguaucgcccaaacuaaugcagagcccgauggcccuaccccagagcuggaagaggaaauguucaaaaagcggaaccucacaauuauggacuugcaucccgggaguggaaagacgagaaaauaccugccugcuaucgucagggaggccauaaagcgucgccuccggacucugauucuugcuccgaccagagugguagcagccgaaauggaggaggcccugaaaggcuugcccaucagguaucagacaaccgcuacuaaguccgaacacacaggucgagagaucguggaucuaaugugccaugcgaccuuuacgaugcggcugcucagcccaguucgcgucccuaauuacaacuuaauuaucauggacgaagcacacuucacugaucccgccucuauagcugccagaggguauauuagcacaagggugggaaugggcgaggcagccgcuaucuuuaugaccgcgaccccaccuggcacugccgaagcauucccccaguccaaugcuccaauucaggacgaggagcgggacaucccggaacgaucauggaacagugggaaugaguggauaacagauuuugugggaaaaaccgucugguucguaccuagcauuaaggccgguaacgacaucgcaaacugucugagaaagaauggcaaaaaggugauccaacuuucucgcaaaacauuugauacugaauaccagaagacgaggcugaacgacugggauuucguugugaccacagacauuuccgagaugggggccaauuuuaaagcugaucgugucaucgacccccggagaugccucaagccagugauuuugacugauggacccgagaggguuauacuggccggcccuaugccagugaccgcggcaucagccgcucagcgccgagguagagucgggcggaacccccagaaggaaaaugaccaauacaucuucacaggccagccucucaacaaugaugaggaccaugcccacuggaccgaagcuaaaaugcugcuugacaacauuaauacuccggagggaaucaucccagcacuauucgaacccgagagggagaagagugccgcuauugauggcgaauaucgccugaaaggggagagccguaagacguuuguggaauugaugagacggggagacuuaccuguauggcuggcccacaaaguggcauccgaggguauaaaguacaccgauaggaaauggugcuucgacggcgaacgcaacaaucagauccucgaggagaacauggauguugaaauuuggacaaaggagggggaacgaaagaaacugagaccccgguggcuugacgcgaggacuuauucugauccacuggcccucaaggaguuuaaagacuucgcugccggacgcaagucgaucgcauuugauuuggucaccgaaauuggcagagugccuagccaucuggcuuacaggacacggaaugcccuagacaaccuggugaugcuccacaccucagagcauggugggcgugcauaucgccacgccgucgaggaacuucccgagacuauggaaacacuguuauugcugggccucaugauccugcuuacgggaggcgcuaugcuguuccucauauccgggaaaggaaucgguaagaccaguauuggcuugaucuguguuauugugucuagcgggaugcuguggauggcggauguaccauuacaguggaucgccuccgcaauagugcuagaguuuuucaugaugguccugcucauuccugagccggaaaagcaacgaacuccccaggacaaucagcuugcuuacgugguuaucggaauucugacauuggccgccaucguggcagcuaacgagaugggccugcucgaaaccaccaaaagagaucuggguaugucaaaggagccaggggucguaucuccuacaagcuaucuugacguggaccuccaccccgccagugcguggacucuguacgcuguugccacgaccgugauaacaccaauguugaggcauacuaucgaaaauuccaccgcaaacgucagccuggccgcuauugcaaaccaagccguggucuuaaugggccuagauaaaggauggccuaucucuaagauggaccugggcgugccccuccuugcgcuggggugcuacucacagguuaauccguugacacugaccgcugccgugcuccugcuuguaacucacuaugcaauuaucggaccaggcuuacaggccaaagcuacgcgggaggcccagaagcgcacagcagcugguauaaugaagaacccuaccguggaugggauuaugacuaucgaccuggaucccgucaucuacgacuccaaauuugagaagcaacucggacagguuauguugcuggugcuaugugccguccagcugcuccuuaugagaaccaguugggcgcugugcgaagccuugacacuggcaacuggcccaauuaccacacucugggaggguagccccggcaaauucuggaauacgaccaucgcugugucgauggccaacauauuuagggggucuuaucuggcaggagcuggcuuagccuucuccauuaugaagagcguagggaucggacggcgaggcacugguucacagggggaaacacuuggagagaaauggaagaagaaacugaaucaacucaguagaaaggaauuugaucuauacaaaaagucuggcauuaccgagguggaccgcacugaggccaaagaaggucugaagaggggcgagacaacccaucacgcgguuucccgggggagcgcuaaauugcagugguucguggaacguaacauggucaucccugagggaagagugauagaucugggcugugggaggggaggcuggucauauuacugcgcaggucucaagaaggucacggaagugcgcggguauaccaaaggaggcccgggccaugaggagcccguuccaaugaguacauacggguggaauaucguaaagcuuaugagcggaaaagacguguucuaccugccucccgaaaagugugauacuuugcugugcgacauuggugaguccucuccuagcccaaccgucgaagagucccggacaauccgagugcucaaaaugguugagcccugguuaaagaacaaucaguuuuguauuaaggugcugaacccuuauaugccaacugucaucgaacaccuugagagacugcagaggaaauacggcgggaugcuagugcgcaauccccucucacggaacucuacccacgaaauguauuggauuaguaauggaacaggcaacaucguaucgagcgugaauaugguuuccagacuguugcugaaccguuucaccaugacucauaggcggccgacgauagagaaggaugucgaccucggugccgggacacgccacgugaacgcugaaccugagaccccaaauauggacgugauuggagagcgaaucaaaagaaucaaggaagagcauucuucaacuuggcacuacgaugacgaaaaccccuauaaaaccugggccuaccacggcagcuaugaggucaaggcaacaggcuccgccaguucuaugauuaaugggguugugaagcuucugacgaaaccuugggauguagugccaauggucacccaaauggcuaugacugacacaacccccuuuggacagcagaggguguucaaggaaaaaguugauacucggacaccgcgcccuaugcccgguaccagaaaggugauggagauaacagcggagugguuauggaggacucugggccgaaacaaaaagccacgguugugcacccgugaagaguuuacgaagaaagucagaaccaaugccgcaaugggggcuguguucacagaagagaaccaaugggacagcgcccgcgcagccguagaagaugaggaguuuuggaagcucguugacagggaacgggagcugcauaaacuaggaaaguguggcucaugcguguacaauaugauggguaaaagagaaaagaaacuuggggaguucggaaaggcuaagggcucccgcgccaucugguacauguggcugggcgcgagguaucucgaguuugaagcacugggguucuugaacgaggaucacugguuuagucgagaaaauagcuacucuggagucgagggugaaggccugcauaaacucggguauauucuucgggacaucuccaagauuccuggaggcgccauguacgcugaugacacugccgguugggacaccagaaucacagaggaugaccugcacaacgaggaaaaaauaacucagcagauggaucccgagcauaggcaguuagcaaaugcuaucuucaagcugaccuaucaaaacaaaguggugaagguccagcgcccaacgcccaaggggacaguuauggacauuaucucacguaaagaucagcggggaagcggccaggugggcaccuacggguugaauacuuuuacaaacauggaagcccaacucguaagacagauggagggagaaggugugcugucgaaggcugaccuagagaauccucaccuucuggagaaaaagauuacccaguggcucgaaacuaaaggcgucgagaggcugaagcgcauggccaucucuggggaugacugcgugguuaagccaauagaugaccgauucgcaaacgcguuguuagcccugaacgauaugggaaaagugcggaaggacauuccgcaguggcaacccaguaaaggcuggcacgauuggcagcaggucccuuucuguucccaucacuuucaugaacucaucaugaaggacgguagaaaacuugugguaccaugcaggccccaggacgagcugaucgggcgcgcuagaauuagccaaggagccggcuggucacuaaaggaaaccgcaugucugggcaaggcuuaugcccagauguggucccucauguacuuccaccggagggauuugcgucuggcaucuaaugccauaugcagcgcgguuccugugcacuggaucccaacaagucgaacgaccugguccauucaugcucaccaucaguggaugacuacagaggacaugcuuaccgucuggaaccgcguguggaucgaggauaaucccuggauggaagacaaaacuccuguuacaaccugggaggaugugccguaccuggggaagagagaagaccaaugguguggaagccucauugguuuaacgucucgggccacaugggcacagaacauccugaccgccauacagcaggucaggucauugaucggcgaugaggaguuucuggacuauaugccaaguaugaaacgcuucagaaaggaagaggaauccgagggggcuauuugguga

SEQ ID NO: 15565 - RNA, 9873 nt, Artificial Sequence
  derived and/or modified CDS sequence (opt3) from DENV-3__EU482456__SS-prME
accagccugugccucaugaugaugcuucccgcaacucuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacuguaacuuacaaauguccacugaucgcggaaguugagccggaagacauugauugcugguguaaccuuaccaguaccugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucacugagaugauccugcucaccaugaaaaauaaggccuggaugguucacagacagugguuuuucgaccugccccuuccuuggacaagcggggcgaccacugagacaccaacguggaacaggaaagaacuguuggugaccuuuaagaaugcccaugccaagaagcaagaggucgugguccucggcucccaggaaggagcuaugcacacugcccugacaggcgcuaccgagauccagaacucagggggaacaaguauuuucgccggucacuuaaagugucggcugaaaauggauaagcuagaacucaaaggcaugagcuacgcaaugugccugaauacuuuugugcuuaagaaagagguuucugagacccagcaugggacgauauugaucaagguggaauacaagggagaggacgcccccuguaaaauuccuuucuccaccgaagauggccaagguaaggcucacaacgggcgucugaucacagcgaacccaguagucacuaaaaaggaggagcccgugaauauagaagcagagccgccuuucggcgaaucaaacauuguuaucggaaucggcgacaaagcccucaagauuaauugguauaagaaagggagcaguaucggaaagauguuugaggcuaccgcccgcggugcaagaaggauggccauucugggcgauacagcuugggacuucgggucugugggaggcguccuuaacucccuggguaaaauggugcaucagauauuugggagcgccuacacugcauuguucucgggcguaucuuggaucaugaagauuggaaucggcgugcuccugaccuggaucggguuaaauuccaaaaacacgucaaugaguuuuagcugcauuguuauaggaaucauuacacuguaucuaggcgcggucgugcaggcugauauggguugugugaucaauuggaaggggaaggaacucaaaugcggauccggcauuuucgucaccaacgagguucacacuuggacagagcaguacaaguuucaagccgacucucccaaacggcuggcaaccgccaucgcuggugccugggaaaauggcgugugugggauacgaagcacuacccgcauggagaaccuuuuguggaagcagaucgcaaaugaacugaacuauauucucugggagaauaacaucaaacugacagugguagucggagauacgauuggcguguuagaacaggggaagagaacccugacuccacagccuauggagcuuaaauacucauggaagacauggggaaaggcuaaaaucguuaccgccgagacacaaaauaguuccuucauaauugacggccccaacacuccagaaugccccagcgcgucuagggccuggaacgugugggaggucgaagacuaugguuuugggguguucaccacgaauaucugguugaagcuccgggagguuuacacacagucaugugaucaucgccugaugagugcugcaauuaaagacgaaagagccgugcacgcugauaugggauacuggaucgagagccagaagaacggcuccuggaaacuagagaaggccucuuuuauagaaguaaagaccugcacuuggccuaaaucgcacacccuguggagcaaugguguccucgaguccgacaugaucauuccaaagucacuggcaggcccgaucagucagcauaaccacaggcccggguaucauacacaaacugcgggaccuuggcaccuuggcaaauuggaacuggauuucaauuacugcgaggggaccacaguggugauuacggagaacuguggaacccguggcccaucuuuacggacuacaaccgucagcgguaagcucauccacgaauggugcugucgauccugcacucugcccccucuuagauauaugggggaggacggauguugguacggcauggaaauaaggccaauuaaugagaaagaagagaacaugguuaagucacuggugagcgccgguucuggcaagguagauaauuuuacaauggggguguugugccucgcuauccuguucgaggaagucaugcgcggaaaauucggcaagaaacauaugaucgccggggugcuauuuaccuucguucugcuccuguccggacagauuacguggcgggacauggcacacacucuuaucaugauuggcaguaacgcuagcgauagaauggguaugggggugaccuauuuggcccugauagcaacauuuaagauccagcccuucuuagcccucggauuuuuccugaggaaacuuaccucucgcgagaaucugcuacucggcgucggccuggcuauggcgacuacauugcaacugccggaagacauugagcagauggccaacgggaucgcauuaggacucaugacccugaaacuuauuacacaguuugaaacuuaccagcuguggaccgcuuuggugucccucacguguucaaauacaaucuucacccugacuguugccuggcgaaccgccacacuaauacuggcuggugugagucuucucccucugugccaaagcucguccaugcggaagacugauugguugccaaugaccgucgcagccaugggcguacccccucugcccuuauuuaucuucucucucaaagacacgccaaagcguagaagcuggccucugaacgagggggugauggcgguuggacuugugucaauucuggcuaguuccuugcucaggaaugauguccccauggccggcccacugguggccggugggcuacugaucgccuguuauguaauuacaggaaccucugcugaccuuacuguggagaaagcagccgacgucacaugggaagaggaagcggagcagaccggcguuagccauaaccucaugaucacuguggaugacgauggcacaaugcgcauaaaggacgaugaaaccgagaacauucugacgguguuguuaaaaacugcucugcucaucgucuccgggaucuuuccguacucaauuccugccacccugcuuguguggcacacauggcagaagcagacccaacggagcggaguucugugggacguacccaguccacccgagacacagaaagcagaauuggaggaagguguguacagaauaaagcagcagggcaucuucgggaagacucaagucggagugggcguucagaaagaggguguguuucauaccauguggcacgucacgcgaggggcagugcuaacacacaauggaaagaggcuggagccuaacugggcuucugucaagaaggaucucauuuccuauggcggcggguggcgccugagcgcccaguggcaaaaaggagaagagguccaggugaucgcaguugaaccagguaagaaucccaagaacuuccagacuaugccuggcauuuuccagaccacaaccggggagaucggagcuauagcccuugacuuuaaaccgggcacuucggguucaccaaucauuaaucgggaagggaagguggucggauuauacggcaacggcgugguuaccaaaaaugggggauaugugucugguaucgcgcaaacaaacgccgagcccgauggcccuacgccagagcuggaagaggaaauguucaagaaaagaaaucucacuauuauggacuugcaucccgggaguggaaagaccaggaaguaccugccugcaaucguccgugaggcuauaaaacgccggcucagaacacugauucuugccccgaccagggugguagcugcagaaauggaggaggcccugaagggcuugcccauccgauaucagacuacagccaccaaauccgaacacacgggucgggagaucguggaucuaaugugccaugcuacuuuuacaaugcgccugcucagcccaguuagagucccuaacuacaauuuaauuaucauggacgaagcgcacuucaccgaucccgcaucuauagccgcuaggggguauauuagcacccgggugggaaugggcgaggccgcagccaucuuuaugacugcuacaccaccuggcaccgcggaagccuucccccaguccaacgcaccaauucaggacgaggagcgagacaucccggaaagaucauggaauagugggaacgaguggauaacagauuuugugggaaagacugucugguucguaccuagcauuaaagcugguaaugacaucgccaacugucugcgcaagaacggcaagaaagugauccaacuuucuaggaagacguuugauaccgaauaccagaaaacacgucugaaugacugggauuucguugugacuaccgacauuuccgagaugggggcaaacuuuaaggccgaucgggucaucgaccccagaaggugccucaaaccagugauuuugacagauggacccgagcgcguuauacuggcuggcccuaugccagugaccgccgcgucagcagcccagcgaagaggucgggucgggaggaauccccagaaggaaaacgaccaauacaucuucacuggccagccucucaauaacgaugaggaccaugcucacuggacggaagccaagaugcugcuugacaauauuaacaccccggagggaaucaucccagcucuauucgaacccgagcgcgagaaaagugcagccauugauggcgaauaucgucugaagggggagagcagaaaaacauuuguggaauugaugcggaggggagacuuaccuguauggcuggcucacaagguggccuccgaggguauaaaauacacugaucgcaaguggugcuucgacggcgaacgaaauaaccagauccucgaggagaauauggauguugaaauuuggaccaaagagggggaaagaaagaagcugcggcccagguggcuugacgcacgcacauauucugauccacuggcgcucaaagaguuuaaggacuucgccgcuggaagaaaaucgaucgccuuggaucuggucaccgaaauuggcagggugccuagccaucuagcauaccggacucguaacgcucuggacaaucucgugaugcuucacacaucagagcauggugggcgcgccuaucgacacgcagucgaggaacugcccgagacgauggaaaccuuauugcugcucggccugaugauccuucugacuggaggcgccaugcucuuuuugauauccgggaagggaaucgguaaaacaaguauuggccugaucuguguuauugugucuagcgggauguuauggauggcugauguaccacuacaguggaucgcguccgccauagugcuggaguucuuuaugaugguccuccuuauuccugagccggaaaagcaaagaacaccccaggacaaccagcuggcauacgugguuaucggaauuuugacccuggcugccaucguggccgcaaaugagaugggccuccuggaaacaacuaagagggaucuugguaugucaaaagagccaggggucguaucuccuacgagcuaucucgacguggaccugcaccccgcuagugccuggaccuuguacgcgguugcuacaacugugauaaccccaaugcugcggcauacaaucgaaaacuccaccgccaaugucagcuuagcagccauugcuaaccaagcagugguccuaaugggccuggauaagggauggccuaucucuaaaauggaccucggcgugccccuucuggccuuggggugcuacucacagguuaacccgcugacucucacggcggcugugcugcuuuuaguaacacacuaugccauuaucggaccaggccugcaggcaaaggccacccgcgaggcucagaaaagaacugccgcagguauaaugaagaauccuaccguggaugggauuaugacaaucgaccucgaucccgucaucuacgacuccaaguucgagaaacaauugggacagguuaugcugcuagugcugugugcuguccagcuccuucugaugaggacaaguugggccuugugcgaagcgcugacccucgccacaggcccaauuacgacccugugggaggguagccccggcaaguuuuggaacacuacaaucgcagugucgauggcuaauauauuccgggggucuuauuuagccggagcaggccuugcuuuuuccauuaugaaaagcguagggaccggacgaagaggcacugguucacagggggaaacacugggagagaaguggaaaaagaagcucaaccaacuaagucgcaaagaguucgaucuguacaagaaaucuggcaucaccgagguggacaggacggaggccaaggaagguuugaaacggggcgagaccacacaucacgccguuucccgugggagcgcgaagcugcagugguuuguggaaagaaauauggucauuccugagggaagggugaucgaucucggcugugggcgcggaggcuggucauauuacugcgcuggucuuaaaaaggucacugaagugcggggguauaccaagggaggcccgggccaugaggagcccguuccaaugaguacauacggguggaacauaguaaaacugaugagcggaaaggacguguucuacuugccucccgaaaaaugugauacucugcucugcgacaucggugaguccucuccuagcccaaccgucgaagagucccgaacaauuagaguguuaaagaugguugagcccuggcugaaaaauaaccaguucuguaucaaggugcuuaauccuuauaugccaaccgucauugaacaccuggagaggcuacagcgcaaguacggcgggaugcucgugcggaacccccugucaagaaauucuacucacgaaauguauuggaucaguaacggaacgggcaauauuguaucgagcgugaacaugguuucccguuugcugcucaauagguuuacaaugacccaucggcgcccgacuaucgagaaagaugucgaccuuggugcagggacccgacacgugaacgccgaaccugagacaccaaacauggacgugauaggagagagaauuaagaggaucaaagaagaacacucuucaacguggcacuacgaugacgaaaaucccuauaagaccugggcuuaccacggcagcuaugaggucaaagccacuggcuccgcaaguucuaugaucaacgggguugugaagcuguuaacaaagccuugggauguagugccaauggucacccaaauggccaugacugacacaacccccuucggacagcagcggguguuuaaagaaaagguugauacacgcacuccgagaccuaugcccgguaccaggaaagugauggagauuacggcugaguggcuguggcgaaccuugggccggaauaagaaaccacgucucugcacaagagaagaguucacuaagaagguccgcaccaacgcggccaugggggcaguguuuacagaagagaaucaaugggacagcgcuagggccgcaguagaagaugaggaguucuggaaacugguugaccgggaaagagagcuacauaaacuuggaaaauguggcucaugcguguacaacaugauggguaagcgcgagaagaagcugggggaguuuggaaaagccaagggcuccagggcuauaugguacauguggcucggcgcccgauaucuggaguucgaagcguugggguuucugaaugaggaucacugguucagucgggaaaacagcuacucuggagucgagggugaaggccuccauaaacuuggguauauccugagagacauuuccaaaaucccuggaggcgcaauguacgccgaugacacugcugguugggacaccaggauuacggaggaugacuuacacaaugaggaaaagaucacacagcagauggaucccgagcaucgccagcuggccaacgcaauauuuaaauugaccuaucaaaauaagguggugaaaguccagcguccaacucccaaggggacaguuauggacaucauuucacggaaggaucagagaggaagcggccaggugggcaccuacgggcucaacacuuucaccaauauggaagcucaacugguaaggcagauggagggagaaggugugcuaucgaaagccgaccuugagaacccucaucugcucgagaagaaaaucacacaguggcuggaaacgaagggcgucgagcgcuugaaacgaauggcuauuucuggggaugacugcgugguuaagccaaucgaugaccgguuugccaaugcauuacuggcgcucaacgauaugggaaaggugagaaaagacauaccgcaguggcaacccaguaagggcuggcacgauuggcagcaggucccuuucuguucccaucacuuccaugaacuuauuaugaaagacgguaggaagcuggugguaccaugccgcccccaggacgagcuaaucgggagagcccggaucagccaaggagcuggcuggucacugaaagaaaccgccugucucggcaaggcauaugcucagaugugguccuugauguacuuucacaggcgugaucugcgacuugccucuaacgcaauuugcagcgccguuccugugcacuggauaccaacaagucgcacaaccugguccauccaugcgcaccaucaguggaugacuacagaggacaugcugaccgucuggaauagaguguggauugaggauaaccccuggauggaagacaagacgccuguuacaaccugggaggaugugccguaccucgggaaacgggaagaccaaugguguggcagcuuaaucggucugacuucuagggcuaccugggcccagaauauuuugacagcaauccagcagguccgcucacugauaggcgaugaggaguuccucgacuauaugccaaguaugaagagauuucggaaagaagaggaauccgagggggccaucugguga

SEQ ID NO: 15566 - RNA, 9873 nt, Artificial Sequence
  derived and/or modified CDS sequence (opt3) from DENV-3__EU482457__SS-prME
accagcuucugccugaugaugaugcuccccgccacacuugcuuuucaccugacuuccagagacggcgagccuaggaugaucguggggaagaacgaacggggaaaaucuuuguuauucaagacggcaucagguauuaauauguguacccugauagccauggaucuaggcgagaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuacuuugccagaggaacaggaccagaauuaugucuguaaacacaccuacguugaucgcgguugggggaacggaugcggccucuuuggcaaggggagucuggugacaugcgccaaguuccaauguuuagagcccaucgagggaaaaguagugcaguaugaaaaucugaaguacacugucauaauuaccgugcacacaggugaccagcaucagguuggcaacgacacccaaggggugacugucgagaucacgccucaggcauccacaguggaagcuguacucccagaguauggaauucuuggccuggaaugcucuccgcgaaccgguuuggauuuuaaugagaugauccuacugacuaugaaaaacaaggccuggaugguucacagacagugguucuuugaccucccccugccuuggaccagcggggcgacaaccgagacuccaacauggaauaggaaagaacuucuggugacguucaagaacgcccaugcaaaaaagcaagaggucguggucuugggcucccaggaaggagcuaugcacaccgcccucacuggcgcuacagagauccagaauucagggggaaccaguauuuuugccggucaccugaagugucgguuaaaaauggaucgucuggaacuaaagggcaugagcuacgcaaugugccucaacacauucgugcugaaaaaggagguuucugagacucagcaugggaccauacuuaucaaaguggaauacaagggagaggacgcccccuguaagauuccuuucuccacggaagauggccaagguaaagcucacaacgggcgcuugaucaccgcgaauccaguagucacaaagaaagaggagcccgugaacauagaagcagagccgccuuuuggcgaaucaaauauuguuaucggaaucggcgacaaggcccugaaaauuaacugguauaagaaggggagcaguaucggaaaaauguucgaggcuacugccagaggugcaaggcggauggccauucucggcgauaccgcuugggacuuugggucugugggaggcguccugaauucccuugguaagauggugcaucagauauucgggagcgccuacacagcacuguuuucgggcguaucuuggaucaugaaaauuggaaucggcguguugcucacuuggaucgggcugaacuccaagaauaccucaaugaguuucagcugcauuguuauaggaaucauuacguuauaucugggcgcggucgugcaggcugauauggguugugugaucaacuggaaagggaaggaacuaaagugcggauccggcauuuuugucacaaaugagguucacaccuggacugagcaguacaaauuccaagccgacucucccaagcgacucgcaacagccaucgcuggugccugggaaaacggcgugugugggauacgcagcaccacuagaauggagaaucugcuuuggaaacagaucgcaaacgaauugaauuauauucugugggagaacaauaucaagcucaccgugguagucggagauacaauuggcgugcuggaacaggggaaaaggacguuaaccccacagccuauggagcugaaguacucauggaaaacuuggggaaaggcuaagaucguuacagccgagacccaaaacaguuccuuuauaauugacggccccaacacaccagaaugccccagcgcgucucgggccuggaaugugugggaggucgaagacuaugguuucgggguguuuacuaccaacaucuggcuuaaauugcgcgagguuuacacgcagucaugugaucauagacucaugagugcugcaauuaaggacgaaagggccgugcacgcugauaugggauacuggaucgagagccagaaaaauggcuccuggaagcuggagaaagccucuuucauagaaguaaagacaugcaccuggccuaagucgcacacucuauggagcaacgguguccuggaguccgacaugaucauuccaaaaucacucgcaggcccgaucagucagcauaaucaccgucccggguaucauacccaaacagcgggaccuuggcaccugggcaagcuugaauuggauuuuaacuacugcgaggggacuaccguggugauuacagagaauuguggaacgcggggcccaucucugcgaaccacuacagucagcgguaaauuaauccacgaauggugcuguagauccugcacccuccccccucugagguauaugggggaggacggauguugguacggcauggaaauacgcccaauuaacgagaaggaagagaauaugguuaaaucacuugugagcgccgguucuggcaagguagauaacuucacuaugggggugcugugcuuggcuauccucuucgaggaagucaugcggggaaaguuuggcaaaaagcauaugaucgccggggugcuguucacauuuguucuacugcucuccggacagauuaccuggagagacauggcacacacgcugaucaugauuggcaguaaugcuagcgauaggauggguaugggggugacuuaucuugccuugauagcaaccuucaaaauccagcccuuucuggccuuaggauucuuucuccgcaagcugacaucucgagagaaccuucugcuaggcgucggccucgcuauggcgaccacucugcaauugccggaagacauugagcagauggccaaugggaucgcacugggauuaaugacacucaaacugauuacccaguucgaaacauaccagcuuuggacugcucugguguccuugaccuguucaaacacgaucuuuacacucaccguugccuggcggacugccacccugauacuagcuggugugagucugcuuccucucugccaaagcucguccaugcguaagacagauuggcugccaaugacugucgcagccaugggcguacccccuuugccccuguucaucuuuucuuuaaaggacaccccaaaaagaaggagcuggccucucaaugagggggugauggcgguuggacuggugucaauucuugcuaguucccuguugcgcaacgauguccccauggccggcccacucguggcaggugggcugcuaaucgccuguuauguaauuacgggaacaucugcugaccugaccguggagaaggcagccgacgucacuugggaagaggaagcggagcagacaggcguuagccauaaccuuauggugaccguggaugacgauggcacuaugcggaucaaagacgaugaaacagagaauauacucaccguccuguugaagacggcuuuacugauuguguccgggaucuucccguacucaaucccugccacucuccugguuuggcacaccuggcagaaacagacacaaagaagcggaguacuuugggacgugcccaguccacccgagacccagaaggcagaacuggaggaaggugucuacaggauuaaacagcagggcauauuugggaagacacaagugggaguuggcgugcagaaggagggugucuuccauacuauguggcacgugacccgaggggccguauugacgcacaacggaaaacgccuagagccuaauugggcuucugucaagaaagaucugaucuccuauggcggcggguggcggcucagcgcccaguggcaaaagggagaagaggugcagguuauugcaguggaaccagguaaaaaccccaagaauuuccagacaaugccuggcaucuuucagacuaccacaggggagauuggagcuaucgcccuggacuucaagccgggcaccucggguucaccaauaaucaacagagaagggaaagucgugggacuuuacggcaauggcguugugacuaagaacgggggauaugucucugguauugcgcaaaccaaugccgagcccgauggcccuacaccagaguuagaagaggaaauguuuaaaaagaggaaccugacgaucauggaccuccaucccgggaguggaaaaacucguaaguacuugccugcaauugugcgcgaggcuaucaagcggagacugaggacccucauacuggccccgacacgaguaguggcugcagaaauggaggaggcccuuaaaggccugcccauucgguaucagaccacugccacaaaguccgaacacaccggucgcgagaucguugauuugaugugccaugcuacguucacuaugagacuacugagcccagucagggugccuaauuacaaccucaucauuauggacgaagcgcacuuuacagaucccgcaucuaucgccgcucggggguauauaagcacccgagugggaaugggcgaggccgcagccauuuucaugaccgcuacuccaccuggcacagcggaagccuuuccccaguccaaugcaccaauccaggacgaggagagagacauuccggaacgcucauggaacagugggaaugaguggaucaccgauuucgucggaaaaacaguaugguuugugccuagcauaaaggcugguaacgacauugccaacuguuuaaggaaaaauggcaagaagguuauccaacugucucguaaaacuuucgauacggaauaccagaagacccggcuuaacgacugggauuuuguggucacaacugacaucuccgagaugggggcaaauuucaaagccgauagagugauugaccccaggcgcugccugaagccaguuauccucaccgauggacccgagcgagugauuuuggcuggcccuaugccagucacagccgcgucagcagcccagagacgggguaggguggggcgcaacccccagaaagaaaaugaccaauacauauucaccggccagccucugaacaaugaugaggaccaugcucacuggacugaagccaagaugcuccuggacaacaucaauacgccggagggaauuaucccagcucuuuuuggccccgaacgugagaagagugcagccaucgauggggaguauagacuaaaaggagaaagccggaagaccuucguagagcugaugaggcgcggugacuugccugugugguuagcuuacaaaguugccuccgaaggcauuaaguauacagaucgaaaauggugcuuugacggggagagaaacaaucagauacuggaagagaacauggaugucgagaucuggacuaaggaaggagagcggaaaaagcucaggccccgcuggcuggacgcaagaaccuacucugauccacuugcgcugaaggaauucaaagacuuugccgcuggcaggaagucgauugcccucgauuuggugacagagaucggucgggugccuagccaccuggcacaucguacccgcaaugcucuagacaaccuggucaugcuccacacuucagaacaugggggccgagccuauagacacgcaguugaggagcuucccgaaacaauggagacgcuguuauugcugggacucaugauucugcuuaccggcggggccaugcuguuccucaucuccggaaaagguauaggcaagacuaguaucggguugauuugugugaucguaucuagcggaaugcuguggauggcugaugugccauuacaguggauugcguccgccaucguccuagaauuuuucaugauggugcugcucauaccugagccggagaaacaaaggacaccccaggacaaucagcuugcauacguugugauuggcauccugaccuuggcugccauugucgccgcaaacgaaaugggucugcucgagaccacaaagcgggaucuggggaugucaaaggaaccaggcguagugucuccuacuagcuaucuugacguugaccuccaccccgcuagugccuggacgcuguacgcgguggcuaccacagucaucacuccaauguugcgccauaccauagagaauuccacagccaacgugagccuggcagccaucgcuaaccaagcagucguguuaaugggacuagauaaaggcuggccuauuucuaagauggaccuggggguuccccuccuugcccugggaugcuacucacaggugaauccguugacccugacugcggcuguacuccugcuugugacgcacuaugccaucauuggcccagguuuacaggcaaaagccacaagagaagcucagaagaggaccgccgcagggaucaugaaaaacccuacugucgauggaauaaugaccauugaccuggaucccguuaucuacgacuccaaguuugagaagcaacucggccaggugauguugcugguccuaugugcugugcagcugcuccuuaugcggacaaguugggcccugugcgaggcguugacucuggccaccgguccaaucacaacgcucugggaaggcagccccgggaaauucuggaauaccacuauugcaguaucgauggcuaacaucuuucgaggaucuuaucuggccggcgcaggguuagcuuucuccauaaugaagagcgugggaacaggcagacgcgguaccgggucacagggagagacucuuggcgaaaaauggaagaaaaagcugaaucaacucaguaggaaggaguuugaucuauacaaaaagucugguauuacagaaguugaccggaccgaggccaaagagggccugaagcguggggaaacgacccaucacgccguguccagaggaagcgcgaaauugcagugguucgucgagaggaacauggugaucccugaaggccgcgucauugaucugggguguggacggggcgguuggucauauuacugcgcugggcucaagaaagugacagagguucgaggauauacuaagggcggcccggggcaugaagagcccguaccaaugaguaccuacggauggaauaucgugaagcuuaugagcgguaaagacgucuucuaccugccucccgagaagugugauacauugcugugcgacauaggcgaauccucuccuagcccaacuguggaggaauccagaaccaucaggguucucaaaaugguggagcccugguuaaagaacaaucaguuuuguauuaaaguccugaacccuuauaugccaacagugaucgagcaccuugaacgccugcagcggaaguacgggggaaugcuaguaagaaauccccucucacguaacucuacccacgagauguauuggauuaguaauggcacugguaacaucgugucgagcguuaauauggucuccaggcuguugcugaaccgguucacgaugacacaucgccgaccgaccauugaaaaggauguggaccucggggcaggaacuagacacgugaacgccgagccugaaaccccaaauauggacgucaucggcgagaggauaaaacggauuaaggaggaacauucuucaacauggcacuacgaugacgagaaccccuauaaaacgugggcuuaccacggcagcuaugaaguuaaggccaccggguccgcaaguucuaugaucaauggagugguaaaacuucugacuaagccuugggauguggucccaauggugacacaaauggccaugaccgacacuacacccuuuggucagcagcgcguuuucaaggagaaaguggauaccagaacaccgaggccuaugcccggcacucgaaaggucauggaaaucaccgcugagugguuauggcggacgcuggggcguaacaaaaagccaagauugugcacccgcgaggaauuuacaaaaaaggugaggacuaaugcggccaugggagcaguauucaccgaggaaaaccaaugggacaaugcucgggccgcaguugaggaugaagaguuuuggaagcucguggacagagagcgcgaacugcauaaacuaggcaagugugguagcugcgucuacaacaugauggggaaaagggagaagaaacuuggagaauucggcaaggccaaaggcucacgagcuauuugguacauguggcugggggcccgguaucucgaguuugaggcgcugggauucuugaaugaagaucacugguuuuccagagagaacaguuacagcgguguggaaggcgaggggcugcauaagcucggauauauacuuagggacaucucuaagauuccuggcggugcaauguacgccgaugacacagcugggugggacacucgcaucaccgaagaugaccugcacaaugaggagaaaauuacgcagcagauggaucccgaacaucgucaguuagccaacgcaaucuucaagcugacauaucaaaauaaaguggucaagguucagcggccaacccccaaaggaacugugauggacauaaucuccagaaaggaucagaggggcucaggccagguagggacauacggauugaacaccuuuacuaauauggaggcucaacucgugcgccagauggaaggugagggcguccugagcaaggccgaccuagaaaacccucaccuucuggagaaaaagauuacccaguggcucgagacaaaagggguggaacgacugaagcggauggcuaucucgggagaugacugcguugugaaaccaauugaugacagauucgccaacgcauuguuagcgcugaaugauaugggcaaggucaggaaggacaucccgcaguggcaacccucuaaagguuggcacgauuggcagcaggugccuuucuguagucaucacuuucaugagcucauaaugaaggacgggcgcaaacuuguaguuccaugcagaccccaggacgaacugauuggacgggccaggaucucccaaggcgcuggcuggagccuaaaggagacggccugucuggggaaagcauaugcucagauguggucacucauguacuuccaccgucgagauuugcgccuggccuccaacgcaaucugcucugccgugccuguccacuggauuccaaccagcagaacuacauggaguauacaugcgcaccaucaguggaugaccacugaagacaugcuuacaguguggaaucggguuuggaucgaggauaaccccuggauggaggacaagaccccugugacgacaugggaagaugucccguaccugggaaagagggaggaccaauggugugguucccucauuggcuuaaccagccgcgcuacuugggcccagaauauccugaccgcaauucagcaggugagaucuuugaucggggaugaagaguuucuggacuauaugccaucaaugaaacgguucaggaaggaggaagagagugaaggagccauaugguga

SEQ ID NO: 15567 - RNA, 9873 nt, Artificial Sequence
  derived and/or modified CDS sequence (opt3) from DENV-3__EU482458__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguugacgaccuuuaagaacgcccaugcaaaaaagcaagagguggucgugcucggcucccaggaaggagcuaugcacacugcccugacaggcgcuaccgagauccagaauucagggggaacaaguauuuucgccggucacuuaaagugucggcugaaaauggauaagcuagaacucaaaggcaugagcuacgcaaugugccugaacacuuuuguccuuaagaaagaggugucugagacccagcaugggacgauauugaucaagguugaauacaagggagaggacgcccccuguaaaauuccuuucuccaccgaagauggccaagguaaggcucacaacgggcgucugaucacagcgaauccagugguaacuaaaaaggaggagcccgucaacauagaagcagagccgccuuucggcgaaucaaauauugugaucggaaucggcgacaaagcccucaagauuaacugguauaagaaagggagcaguaucggaaagauguuugaggcuaccgcccgcggugcaagaaggauggccauucugggcgauacagcuugggacuucgggucuguuggaggcgugcuuaauucccuggguaaaaugguccaucagauauuugggagcgccuacacugcauuguucucgggcgugucuuggaucaugaagauuggaaucggcguacuccugaccuggaucggguuaaacuccaaaaauacgucaaugaguuuuagcugcauugugauaggaaucauuacacuguaucuaggcgcgguuguccaggcugauauggguugugccaucaacuggaaggggaaggaacucaaaugcggauccggcauuuucgugaccaaugaggugcacacuuggacagagcaguacaaguuucaagcagacucucccaaacggcuggccaccgcuaucgccggugcaugggaaaacggcgucugugggauacgaagcacuacccgcauggagaaucuuuuguggaagcagaucgcuaacgaacugaauuauauucucugggagaacaauaucaaacugacaguuguggugggagauauuaucggcguauuagaacaggggaagagaacgcugaccccacagccuauggagcuuaaauacucauggaagacuuggggaaaggccaaaauagucacagcggagacccaaaacaguuccuucauuaucgacggccccaacacaccagaaugccccagcgccucuagggcuuggaaugugugggagguugaagacuaugguuuugggguguucacuaccaacauuugguugaagcuccgggaggucuacacgcagucaugugaucaucgccugaugagugcagccaucaaagacgaaagagcugugcacgccgauaugggauacuggauagagagccagaagaauggcuccuggaaacuagagaaggcaucuuuuaucgaaguuaagacaugcaccuggccuaaaucgcacacucuguggagcaacggugugcucgaguccgacaugauuaucccaaagucacuggcgggcccgauuagucagcauaaucacaggcccggguaucauacccaaacagccggaccuuggcaccuuggcaaauuggaacuggauuucaacuacugcgaggggacuaccguagucaucacagagaauuguggaaugcguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggugaagucacuggucagcgcugguucuggcaagguugauaacuuuaccauggggguguugugccucgccauccuguucgaggaaguaaugcgcggaaaauucggcaagaaacauaugauugcaggggugcuauuuacuuucguccugcuccuguccggacagaucacauggcgggacauggcucacacccuuauuaugauaggcaguaaugccagcgauagaauggguaugggggugacguauuuggcacugaucgccacuuuuaagauucagcccuucuuagcucucggauuuuuccugaggaaacuuaccucucgcgagaaccugcuacucggcguuggccuggcgauggccacaaccuugcaacugccggaagacaucgagcagauggcaaaugggauugcuuuaggacucaugacucugaagcuuaucacacaguuugaaaccuaccagcuguggacagccuuggugucccucacuuguucaaacaccauauucacgcugacagucgccuggcgaaccgcuacucuaauccuggcaggugugagucuucucccucugugccaaagcucguccaugcggaagaccgauugguugccaaugacaguugccgcgaugggcgugcccccucugcccuuauuuauuuucucucucaaagacacuccaaagcguagaagcuggccucugaaugagggggucauggcuguaggacuugugucaauccuggccaguuccuugcucaggaacgauguucccauggcaggcccacugguggccggugggcuacugauugcuuguuaugucaucaccggaacgucugcagaccuuacaguggagaaagccgcggacguaaccugggaagaggaagcugagcagacuggcgugagccauaaccucaugauaacagucgaugacgauggcaccaugcgcauuaaggacgaugaaacugagaauauccugacaguuuuguuaaaaaccgcccugcucaucguguccgggauuuuuccguacucaauaccugcaacgcugcuuguguggcacacuuggcagaagcagacccaacggagcggaguccugugggacgugcccaguccacccgagacacagaaagccgaauuggaggaagguguuuacagaaucaagcagcagggcauuuucgggaagacccaaguaggagugggcguccagaaagaggguguguuucauacaauguggcacguuacuaggggggcugugcuaacccacaacggaaagcgacuggagccuaauugggccucugucaaaaaggaucucaucuccuauggcggcggguggcgccugagcgcacaguggcaaaaaggagaagaggugcagguaauugcugucgaaccagguaagaaccccaagaauuuccagacgaugccuggcaucuuccagacaacuaccggggagauaggagccaucgcgcuugacuuuaaaccgggcacaucggguucaccaauuaucaaccgggaagggaaggugguuggauuauacggcaauggcguggucaccaaaaacgggggauaugugucugguauugcccaaacuaaugcagagcccgauggcccuaccccagagcuggaagaggaaauguucaagaaaagaaaccucacaaucauggacuugcaucccgggaguggaaagacgaggaaguaccugccugcuauaguucgugaggccauuaaacgccggcucagaacucugauccuugcuccgaccaggguggucgcagccgaaauggaggaggcccugaagggcuugcccauccgauaucagacaaccgcuacuaaauccgaacacacaggucgggagauuguggaucuaaugugccaugcgaccuuuacgaugcgccugcucagcccaguaagagugccuaauuacaacuuaaucauaauggacgaagcacacuucacugaucccgccucuauugcugccaggggguauaucagcacacggguuggaaugggcgaggcagccgcuauuuuuaugaccgcgaccccaccuggcacugccgaagcauucccccaguccaaugcuccaauccaggacgaggagcgagacauaccggaaagaucauggaacagugggaaugaguggauuacagauuuugucggaaagaccgugugguucgugccuagcaucaaagccgguaacgacaucgcaaacugucugcgcaagaauggcaagaaagucauucaacuuucuaggaagacauuugauacugaauaccagaaaacgcgucugaacgacugggauuucguagugaccacagacaucuccgagaugggggccaauuuuaaggcugaucggguuauugaccccagaaggugccucaaaccagugauauugacugauggacccgagcgcgucauccuggccggcccuaugccagugaccgcggcaucagccgcucagcgaagaggucggguugggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuuguggaauugaugcggaggggagacuuaccugucuggcuggcccacaagguggcauccgaggguaucaaauacaccgaucgcaaguggugcuucgacggcgaacgaaacaaucagauucucgaggagaacauggauguagaaaucuggacaaaagagggggaaagaaagaagcugcggcccagguggcuugacgcgcgcacuuauucugauccacuggcccucaaagaguuuaaggacuucgcugccggaagaaaaucgauugcauuggaucuggugaccgaaaucggcaggguuccuagccaucuagcuuaccggacacguaaugcccuggacaaccucgucaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugugaucgucucuagcgggauguuauggauggcggauguuccacuacaguggauagccuccgcaauugugcuggaguucuuuaugaugguacuccuuaucccugagccggaaaagcaaagaacuccccaggacaaucagcuggcuuacguggucauuggaaucuugacacuggccgccauaguggcagcuaacgagaugggccuccuggaaaccaccaagagggaucuugguaugucaaaagagccagggguugugucuccuacaagcuaucucgacgucgaccugcaccccgccagugcguggacuuuguacgcuguagccacgaccgugaucacaccaaugcugcggcauacuauugaaaauuccaccgcaaacguuagcuuagccgcuaucgcaaaccaagccgugguccuaaugggccuggauaagggauggccuauuucuaaaauggaccucggcgugccccuucuggcguuggggugcuacucacaggucaauccgcugacacucaccgcugccgugcugcuuuuaguuacucacuaugcaaucauaggaccaggccugcaggccaaggcuacgcgcgaggcccagaaaagaacagcagcugguauuaugaagaacccuaccguggaugggaucaugacuaucgaccucgaucccguaauuuacgacuccaaguucgagaaacaauugggacaggugaugcugcuaguccugugugccguucagcuccuucugaugaggaccaguugggcguugugcgaagcccugacacucgcaacuggcccaaucaccacacugugggaggguagccccggcaaguuuuggaauacgaccauagcugugucgauggccaacauuuuccgggggucuuauuuagcaggagcuggccuugccuuuuccaucaugaaaagcgucgggacuggacgaagaggcacagguucacagggggaaacccugggagagaaguggaaaaagaagcucaaucaacuaagucgcaaagaauucgaucuguacaagaaaucuggcauuacugagguggacaggacagaggccaaggaagguuugaaacggggcgagaccacgcaucacgcgguaucccgugggagcgcuaagcugcagugguuuguggaaagaaacaugguuaucccugagggaagggugauagaucucggcugugggcgcggaggcuggucauauuacugcgcaggucuuaaaaaggucaccgaagugcggggguauacaaagggaggcccgggccaugaggagcccgucccaaugaguacuuacggguggaauaucgugaaacugaugagcggaaaggacguuuucuacuugccucccgaaaaaugugauacccugcucugcgacauuggugaguccucuccuagcccaacaguagaagagucccgaacuaucagaguguuaaagauggucgagcccuggcugaaaaacaaucaguucuguauuaaggugcuuaacccuuauaugccaaccguuaucgaacaccuggagaggcuacagcgcaaguacggcgggaugcucgugcggaauccccugucaagaaacucuacacacgaaauguauuggauuaguaauggaaccggcaacaucgucucgagcgugaauaugguaucccguuugcugcucaacagguuuacuaugacgcaucggcgcccgacaauagagaaagauguggaccuuggugccgggacccgacacguuaacgcugaaccugagacuccaaauauggacgucauuggagagagaaucaagaggaucaaagaagagcauucuucaaccuggcacuacgaugacgaaaaccccuauaagacaugggccuaccacggcagcuaugaggugaaagcaacgggcuccgccaguucuaugauuaaugggguggucaagcuguuaaccaagccuugggauguugugccaaugguaacucaaauggcuaugacagacaccacucccuucggacagcagcggguguuuaaagaaaaggucgauacacgcaccccgagaccuaugcccgguacaaggaaagugauggagauaacugcggaguggcuguggcgaaccuugggccggaacaagaaaccacgucucugcacgagagaagaguucaccaagaagguucgcacaaaugccgcaaugggggcuguguuuacugaagagaaccaaugggacagcgccagggcagccgucgaagaugaggaguucuggaaacugguggaccgggaaagagagcuacauaagcuuggaaaauguggcucaugcguauacaauaugauggguaagcgcgaaaaaaagcugggggaguuuggaaaagcuaagggcuccagggccaucugguacauguggcucggcgcgcgauaucuggaguucgaagcauugggguuucugaacgaggaucacugguucagucgggaaaauagcuacucuggaguugagggugaaggccuccauaagcuuggguauauucugagagacaucuccaaaauuccuggaggcgccauguacgcugaugacaccgccgguugggacacaaggaucacugaggaugacuuacacaacgaggaaaagauaacccagcagauggaucccgagcaucgccagcuggcaaaugcuaucuuuaaauugacguaucaaaacaagguggucaaagugcagcguccaacacccaaggggaccgugauggacauuaucucacggaaggaucagagaggaagcggccaggucggcacuuacgggcucaauacauucaccaacauggaagcccaacugguuaggcagauggagggagaaggugugcuaucgaaagcugaccuugagaauccucaccugcucgagaagaaaauuacucaguggcuggaaaccaagggcguagagcgcuugaaacgaauggccaucucuggggaugacugcguggucaagccaauagaugaccgguuugcaaacgcguuacuggcccucaacgauaugggaaaggugagaaaagacauuccgcaguggcaacccaguaagggcuggcacgauuggcagcagguuccuuucuguucccaucacuuccaugaacuuaucaugaaagacgguaggaagcugguggucccaugccgcccccaggacgagcuaaucgggagagcucggauuagccaaggagccggcuggucacugaaagaaacagcaugucucggcaaggcuuaugcccagaugugguccuugauguacuuucacaggcgugaucugcgacuugcaucuaaugccauaugcagcgcggugccuguacacuggaucccaacgagucgcaccacuugguccauucaugcucaccaucaguggaugacaaccgaggacaugcugacuguuuggaacagaguguggaucgaggauaaucccuggauggaagacaagacaccuauuaccacgugggaggaugucccguaccucgggaaacgggaagaccaaugguguggaagcuuaaucggucugacaucuagggccaccugggcacagaacauauugacugccauccagcaggugcgcucacugauuggcgaugaggaguuccucgacuauaugccaaguaugaagagauuucggaaagaagaggaauccgagggggcuaucugguga

SEQ ID NO: 15568 - RNA, 9873 nt, Artificial Sequence
  derived and/or modified CDS sequence (opt3) from DENV-3__EU482459__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcgcacaguggcaaaaaggagaagagguacaggucauugcuguggaaccagguaagaaccccaagaauuuccagacgaugccuggcaucuuccagacaacuaccggggagauaggagccaucgcgcuugacuuuaaaccgggcacaucggguucaccaauuaucaaccgggaagggaagguugugggauuauacggcaauggcgucgugaccaaaaacgggggauauguuucugguauugcccaaacuaaugcagagcccgauggcccuaccccagagcuggaagaggaaauguucaagaaaagaaaccucacaaucauggacuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaucuaaugugccaugcgaccuuuacgaugcgccugcucagcccagugagaguuccuaauuacaacuuaaucauaauggacgaagcacacuucacugaucccgccucuauugcugccaggggguauaucagcacacgggucggaaugggcgaggcagccgcuauuuuuaugaccgcgaccccaccuggcacugccgaagcauucccccaguccaaugcuccaauccaggacgaggagcgagacauaccggaaagaucauggaacagugggaaugaguggauuacagauuuugugggaaagaccgugugguucgucccuagcaucaaagccgguaacgacaucgcaaacugucugcgcaagaauggcaagaaaguaauucaacuuucuaggaagacauuugauacugaauaccagaaaacgcgucugaacgacugggauuucgugguuaccacagacaucuccgagaugggggccaauuuuaaggcugaucgggugauugaccccagaaggugccucaaaccagucauauugacugauggacccgagcgcgugauccuggccggcccuaugccaguuaccgcggcaucagccgcucagcgaagaggucggguggggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuugucgaauugaugcggaggggagacuuaccuguguggcuggcccacaagguagcauccgaggguaucaaauacaccgaucgcaaguggugcuucgacggcgaacgaaacaaucagauucucgaggagaacauggauguggaaaucuggacaaaagagggggaaagaaagaagcugcggcccagguggcuugacgcgcgcacuuauucugauccacuggcccucaaagaguuuaaggacuucgcugccggaagaaaaucgauugcauuggaucugguuaccgaaaucggcagggucccuagccaucuagcuuaccggacacguaaugcccuggacaaccucgugaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggaugugccacuacaguggauagccuccgcaauuguacuggaguucuuuaugauggugcuccuuaucccugagccggaaaagcaaagaacuccccaggacaaucagcuggcuuacgucgugauuggaaucuugacacuggccgccauaguugcagcuaacgagaugggccuccuggaaaccaccaagagggaucuugguaugucaaaagagccagggguggucucuccuacaagcuaucucgacguagaccugcaccccgccagugcguggacuuuguacgcuguggccacgaccguuaucacaccaaugcugcggcauacuauugaaaauuccaccgcaaacgugagcuuagccgcuaucgcaaaccaagccgucgugcuaaugggccuggauaagggauggccuauuucuaaaauggaccucggcgucccccuucuggcguuggggugcuacucacaggugaauccgcugacacucaccgcugccguucugcuuuuagugacucacuaugcaaucauaggaccaggccugcaggccaaggcuacgcgcgaggcccagaaaagaacagcagcugguauuaugaagaacccuaccguagaugggaucaugacuaucgaccucgaucccgugauuuacgacuccaaguucgagaaacaauugggacaggucaugcugcuaguucugugugccgugcagcuccuucugaugaggaccaguugggcguugugcgaagcccugacacucgcaacuggcccaaucaccacacugugggaggguagccccggcaaguuuuggaauacgaccauagcugucucgauggccaacauuuuccgggggucuuauuuagcaggagcuggccuugccuuuuccaucaugaaaagcguggggacuggacgaagaggcacagguucacagggggaaacccugggagagaaguggaaaaagaagcucaaucaacuaagucgcaaagaauucgaucuguacaagaaaucuggcauuacugagguagacaggacagaggccaaggaagguuugaaacggggcgagaccacgcaucacgcggugucccgugggagcgcuaagcugcagugguuuguugaaagaaacauggugaucccugagggaagggucauagaucucggcugugggcgcggaggcuggucauauuacugcgcaggucuuaaaaaggugaccgaaguccggggguauacaaagggaggcccgggccaugaggagcccgugccaaugaguacuuacggguggaaucugguuaaauugaugagcggaaaggacguauucuaccugccucccgaaaaaugugauacccucuuaugcgacaucggugaguccucuccuagcccaacaguggaagagucccgaacuauuagaguccugaagaugguggagcccuggcuuaaaaacaaucaguucuguaucaagguucugaacccuuauaugccaaccgugauugaacaccuagagaggcuccagcgcaaguacggcgggaugcugguccggaaucccuugucaagaaacucuacacacgaaauguauuggaucaguaauggaaccggcaacauugugucgagcguaaauauggugucccgucugcuccuuaacagguuuacuaugacgcaucggcgcccgacaaucgagaaagauguugaccugggugccgggacccgacacgucaacgcugaaccugagacuccaaauauggacgugauaggagagagaauuaagaggaucaaagaagagcauucuucaaccuggcacuacgaugacgaaaaccccuauaagacaugggccuaccacggcagcuaugaggugaaagcaacgggcuccgccaguucuaugaucaauggggucguuaaguuacugaccaagccuugggaugugguaccaauggugacucaaauggcuaugacagacaccacucccuucggacagcagcgggucuuuaaagaaaagguggauacacgcaccccgagaccuaugcccgguacaaggaaaguuauggagauuacugcggagugguuguggcgaacccucggccggaacaagaaaccacgucugugcacgagagaagaguucaccaagaaggugcgcacaaaugccgcaaugggggcugucuuuacugaagagaaccaaugggacagcgccagggcagccguggaagaugaggaguucuggaaacuaguagaccgggaaagagagcuucauaagcugggaaaauguggcucaugcguuuacaauaugauggguaagcgcgaaaaaaagcucggggaguuuggaaaagcuaagggcuccagggccauaugguacauguggcugggcgcgcgauauuuggaguucgaagcacugggguuucucaacgaggaucacugguucagucgggaaaauagcuacucuggaguggagggugaaggccuucauaagcugggguauaucuuaagagacauuuccaaaaucccuggaggcgccauguacgcugaugacaccgccgguugggacacaaggauuacugaggaugaccugcacaacgaggaaaagaucacccagcagauggaucccgagcaucgccaguuggcaaaugcuauauuuaaacucacguaucaaaacaaggucgugaaagugcagcguccaacacccaaggggaccgucauggacaucauuucacggaaggaucagagaggaagcggccagguuggcacuuacgggcugaauacauucaccaacauggaagcccaacuagugaggcagauggagggagaagguguacuuucgaaagcugaccuggagaauccucaccuccuggagaagaaaaucacucagugguuggaaaccaagggcguggagcgcuuaaaacgaauggccauuucuggggaugacugcgucgugaagccaaucgaugaccgguuugcaaacgcgcugcucgcccuuaacgauaugggaaagguuagaaaagacauaccgcaguggcaacccaguaagggcuggcacgauuggcagcaggugccuuucuguucccaucacuuccaugaacugauuaugaaagacgguaggaagcuagucgugccaugccgcccccaggacgagcugaucgggagagcucggaucagccaaggagccggcuggucacucaaagaaacagcauguuugggcaaggcuuaugcccagauguggucccugauguacuuucacaggcgugaucuucgacuggcaucuaaugccauuugcagcgcgguaccuguucacuggauaccaacgagucgcaccacuugguccauccaugcucaccaucaguggaugacaaccgaggacaugcucacuguguggaacagagucuggauugaggauaaucccuggauggaagacaagacaccugugaccacgugggaggauguuccguacuuagggaaacgggaagaccaaugguguggaagccugaucgguuugacaucuagggccaccugggcacagaacauucugacugccauccagcaggugcgcucacucauaggcgaugaggaguuccuugacuauaugccaaguaugaagagauuucggaaagaagaggaauccgagggggcuaucugguga

SEQ ID NO: 15569 - RNA, 9873 nt, Artificial Sequence
  derived and/or modified CDS sequence (opt3) from DENV-3__EU482460__SS-prME
accagccugugccucaugaugaugcuucccgccacauucgcuuuucaccugacuuccagagacggcgagccuaggaugaucguggggaagaacgaacggggaaaaucuuuguuauucaagacggcaucagguauuaauauguguacccugauagccauggaucuaggcgagaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcccauagagggaaaaguagugcaguaugaaaaucugaaguacacagucauuaucacugugcacaccggugaccagcaucagguuggcaacgacacacaaggggugaccgucgagauuacuccucaggcauccacgguggaagcuguacucccagaguauggaacacuuggccuggaaugcucuccgcgaaccgguuuggauuuuaaugagaugauccuacugacuaugaaaaacaaggccuggaugguucacagacagugguucuuugaccucccccugccuuggaccagcgggacaaccacugagacaccaacguggaauaggaaagaacuucuggugaccuucaagaacgcgcaugccaaaaagcaagaggucguggucuugggcucccaggaaggagcaaugcacacugcucucacaggcgccaccgagauccagaauucagggggaacaaguauuuuugcuggucaccugaagugucgguuaaaaauggauaagcuggaacuaaaaggcaugagcuacgccaugugccucaacacuuucgugcugaagaaagagguuucugagacccagcaugggacgauacuuaucaagguggaauacaagggagaggacgcacccuguaaaauuccuuucuccaccgaagauggccaagguaaggcccacaacgggcguuugaucacagcuaauccaguagucacuaaaaaggaggagcccgugaacauagaagcggagccgccuuuuggcgaaucaaauauuguuaucggaaucggcgacaaagcacugaagauuaacugguauaagaaagggagcaguaucggaaagauguucgaggccaccgcucgcggugccagaaggauggcaauucucggcgauacagccugggacuuugggucugugggaggcguccugaauucccuugguaaaauggugcaucagauauucgggagcgcuuacacugcccuguuuucgggcguaucuuggaucaugaagauuggaaucggcguguugcucaccuggaucgggcugaacuccaaaaauacgucaaugaguuucagcugcauuguuauaggaaucauuacauuauaucugggcgcagucgugcaggcggauauggguugugcuaucaacuggaaggggaaggaacuaaaaugcggauccggcauuuuugugaccaaugagguccacacuuggacagagcaguaccgguuccaagccgacucucccaagcgacucgcaaccgccaucgcuggugccugggaaaacggcguuugugggauacgcagcacuaccagaauggagaaucugcuuuggaaacagaucgcaaacgaauugaauuauauucugugggagaacaauaucaagcucacaguggugguaggagauauuaucggcguccuggaacaggggaaaagggcuuuagccccacagccuauggagcugaaguacucauggaaaacguggggaaaggcgaagauagugaccgccgagacucaaaacaguuccuuuauuaucgacggccccaacacaccagaaugccccagcgcuucucgggcauggaauguuugggagguggaagacuaugguuucggggucuuuaccacaaacauuuggcuuaaauugcgcgagguguacacucagucaugugaucauagacucaugagugccgcuaucaaggacgaaagggccguucacgcagauaugggauacuggauagagagccagaaaaauggcuccuggaagcuggagaaagcgucuuucaucgaagugaagaccugcacguggccuaagucgcacacacuauggagcaacgguguacuggaguccgacaugauuaucccaaaaucacucgccggcccgauuagucagcauaaucaccgucccggguaucauacccaaacugcuggaccuuggcaccugggcaagcuugaauuggauuuuaacuacugcgaggggaccacagucgugaucacugagaauuguggaacccggggcccaucucugcgaacaacgaccgugagcgguaaauuaauacacgaauggugcuguagauccugcacucuccccccucugagguauaugggggaggacggauguugguacggcauggaaauucgcccaaucaacgagaaggaagagaauauggucaaaucacuuguuagcgccgguucuggcaagguggauaacuucacaauggggguacugugcuuggcaauccucuucgaggaagugaugcggggaaaguuuggcaaaaagcauaugauugcugggguccuguucaccuuugugcuacugcucuccggacagaucacuuggagagacauggcccacacacugauuaugauaggcaguaaugcaagcgauaggauggguauggggguuaccuaucuugccuugaucgcuacguucaaaauucagcccuuucuggcguuaggauucuuucuccgcaagcugacuucucgagagaaccuucugcuaggcgugggccucgccauggcaaccacacugcaauugccggaagacaucgagcagauggcuaaugggauugcccugggauuaaugacccucaaacugaucacucaguucgaaacauaccagcuuuggaccgcccuggucuccuugacauguucaaacacuauauuuacccucacgguggcuuggcggacagcaacccugauccuagccgguguuagucugcuuccucucugccaaagcucguccaugcguaagacugauuggcugccaaugaccguggcggcuaugggcguccccccuuugccccuguucauuuuuucuuuaaaggacacaccaaaaagaaggagcuggccucucaaugaggggguaauggccgugggacugguuucaauccuugcaaguucccuguugcgcaacgaugugcccauggccggcccacucgucgcuggugggcugcuaauugcauguuaugugaucacuggaaccucugccgaccugacgguagagaaggcggcugacgugacaugggaagaggaagccgagcagaccggcgucagccauaaccuuaugauaacuguugaugacgauggcacaaugcggauuaaagacgaugaaaccgagaauauccucacugugcuguugaagacagcauuacugaucguguccgggauuuucccguacucaauaccugccacccuccuggucuggcacacguggcagaaacagacucaaagaagcggagugcuuugggacguucccaguccacccgagacccagaaggcugaacuggaggaagguguauacaggaucaaacagcagggcauuuuugggaagacacaagugggagucggcgugcagaaggaggguguuuuccauaccauguggcacgugacacgaggggccgucuugacucacaacggaaaacgccuagagccuaauugggcaucugugaagaaagaucugaucuccuauggcggcggguggcggcucagcgcucaguggcaaaagggagaagagguacaggucauugccguggaaccagguaaaaaccccaagaauuuccagaccaugccuggcaucuuucagacgacaaugggggagauaggagcgaucgcccuggacuucaagccgggcacuucggguucaccaauuaucaacagagaagggaaaguugugggacuuuacggcaauggcgucgugaccaagaacgggggauauguuucugguauugcacaaacaaaugcugagcccgauggcccuaccccagaguuagaagaggaaauguuuaaaaagaggaaccugacuaucauggaccuccaucccgggaguggaaaaacccguaaguacuugccugccauagugcgcgaggcuauuaagcggagacugaggacacucauccuggcaccgacgcgagucguggccgccgaaauggaggaggcucuuaaaggccugcccauccgguaucagacuaccgcgacaaaguccgaacacaccggucgcgagauuguagauuugaugugccaugcaacuuucacaaugagacuacugagcccagugaggguuccuaauuacaaccucaucauaauggacgaagcccacuuuaccgaucccgcuucuauugccgcacggggguauaucagcacgcgagucggaaugggcgaggccgcugcgauuuucaugacugccacaccaccuggcaccgcagaagcuuuuccccaguccaaugccccaauccaggacgaggagagagacauaccggaacgcucauggaacagugggaaugaguggauuaccgauuucgugggaaaaacugugugguuugucccuagcaucaaggcagguaacgacaucgccaacuguuuaaggaaaaauggcaagaagguaauucaacugucucguaaaacauucgauaccgaauaccagaagacacggcuuaacgacugggauuuugugguuacuacggacaucuccgagaugggggcuaauuucaaagccgauagagugauugaccccaggcgcugccugaagccagucauacucaccgauggacccgagcgagugaucuuggcgggcccuaugccaguuacagcagccucagcugcccagagacgggguaggguggggcgcaacccccagaaagaaaaugaccaauacauuuucacuggccagccucugaacaaugaugaggaccaugcucacuggaccgaagcaaagaugcuccuggacaacaucaauacaccggagggaaucauuccagcccuuuuugaacccgagcgugagaagagugcugccauagauggcgaauauagacuaaaaggggagagccggaagaccuucgucgaacugaugaggcgcggagacuugccugugugguuagcacacaaaguagcguccgaggguaucaaguacacugaucgaaaauggugcuuugacggcgaaagaaacaaucagauucuggaggagaacauggauguggaaaucuggacgaaggagggggaacggaaaaagcucaggccccgcuggcuggacgccagaaccuauucugauccacuugcucugaaggaguucaaagacuuugccgcaggaaggaagucgauugcucucgauuugguuacagaaaucggccgggucccuagccaucuggccuaccguacucgcaaugcacuagacaaccuggugaugcuccacaccucagagcauggugggcgagccuauagacacgcuguggaggaacuucccgagacaauggaaacccuguuauugcugggccucaugauacugcuuacuggaggcgcgaugcuguuccucaucuccgggaaaggaauugguaagacaaguaucggcuugauuugugucaucguuucuagcgggaugcuguggauggccgaugugccauuacaguggauagcauccgcuauuguacuagaguuuuucaugauggugcugcucaucccugagccggaaaaacaaaggacgccccaggacaaucagcuugccuacgucgugauuggaauccugaccuuggccgcaauaguugcugccaacgagaugggccugcucgaaacuacaaagcgggaucuggguaugucaaaggagccagggguggucucuccuaccagcuaucuugacguagaccuccaccccgcgagugcuuggacccuguacgccguggcaacaacuguuaucacgccaauguugcgccauaccauugaaaauuccacagccaacgugagccuggcugcaaucgccaaccaagcggucguguuaaugggccuagauaaaggauggccuauuucuaagauggaccugggcgucccccuccuugcucuggggugcuacucacaggugaauccguugacucugaccgccgcaguucuccugcuugugacacacuaugccaucauaggaccaggcuuacaggcuaaagccaccagagaggcacagaagaggacugcugccgguauuaugaaaaacccuacgguagaugggaucaugacaaucgaccuggaucccgugauuuacgacccaaaguuugagaagcaacucggacaggucauguugcugguucuaugugcggugcagcugcuccuuaugcggaccuccugggcccugugcgaagcauugacucuggcuaccggccccaucacaacucucugggaggguaguccuggcaaauucuggaauaccacaauagccgucagcauggcaaacauuuuucgagggucguaucuggcuggagccggcuuagccuucucuaucaugaaguccguggggacgggaagacgcggcaccgguagccagggggaaacucuuggagagaaauggaagaaaaagcugaaucaacucucaaggaaggaauuugaucuauacaaaaagaguggcauuacagagguagaccggaccgaggcgaaagaaggucugaagcguggcgagacuacacaucacgcugugucuagaggguccgcaaaauugcagugguucguugaaaggaacauggugaucccggagggacgcgucauagaucugggcugugggcggggaggcuggagcuauuacugcgccggucucaagaaagugaccgaaguccgaggguauacgaagggaggccccggccaugaggagccagugccuaugucaaccuacggguggaauaucguuaagcuuaugaguggaaaagacguauucuaccugcccccugaaaagugugauacauugcugugcgacauuggugagagcuccccaucucccacuguggaagagagcagaaccaucaggguccucaaaaugguggagccuugguuaaagaacaaucaguuuuguauuaaaguucugaacccauauaugcccacagugaucgaacaccuugagcgccugcagcggaaguacggcgggaugcuagucagaaauccgcucucccguaacucaacucacgaaauguauuggauuucuaauggaaccggcaacaucgugaguucgguaaauauggugagcaggcuguugcugaaccgguucacaaugacccaucgccgaccuacuauagagaaggauguugaccucggugcugggacgagacacgucaacgccgaaccagagacacccaauauggacgugauuggagagaggaucaaacggaucaaggaagagcauuccucuaccuggcacuacgaugacgaaaacccuuauaaaacuugggcauaccacggcucauaugaggugaaggccaccggcagcgcuuccaguaugauuaauggggucguuaaacuucugacaaagccaugggaugugguacccauggugacgcaaauggcgaugaccgacacuacaccguuuggacagcagcgcgucuucaaggaaaaaguggauaccagaacuccuaggcccaugccagguacacgaaagguuauggagauaaccgccgagugguuauggcggacacugggccguaacaaaaagccuagauugugcacucgcgaagaguuuaccaaaaaggugaggacgaaugcagcuaugggggccgucuucaccgaagagaaccaaugggacucugcacgggccgcuguggaagaugaggaguuuuggaagcucguagacagagaacgcgagcugcauaaacuaggaaaguguggcagcugcguuuacaauaugauggguaaaagggaaaagaaacuuggggaguucggaaaggccaaaggcucacgagcgaucugguacauguggcugggcgcacgguaucucgaguuugaagcccugggguucuugaacgaggaucacugguuuuccagagaaaauaguuacagcggaguggagggugaaggccugcauaagcucggguauauucuuagggacaucucuaagauucccggaggcgcuauguacgccgaugacacagcagguugggacacucgcaucaccgaggaugaccugcacaacgaggaaaaaauaacacagcagauggauccagagcaucgucaguuagcuaaugccaucuucaagcugacuuaucaaaacaaagucgugaaggugcagcggcccaccccuaaagggacggucauggacauuaucuccagaaaggaucagaggggaucaggccagguuggcacauacggguugaauaccuuuacuaacauggaagcucaacucgugcgccagauggagggagaagguguacugagcaaggccgaccuagagaauccacaccuucuggagaaaaagauuacacaguggcucgaaaccaaaggcguggagcgacugaagcggauggcaaucucgggggaugacugcgucgugaaaccgauagaugacagauucgcgaacgccuuguuagcucugaacgauaugggaaagguuaggaaggacauuccccaguggcaaccuucuaaaggcuggcacgauuggcagcaggugccauucuguagucaucacuuucaugaacucaucaugaaggacggucgcaaacuugucgugcccugcagaccucaggacgagcugaucgggcgggccaggauuucccaaggagcaggcuggagccuaaaggaaacugcuugucugggcaaagccuaugcacagauguggucacucauguacuuccaccgucgagauuugcgccuggccuccaaugcgauaugcucugcuguaccaguucacuggauccccaccagcagaacaacguggaguauucaugcccaccaucaguggaugaccacugaggacaugcuuacaguguggaaccgggucuggaucgaggauaauccuuggauggaagacaagaccccggugacuacaugggaggauguuccauaccuggggaagagggaagaccaaugguguggaucccucauugguuuaaccagccgcgcaacgugggcccagaacauccugacagcuauacagcaggugagaucuuugaucggcgaugaggaguuucuggacuauaugcccucaaugaaacgguucaggaaggaagaggaaagugagggggccauuugguga

SEQ ID NO: 15570 - RNA, 9873 nt, Artificial Sequence
  derived and/or modified CDS sequence (opt3) from DENV-3__EU482461__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcgcacaguggcaaaaaggagaagagguacaggucauugcuguggaaccagguaagaaccccaagaauuuccagacgaugccuggcaucuuccagacaacuaccggggagauaggagccaucgcgcuugacuuuaaaccgggcacaucggguucaccaauuaucaaccgggaagggaagguugugggauuauacggcaauggcgucgugaccaaaaacgggggauauguuucugguauugcccaaacuaaugcagagcccgauggcccuaccccagagcuggaagaggaaauguucaagaaaagaaaccucacaaucauggacuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaucuaaugugccaugcgaccuuuacgaugcgccugcucagcccagugagaguuccuaauuacaacuuagucaucauggacgaagcacacuucacugaucccgccucuauagcugccaggggguauauuagcacacgggugggaaugggcgaggcagccgcuaucuuuaugaccgcgaccccaccuggcacugccgaagcauucccccaguccaaugcuccaauucaggacgaggagcgagacaucccggaaagaucauggaacagugggaaugaguggauaacagauuuugugggaaagaccgucugguucguaccuagcauuaaagccgguaacgacaucgcaaacugucugcgcaagaauggcaagaaagugauccaacuuucuaggaagacauuugauacugaauaccagaaaacgcgucugaacgacugggauuucguugugaccacagacauuuccgagaugggggccaauuuuaaggcugaucgggucaucgaccccagaaggugccucaaaccagugauuuugacugauggacccgagcgcguuauacuggccggcccuaugccagugaccgcggcaucagccgcucagcgaagaggucgggucgggaggaacccccagaaggaaaaugaccaauacaucuucacaggccagccucucaacaaugaugaggaccaugcccacuggaccgaagcuaagaugcugcuugacaacauuaauacuccggagggaaucaucccagcacuauucgaacccgagcgcgagaaaagugccgcuauugauggcgaauaucgucugaagggggagagcagaaaaacguuuguggaauugaugcggaggggagacuuaccuguauggcuggcccacaagguggcauccgaggguauaaaauacaccgaucgcaaguggugcuucgacggcgaacgaaacaaucagauccucgaggagaacauggauguugaaauuuggacaaaagagggggaaagaaagaagcugcggcccagguggcuugacgcgcgcacuuauucugauccacuggcccucaaagaguuuaaggacuucgcugccggaagaaaaucgaucgcauuggaucuggucaccgaaauuggcagggugccuagccaucuagcuuaccggacacguaaugcccuggacaaccucgugaugcuucacaccucagagcauggugggcgcgcauaucgacacgccgucgaggaacugcccgagacuauggaaacauuauugcugcucggccugaugauccuucugacgggaggcgcuaugcucuuuuugauauccgggaagggaaucgguaaaaccaguauuggccugaucuguguuauugugucuagcgggauguuauggauggcggauguaccacuacaguggaucgccuccgcaauagugcuggaguucuuuaugaugguccuccuuauuccugagccggaaaagcaaagaacuccccaggacaaucagcuggcuuacgugguuaucggaauuuugacacuggccgccaucguggcagcuaacgagaugggccuccuggaaaccaccaagagggaucuugguaugucaaaagagccaggggucguaucuccuacaagcuaucucgacguggaccugcaccccgccagugcguggacuuuguacgcuguugccacgaccgugauaacaccaaugcugcggcauacuaucgaaaauuccaccgcaaacgucagcuuagccgcuauugcaaaccaagccgugguccuaaugggccuggauaagggauggccuaucucuaaaauggaccucggcgugccccuucuggcguuggggugcuacucacagguuaauccgcugacacucaccgcugccgugcugcuuuuaguaacucacuaugcaauuaucggaccaggccugcaggccaaggcuacgcgcgaggcccagaaaagaacagcagcugguauaaugaagaacccuaccguggaugggauuaugacuaucgaccucgaucccgucaucuacgacuccaaguucgagaaacaauugggacagguuaugcugcuagugcugugugccguccagcuccuucugaugaggaccaguugggcguugugcgaagcccugacacucgcaacuggcccaauuaccacacugugggaggguagccccggcaaguuuuggaauacgaccaucgcugugucgauggccaacauauuccgggggucuuauuuagcaggagcuggccuugccuuuuccauuaugaaaagcguagggacuggacgaagaggcacagguucacagggggaaacccugggagagaaguggaaaaagaagcucaaucaacuaagucgcaaagaauucgaucuguacaagaaaucuggcaucacugagguggacaggacagaggccaaggaagguuugaaacggggcgagaccacgcaucacgcgguuucccgugggagcgcuaagcugcagugguuuguggaaagaaacauggucauuccugagggaagggugaucgaucucggcugugggcgcggaggcuggucauauuacugcgcaggucuuaaaaaggucaccgaagugcggggguauacaaagggaggcccgggccaugaggagcccguuccaaugaguacuuacggguggaaucugguaaaauugaugagcggaaaggacguguucuaccugccucccgaaaaaugugauacccucuuaugcgacauaggugaguccucuccuagcccaacagucgaagagucccgaacuaucagagugcugaagaugguugagcccuggcuuaaaaacaaucaguucuguauuaaggugcugaacccuuauaugccaaccgucaucgaacaccuagagaggcuccagcgcaaguacggcgggaugcuggugcggaaucccuugucaagaaacucuacacacgaaauguauuggauuaguaauggaaccggcaacaucguaucgagcgugaauaugguuucccgucugcuccuuaacagguuuacuaugacgcaucggcgcccgacaauugagaaagaugucgaccugggugccgggacccgacacgugaacgcugaaccugagacuccaaauauggacgugaucggagagagaauaaagaggauuaaagaagagcauucuucaaccuggcacuacgaugacgaaaaccccuauaagacaugggccuaccacggcagcuaugaggucaaagcaacgggcuccgccaguucuaugaucaaugggguugugaaguuacugaccaagccuugggauguagugccaauggucacucaaauggcuaugacagacaccacucccuucggacagcagcggguguuuaaagaaaagguugauacacgcaccccgagaccuaugcccgguacaaggaaagugauggagaucacugcggagugguuguggcgaacccucggccggaacaagaaaccacgucugugcacgagagaagaguucaccaagaagguccgcacaaaugccgcaaugggggcuguguuuacugaagagaaccaaugggacagcgccagggcagccguagaagaugaggaguucuggaaacuaguugaccgggaaagagagcuucauaagcugggaaaauguggcucaugcguguacaauaugauggguaagcgcgaaaaaaagcucggggaguuuggaaaagcuaagggcuccagggccauuugguacauguggcugggcgcgcgauauuuggaguucgaagcacugggguuucucaacgaggaucacugguucagucgggaaaauagcuacucuggagucgagggugaaggccuucauaagcugggguauauauuaagagacaucuccaaaauuccuggaggcgccauguacgcugaugacaccgccgguugggacacaaggaucacugaggaugaccugcacaacgaggaaaagauuacccagcagauggaucccgagcaucgccaguuggcaaaugcuaucuuuaaacucacguaucaaaacaagguggugaaaguccagcguccaacacccaaggggaccguuauggacauaaucucacggaaggaucagagaggaagcggccaggugggcacuuacgggcugaauacauucaccaacauggaagcccaacuaguaaggcagauggagggagaaggugugcuuucgaaagcugaccuggagaauccucaccuccuggagaagaaaauuacucagugguuggaaaccaagggcgucgagcgcuuaaaacgaauggccaucucuggggaugacugcgugguuaagccaauugaugaccgguuugcaaacgcgcugcucgcccuuaacgauaugggaaaggugagaaaagacaucccgcaguggcaacccaguaagggcuggcacgauuggcagcaggucccuuucuguucccaucacuuccaugaacugauaaugaaagacgguaggaagcuagugguaccaugccgcccccaggacgagcugauugggagagcucggaucagccaaggagccggcuggucacucaaagaaacagcauguuugggcaaggcuuaugcccagauguggucccugauguacuuucacaggcgugaucuucgacuggcaucuaaugccaucugcagcgcgguuccugugcacuggauuccaacgagucgcaccacuugguccauacaugcucaccaucaguggaugacaaccgaggacaugcucacugucuggaacagaguguggaucgaggauaaucccuggauggaagacaagacaccuguuaccacgugggaggaugugccguacuuagggaaacgggaagaccaaugguguggaagccugauugguuugacaucuagggccaccugggcacagaacauccugacugccauucagcagguccgcucacucaucggcgaugaggaguuccuugacuauaugccaaguaugaagagauuucggaaagaagaggaauccgagggggcuauaugguga

SEQ ID NO: 15571 - RNA, 9873 nt, Artificial Sequence
  derived and/or modified CDS sequence (opt3) from DENV-3__EU482462__SS-prME
accagccugugccucaugaugaugcuucccgcaacacuggcuuuccacuugacuuccagggacggagagccuaggaugaucguggggaagaacgaacggggaaagucuuuacuguuuaagacggcaucagguauuaauauguguaccuuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaggaauaagcccacacucgacaucgagcugcagaaaaccgaagcaacucaacuugccacacugcggaaguuguguauugagggaaaaaucaccaacauuacgaccgauagccgcugcccuacacagggcgaagcuauccucccagaggaacaggaccagaauuaugucuguaagcacacuuacguugaucgagguugggggaacggaugcggccuguucggcaaagggaguuuagugaccugcgccaaguuucaaugucuggagcccauagagggaaagguagugcaguaugaaaaucucaaauacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgagaaccggucuagauuucaaugagaugauccugcucacuaugaagaacaaagccuggaugguucacaggcagugguuuuucgaccugccccuuccuuggaccagcggggcgacaaccgagacuccaacauggaaucggaaggaacuguuggugacguuuaaaaacgcccaugcaaagaaacaagaggucgugguccucggcucccaggaaggagcuaugcacaccgcccugacuggcgcuacagagauccaaaauucagggggaaccaguauuuucgccggucacuuaaagugucgucugaagauggauaaacuagaacucaagggcaugagcuacgcaaugugccugaacacauuugugcuuaaaaaggagguuucugagacucagcaugggaccauauugaucaaaguggaauacaagggagaggacgcccccuguaagauuccuuucuccacggaagauggccaagguaaagcucacaacgggcgccugaucaccgcgaauccaguagucacaaagaaagaggagcccgugaacauagaagcagagccgccuuucggcgaaucaaauauuguuaucggaaucggcgacaaggcccucaaaauuaacugguauaagaaggggagcaguaucggaaaaauguuugaggcuacugccagaggugcaaggcggauggccauucugggcgauaccgcuugggacuucgggucugugggaggcguccuuaauucccuggguaagauggugcaucagauauuugggagcgccuacacagcauuguucucgggcguaucuuggaucaugaaaauuggaaucggcgugcuccugacuuggaucggguuaaacuccaagaauaccucaaugaguuuuagcugcauuguuauaggaaucauuacgcuguaucuaggcgcggucgugcaggcugauauggguugugccaucaacuggaaagggaaggaacucaagugcggauccggcauuuucgugacaaaugagguccacaccuggacugagcaguacaaauuucaagcagacucucccaagcgacuggccacagcuaucgccggugcaugggaaaacggcguuugugggauacgcagcaccacuagaauggagaaucuuuuguggaaacagaucgcuaacgaacugaauuauauucucugggagaacaauaucaagcugaccguggugguaggagauauuaucggcgucuuagaacaggggaaaaggacacugacgccacagccuauggaccuuaaguacucauggaaaaccuggggaaaggccaagauagugacugcggagacacaaaacaguuccuucauuaucgacggccccaacaccccagagugccccagcgccucucgggcuuggaauguuugggaaguggaggauuaugguuuuggggucuucacaacuaacauuugguugaaacuccgcgaaguguacacccagucaugugaccauagacugaugagugcagccaucaaggaugagagggcuguucacgccgacaugggauacuggauagaaagccagaaaaauggcuccuggaagcuagagaaagcaucuuuuaucgaggugaagacgugcacauggccuaagucgcacacccuguggagcaacgguguacucgaauccgauaugauuaucccaaaaucacuggcgggcccgauuagucagcauaaucaccgucccggguaucauacucaaaccgccggaccuuggcaccuuggcaaguuggagcuggacuucaacuacugcgaagggacaacugucgugaucaccgagaauuguggaacacggggcccaucuuuacgaacgaccacugugagcgguaaacucauacacgaguggugcuguagauccugcacacugcccccucuuagguauaugggggaagauggauguugguacggcauggagauucgcccaaucaacgaaaaggaggaaaauauggucaaaucacugguuagcgcugguucuggcaagguggacaacuuuaccauggggguauugugccucgccauccuguucgaggaggugaugcggggaaaguucggcaaaaagcauaugauugcagggguccuauuuacuuucgugcugcuccuguccggacagaucacauggaaagauauggcucacaccuuuauuaugauaggcaguaaugccagcgacagaauggguauggggguuacguaucuugcauugaucgccacuuucaagauucagcccuuucuggcuuuaggauucuuucucaggaaacugaccucucgcgaaaaccuucugcuaggcgugggccucgcgauggccacaacccugcaauugccggaggauaucgaacagauggcaaaugggauugcucugggauuaaugacucucaagcugaucacacaguucgagaccuaccagcuuuggacagcccuggucuccuugacuuguucaaacaccauauuuacgcucacaguggccuggcgaaccgcuacucugguucuagccggugugagucugcuuccucucugccaaagcucguccaugcggaagaccgacuggcugccaaugacagucgccgcgaugggcguacccccuuugccccuguucaucuuuucuuuaaaagauacuccaaagcguagaagcuggccucucaaugaaggggugauggcuguuggacuggugucaauucuugccaguucccuguugaggaacgacguccccauggcaggcccacucguggccggugggcugcuaaucgcuuguuauguaauuaccggaacgucugcagaccugacaguggagaaagccgcggaugucaccugggaggaagaggcugaacagacuggcguuagccauaaccuuaugaucacaguggacgaugacggcaccaugcgcauaaaggaugacgagacugaaaauauucucacagugcuguugaaaaccgccuuacugaucgucuccgggaucuucccguacucaauuccugcaacgcuccugguguggcacacuuggcagaagcagacccaacggagcggaguucuuugggauguacccaguccacccgagacacagaaagccgagcuggaagaggguguguacagaauaaagcagcagggcaucuuugggaagacccaagucggagugggcguucagaaagaagguguguuccauacaauguggcacgucacuagaggggcuguguugacccacaacggaaagcgacuagagccuaauugggccucugucaagaaggaccugauuuccuauggcggcggguggcgccucagcgcacaguggcaaaaaggagaggaaguccaggugaucgcuguugagccagguaagaaccccaagaauuuccagacgaugccuggcauuuuucagacaacuaccggggaaaucggagccauagcgcuggauuucaaaccgggcacaucggguucaccaaucauuaaccgggaggggaagguggucggacuuuacggcaauggcgugguuaccaaaaacgggggauaugugucugguaucgcccaaacuaaugcagaacccgacggcccuaccccagaguuagaggaagagauguuuaagaaaagaaaccugacaauuauggaucuccaucccgggaguggaaagacgaggaaguacuugccugcuaucguccgugaagccauaaaacgccggcugagaacucucauucuggcuccgaccagggugguagcagccgagauggaagaggcccuuaagggccugcccauccgauaucagacaaccgcuacuaaauccgagcacacaggucgggaaaucguggacuugaugugccaugcgaccuucacgaugcgccuacugagcccaguuagagucccuaauuacaaccucauuaucauggaugaggcacacuuuacugaccccgccucuauagcugccaggggguauauuagcacacgggugggaaugggcgaagcagccgcuaucuucaugaccgcgaccccaccuggcacugccgaggcauuuccccaguccaaugcuccaauucaggacgaggaacgagauaucccggagagaucauggaacagugggaaugaauggauaacagacuucgugggaaagaccgucugguuuguaccuagcauuaaagccgguaacgauaucgcaaacuguuuacgcaagaauggcaagaaagugauccaacugucuaggaagacauucgacacugaguaccagaaaacgcgucuuaacgauugggacuuuguugugaccacagauauuuccgaaaugggggccaauuucaaggcugaccgggucaucgaucccagaaggugccugaaaccagugauucucacugacggacccgagcgcguuauauuggccggcccuaugccagugaccgcggcaucagccgcucagcgaagaggucgggucgggaggaacccccagaaggagaaugaucaauacaucuucacaggccagccucugaacaaugacgaagaccaugcccacuggaccgaggcuaagaugcuccuggauaacauuaauacuccggaaggaaucaucccagcacuuuuugagcccgaacgcgagaaaagugccgcuauugacggcgaguaucgucuaaagggggaaagcagaaaaacguucguggagcugaugcggaggggagauuugccuguaugguuagcccacaagguggcauccgaagguauaaaauacaccgaccgcaaguggugcuuugauggcgagcgaaacaaucagauccuggaagagaacauggacguugagauuuggacaaaagaaggggagagaaagaagcuccggcccagguggcuggaugcgcgcacuuauucugacccacuugcccugaaagaguucaaggauuuugcugccggaagaaaaucgaucgcacucgacuuggucaccgagauuggcagggugccuagccaucuggcuuaccggacacguaaugcccuagauaaccuggugaugcuccacaccucagaacauggugggcgcgcauaucgacacgccgucgaggagcuucccgaaacuauggagacacuguuauugcugggccucaugauccugcuuacgggaggcgcuaugcuguuccucauauccgggaagggaaucgguaaaaccaguauuggcuugaucuguguuauugugucuagcgggaugcuguggauggcggacguaccauuacaguggaucgccuccgcaauagugcuagaauuuuucaugaugguccugcucauuccugagccggagaagcaaagaacuccccaggauaaucagcuugcuuacgugguuaucggcauucugacauuggccgccaucguggcagcuaacgaaaugggccugcucgagaccaccaagagggaccuggguaugucaaaagaaccaggggucguaucuccuacaagcuaucuugacguggaucuccaccccgccagugcguggacucuguacgcuguugccacgaccgugauaacaccaauguugcggcauacuaucgaaaauuccaccgcaaacgucagccuggccgcuauugcaaaccaagccguggucuuaaugggccuagacaagggauggccuaucucuaaaauggaucugggcgugccccuccuugcgcuggggugcuacucacagguuaauccguugacacugaccgcugccgugcuccugcuuguaacucacuaugcaauuaucggaccaggcuuacaggccaaggcuacgcgcgaagcccagaaaagaacagcagcugguauaaugaagaacccuaccguggacgggauuaugacuaucgaucuggaccccgucaucuacgauuccaaguuugagaaacaacucggacagguuauguugcuggugcuaugugccguccagcugcuccuuaugaggaccaguugggcgcugugcgaggccuugacacuggcaacuggcccaauuaccacacucugggaagguagccccggcaaguucuggaauacgaccaucgcugugucgauggccaacauauuucgggggucuuaucuggcaggagcuggcuuagccuucuccauuaugaaaagcguagggacuggacgaagaggcacagguucacagggggagacccuuggagaaaaguggaaaaagaagcugaaucaacucagucgcaaagaguuugaccuauacaagaaaucuggcaucacugaaguggauaggacagaggccaaggagggucugaaacggggcgaaaccacgcaucacgcgguuucccgugggagcgcuaaguugcagugguucguggagagaaacauggucauuccugaaggaagggugaucgaccugggcugugggcgcggaggcuggucauauuacugcgcaggucucaaaaaggucaccgaggugcggggguauacaaagggaggcccgggccaugaagaacccguuccaaugaguacuuacggguggaauauaguaaaacuuaugagcggaaaggauguguucuaccugccucccgagaaaugugacaccuugcugugcgauaucggugaauccucuccuagcccaacagucgaggaaucccgaacuauuagagugcucaagaugguugagcccuggcuaaagaacaaucaguuuuguaucaaggugcugaacccuuauaugccaaccgucauugagcaccuugaaaggcugcagcgcaaguacggcgggaugcuagugcggaauccccucucaagaaacucuacacacgagauguauuggaucaguaauggaaccggcaacauuguaucgagcgugaauaugguuucccgucuguugcugaacagguucacuaugacgcaucggcgcccgacaaucgaaaaagacgucgaccucggugccgggacccgacacgugaacgcugagccugaaacuccaaauauggaugugauaggagagagaauuaagaggaucaaagaggaacauucuucaaccuggcacuacgacgaugagaaccccuauaagacaugggccuaccacggcagcuaugaagucaaagcaacgggcuccgccaguucuaugaucaaugggguugugaaacuucugaccaagccuugggacguagugccaauggucacucaaauggcuaugacagauaccacucccuuuggacagcagcggguguucaaagagaagguugacacacgcaccccgagaccuaugcccgguacaaggaaagugauggaaauuacugcggagugguuauggcgaacccugggccggaacaagaaaccacguuugugcacgagagaggaauuuaccaagaagguccgcacaaaugccgcaaugggggcuguguucacugaggaaaaccaaugggauagcgccagggcagccguagaggacgaagaguuuuggaaacucguugaucgggagagagaacugcauaagcuaggaaaauguggcucaugcguguacaauaugauggguaagcgcgagaagaaacuuggggaguucggaaaagcuaaaggcuccagggccauaugguacauguggcugggcgcgcgauaucucgaguuugaggcacugggguucuugaacgaagaccacugguuuagucgggagaauagcuacucuggagucgaaggugagggccugcauaagcucggguauauccuuagagauauuuccaaaaucccuggaggcgccauguacgcugacgacaccgccgguugggauacaaggauuacugaagacgaucugcacaacgaggagaagaucacccagcagauggaccccgaacaucgccaguuagcaaaugcuauauucaaacugacguaucaaaacaagguggugaaaguccagcguccaacacccaaggggaccguuauggauaucauuucacggaaggaccagagaggaagcggccaggugggcacuuacggguugaauacauuuaccaacauggaggcccaacucguaaggcagauggaaggagagggugugcugucgaaagcugaucuagaaaauccucaccuucuggagaagaaaaucacucaguggcucgagaccaagggcgucgaacgccugaaacgaauggccauuucuggggacgauugcgugguuaagccaaucgacgaucgguucgcaaacgcguuguuagcccugaacgacaugggaaaggugagaaaagauauaccgcaguggcaacccaguaagggcuggcacgacuggcagcaggucccuuucuguucccaucacuuucaugagcucauuaugaaagacgguaggaaacuugugguaccaugccgcccccaggaugaacugaucgggagagcucggaucagccaaggagccggcuggucacuaaaagagacagcaugucugggcaaggcuuaugcccagauguggucccucauguacuuccacaggcgugacuugcgacuggcaucuaaugccauuugcagcgcgguuccugugcacuggauaccaaucagucgcacgaccugguccauucaugcucaccaucaguggaugacuacagaagauaugcuuaccgucuggaacagaguguggaucgaggacaaucccuggauggaggauaagacuccuguuacaaccugggaagacgugccguaccuggggaaacgggaggaucaaugguguggaagccucauugguuuaacgucuagggccacaugggcacagaacauccugaccgccauacagcagguccgcucauugaucggcgacgaagaguuucuggauuauaugccaaguaugaagagauuccggaaagaggaagaguccgaaggggcuauuugguga

SEQ ID NO: 15572 - RNA, 9873 nt, Artificial Sequence
  derived and/or modified CDS sequence (opt3) from DENV-3__EU660407__SS-prME
acaagccugugccucaugaugaugcuucccgcaacacuggcuuuccacuugacuuccagagacggcgaaccuaggaugaucguggggaagaaugaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucaccaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgagaaugacaugauuaucccaaagucccuggcaggcccgauuucacagcauaaccacaggcccggguaucauacucaaaccgcgggaccuuggcaccuuggcaaauuggaacuggauuucaauuacugcgaggggacaacuguggugaucaccgagaacuguggaacacguggcccaaguuuacggacgaccacugucucugguaagcucauacacgaauggugcugucgaagcugcacacugcccccucuuagauauaugggggaggacggauguugguacggcauggaaauuaggccaaucaaugagaaagaagagaacaugguuaagucccuggugucagccgguagcggcaagguagauaauuuuaccauggggguguugugccucgcuauccuguucgaggaagucaugcgcggaaaauucggcaagaaacauaugauugccggggugcuauuuacuuucguucugcuccugucuggacagaucacauggcgggacauggcacacacccuuauuaugauaggcuccaacgcuagugauagaauggguaugggggugacguauuuggcccugaucgcaacuuuuaagauucagcccuucuuagcccucggauuuuuccugaggaaacuuaccagccgcgagaaucugcuacucggcgucggccuggcuauggcgacaaccuugcaacugccggaagacaucgagcagauggccaacgggauugcauuaggacucaugacucugaaacuuaucacacaguuugaaaccuaccagcuguggacagcuuuggugucucucacuuguuccaauaccauauucacgcugacaguugccuggcgaaccgccacucuaauccuggcuggugugucacuucucccucugugccaaaguagcucgaugcggaagaccgauugguugccaaugacagucgcagccaugggcguacccccucugcccuuauuuauuuucucccucaaagacacuccaaagcguagaucuuggccucugaacgagggggugauggcgguuggacuugugagcauccuggcuucaaguuugcucaggaacgauguccccauggccggcccacugguggccggugggcuacugauugccuguuauguaaucaccggaacguccgcugaccuuacaguggagaaagcagccgacgucaccugggaagaggaagcggagcagacuggcguuucucauaaucucaugauaacaguggaugacgauggcaccaugcgcauuaaggacgaugaaacugagaacauccugacaguguuguuaaaaaccgcucugcucaucgucagcgggauuuuuccguacuccauaccugccacgcugcuuguguggcacacuuggcagaagcagacccaacggucaggaguucugugggacguacccagcccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaauggaaagaggcuggagccuaacugggcuagugucaagaaggaucucaucucuuauggcggcggguggcgccuguccgcccaguggcaaaaaggagaagagguccaggugauugcaguugaaccagguaagaaucccaagaacuuccagacgaugccuggcaucuuccagacaacuaccggggagauaggagcuaucgcccuugacuuuaaaccgggcacaagcgguucgccaauuaucaaucgggaagggaagguggucggauuauacggcaacggcgugguuaccaaaaaugggggauaugugucagguauugcgcaaacuaacgccgagcccgauggcccuaccccagagcuggaagaggaaauguucaagaaaagaaaucucacaaucauggacuugcaucccgggucuggaaagacgaggaaguaccugccugcaauaguccgugaggcuauuaaacgccggcucagaacucugauccuugccccgaccagggugguagcugcagaaauggaggaggcccugaagggcuugcccauccgauaucagacaaccgccacuaaaagugaacacacaggucgggagauuguggaucuaaugugccaugcuaccuuuacgaugcgccugcucuccccaguuagagucccuaacuacaauuuaaucauaauggacgaagcgcacuucacugaucccgcaagcauugccgcuaggggguauaucucuacacgggugggaaugggcgaggccgcagccauuuuuaugaccgcuaccccaccuggcacugcggaagccuucccccagagcaacgcaccaauccaggacgaggagcgagacauaccggaaagauccuggaacucagggaacgaguggauuacagauuuugugggaaagaccgucugguucguaccuaguaucaaagcugguaacgacaucgccaauugucugcgcaagaacggcaagaaagugauucaacuuagcaggaagacauuugauacugaauaccagaaaacgaagcugaaugacugggauuucguugugaccacagacaucucugagaugggggcaaacuuuaaagccgaucgugucauugacccccggagaugccucaagccagugauauugacugauggacccgagaggguuauccuggcuggcccuaugccagugaccgccgcguccgcagcccagcgccgagguagagucgggcggaauccccagaaggaaaacgaccaauacauuuucacaggccagccucucaauaacgaugaggaccaugcucacuggaccgaagccaaaaugcugcuugacaauaucaacacuccggagggaaucauuccagcucuauucgaacccgagagggagaagucagcagccauagauggcgaauaucgccugaaaggggagagucguaagacguuuguggaauugaugagacggggagacuuaccuguauggcuggcucacaaaguggccagcgaggguaucaaguacaccgauaggaaauggugcuucgacggcgaacgcaauaaccagauucucgaggagaauauggauguugaaaucuggacaaaggagggggaacgaaagaaacugagaccccgguggcuugacgcaaggacuuauuccgauccacuggcgcucaaggaguuuaaagacuucgccgcuggacgcaagucuauugccuuggaucuggucaccgaaaucggcagagugccuucgcaucuagcauacaggacacggaacgcucuggacaaucucgugaugcuucacaccagcgagcauggugggcgugccuaucgccacgcagucgaggaacugcccgagacuauggaaacauuauugcugcucggccugaugauacuucugacgggaggcgccaugcucuuuuugaucucagggaaaggaauugguaagaccuccaucggccugauuuguguuaucgugaguucugggauguuauggauggcugauguaccacuacaguggauagcgagcgccauugugcuggaguucuuuaugaugguccuccuuaucccugagccggaaaagcaacgaacuccccaggacaaccagcuggcauacgugguuauuggaaucuugacacuggcugccauaguggccgcaaaugagaugggccuccuggaaaccaccaaaagagaucuugguauguccaaggagccaggggucguaucaccuacaucuuaucucgacguggaccugcaccccgcuagcgccuggacuuuguacgcgguugcuacgaccgugaucacaccaaugcugaggcauacuauugaaaacaguaccgccaacgucuccuuagcagccaucgcuaaucaagcagugguccuaaugggccuggauaaaggauggccuauuagcaagauggaccucggcgugccccuucuggccuuggggugcuacucucagguuaacccgcugacacucaccgcggcugugcugcuuuuaguaacucacuaugccaucauaggaccaggccugcaggcaaaagccacgcgggaggcucagaagcgcacagccgcagguauuaugaagaauccuaccguggaugggaucaugacuaucgaccucgaucccgucauuuacgacucaaaauucgagaagcaauugggacagguuaugcugcuagugcugugugcuguccagcuccuucugaugagaaccuccugggccuugugcgaagcgcugacacucgccacuggcccaaucaccacacugugggaggguagucccggcaaauuuuggaacacgaccauagcagugagcauggcuaauauuuucagggggucguauuuagccggagcaggccuugcuuuuucuaucaugaaguccguagggacuggacggcgaggcacagguagccagggggaaacccugggagagaaauggaagaagaaacucaaccaacuaucaagaaaggaguucgaucuguacaaaaagaguggcauuacugagguggaccgcacagaggccaaagaagguuugaagaggggcgagaccacgcaucacgccguuucucggggguccgcgaaacugcagugguuuguggaacguaauauggucaucccugagggaagagugauagaucucggcugugggaggggaggcuggagcuauuacugcgcuggucuuaagcgcgucaccgaagugcggggguauacaaagggaggcccgggccaugaggagcccguuccaaugucaacuuacggguggaacaucguaaaacugaugaguggaaaggacguguucuacuugccucccgaaaaaugugauacccugcucugcgacauuggugagagcuccccuucuccaacagucgaagagagccgaacuaucagaguguuaaagaugguugagcccuggcugaaaaauaaccaguucuguauuaaggugcuuaauccuuauaugccaaccgucaucgaacaccuggagaggcuacagcgcaaguacggcgggaugcucgugcggaacccccuguccagaaauucaacacacgaaauguauuggauuucuaacggaaccggcaauaucguaaguucggugaacaugguuagccguuugcugcucaacagguuuacuaugacgcaucggcgcccgacaauagagaaagaugucgaccuuggugcagggacccgacacgugaaugccgaaccugagacuccaaacauggacgugauuggagagagaaucaagaggaucaaagaagaacacuccucuaccuggcacuacgaugacgaaaaucccuauaagacaugggcuuaccacggcucauaugaggucaaagccacgggcagcgcauccaguaugauuaacgggguugugaagcuguuaaccaagccuugggauguagugccaauggucacucaaauggccaugacagacaccacucccuucggacagcagcggguguuuaaagaaaagguugauacacgcaccccgagaccuaugcccgguacaaggaaagugauggagauaacugcugaguggcuguggcgaaccuugggccggaauaagaaaccacgucucugcacgagagaagaguucaccaagaagguccgcacaaacgcggccaugggggcaguguuuacugaagagaaucaaugggacucugcuagggccgcaguagaagaugaggaguucuggaaacugguugaccgggaaagagagcuacauaaacuuggaaaauguggcagcugcguguacaacaugauggguaagcgcgagaaaaagcugggggaguuuggaaaagccaagggcucaagggcuaucugguacauguggcucggcgcccgauaucuggaguucgaagcguugggguuucugaaugaggaucacugguucucccgggaaaacaguuacagcggagucgagggugaaggccuccauaaacuuggguauauucugagagacaucucuaaaauuccuggaggcgcaauguacgccgaugacaccgcugguugggacacaaggaucacugaggaugacuuacacaaugaggaaaagauaacccagcagauggaucccgagcaucgccagcuggccaacgcaaucuuuaaauugacguaucaaaauaagguggugaaaguccagcguccaacacccaaggggaccguuauggacauuaucucccggaaggaucagagaggaucaggccaggugggcacuuacgggcucaacacauucaccaauauggaagcucaacugguaaggcagauggagggagaaggugugcuaagcaaagccgaccuugagaacccucaucugcucgagaagaaaauuacucaguggcuggaaaccaagggcgucgagcgcuugaaacgaauggcuaucucgggggaugacugcgugguuaagccaauagaugaccgguuugccaacgcauuacuggcgcucaaugauaugggaaaggugagaaaagacauuccgcaguggcaacccucuaagggcuggcacgauuggcagcaggucccuuucuguagucaucacuuccaugaacuuaucaugaaagacgguaggaagcuggugguaccaugccgcccccaggacgagcuaaucgggagagcccggauuucccaaggagcuggcuggagccugaaagaaacagccugucucggcaaggcauaugcucagauguggucauugauguacuuucacaggcgugaucugcgacuugccuccaacgcaauaugcucugccguuccugugcacuggaucccaacgagccgcaccacuuggaguauucaugcgcaccaucaguggaugacaaccgaggacaugcugacugucuggaauagaguguggaucgaggauaaccccuggauggaagacaagacaccuguuaccacgugggaggaugugccguaccucgggaaacgggaagaccaaugguguggauccuuaauuggucugacaagcagggcuaccugggcccagaauaucuugacugcaauacagcagguccgcucucugaucggcgaugaggaguuccucgacuauaugccaucaaugaagagauuucggaaagaagaggaaagugagggggccauuugguga

SEQ ID NO: 15573 - RNA, 9873 nt, Artificial Sequence
  derived and/or modified CDS sequence (opt3) from DENV-3__EU660409__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacuaggcuugccacacugcggaaauuguguauugagggaaagaucaccaacauuacgaccgauagccgcugcccuacacaaggcgaagcuauccucccagaggaacaggaccagaauuaugucuguaaacacacuuacguugaucgagguugggggaacggaugcggccuguucggcaaggggaguuuagugaccugcgccaaguuucagugucuggagcucauagagggaaaaguagugcaauaugaaaaucuuaaguacacagucauuaucacugugcacaccggugaccagcaucagguuggcaacgacacacagggggcaaccguggagauuacuccccaagcuuccacggucgaagccgugcugccugaguauggaacauugggccuagaaugcucuccaagaaccggucuggauuucaaugagaugauccuccugacuaugaaaaacaaggcguggaugguacacaggcagugguuuuucgaccuuccgcugcccuggaccagcggggccacaaccgagacuccuacauggaaucggaaagaauugcucguuacguuuaagaacgcacaugcuaaaaagcaggagguggucgugcugggcucccaagaaggagccaugcacaccgcuuuaacuggcgccacagagauccagaauucagggggaaccaguauuuucgcaggucaccugaagugucgucuaaaaauggauaagcucgaacugaaaggcaugagcuacgccaugugccuuaacacauuugucuugaagaaagaggugucugagacucagcaugggaccauacugaucaagguugaauacaagggagaggacgcuccauguaaaauucccuucuccacggaagauggccaggguaaggcgcacaacgggcgccucaucaccgcaaauccugugguaacaaaaaaggaggagccagucaacauagaagccgagcccccguucggcgaaucaaauauugugaucggaaucggcgacaaagcucugaagauuaacugguauaagaaagggagcaguaucggaaagauguuugaggccacugcaagaggugccaggcggauggcuauucuuggcgauaccgccugggacuucgggucuguuggaggcgugcugaauuccuuggguaaaaugguccaucaaauauuugggagcgcauacacagcgcucuucucgggcgugucuuggaucaugaagauuggaaucggcguacuguuaacuuggaucgggcugaacuccaaaaauaccucaaugaguuuuagcugcauugcuauaggaaucauuacgcuauaucucggcgccgugguucaggcagauauggguugugucaucaacuggaaggggaaggaacugaaaugcggauccggcauuuucgugacaaaugaggugcacaccuggacugagcaguacaaguuucaggccgacucuccuaaacgacuugcuacagccaucgcaggugcuugggaaaacggcgucugugggauacgcagcaccacuagaauggagaauuugcuguggaagcaaaucgccaacgaacucaauuauauucugugggagaacaauaucaaauuaaccguuguggugggagauauuaucggcguacuggaacaggggaagaggacacuuacgccccagccaauggaguugaaauacucauggaagaccuggggaaaggcgaaaauagucacugccgagacacagaacaguuccuucauuaucgacggcccuaacacccccgaaugcccaagcgcuucucgggcauggaaugugugggagguugaagacuaugguuuugggguguucacaacuaacauuuggcucaagcugcgcgaggucuacacccaaucaugugaucauagacuaaugagugccgcuaucaaagacgaaagggccgugcacgcagauaugggauacuggauagagagccagaagaauggcuccuggaaacuggagaaggcgucuuuuaucgaaguuaagacgugcacauggcccaaaucgcacacccucuggagcaacggugugcuggaguccgacaugauuaucccuaagucacuugccggcccaauuagucagcauaaucaccguccgggguaucauacucagaccgcuggacccuggcacuugggcaaacuggaauuagauuucaacuacugcgaggggacaacuguagucaucaccgagaauuguggaacacggggcccuucucuccgaacgaccacugugagcgguaagcugauacacgaauggugcuguagauccugcacacuuccaccccugagguauaugggggaggacggauguugguacggcauggaaauucgcccuaucaacgagaaagaagagaauauggugaagucauuggucagcgccgguucuggcaagguugauaacuuuaccaugggggcacucugccuggcuauccuauucgaggaagugaugcggggaaaauucggcaagaaacauaugauugccgggguacuguuuacuuucgugcuccugcuuuccggacaaaucacauggagagacauggcacacaccuugauuaugauaggcaguaaugccagcgauaggauggguaugggggucacguaucuggcuuuaaucgcgacuuuuaagauucagccauuccucgcccugggauuuuuccuucgcaaacugaccucucgagagaaccuacuccugggcgugggcuuggcaauggcuacaacccugcaguuacccgaagacaucgagcaaauggccaaugggauugcccucggacugaugacucuuaagcugaucacacaguuugaaaccuaccaguuguggacagcucucguuucccugacuuguucaaacaccauauucacgcuaacaguggcauggcggaccgccacucugauccuugcgggugucagucuccugccguugugccagagcucguccaugcguaagaccgauuggcugccuauggcuguggccgcaaugggcguuccacccuuaccucucuuuauuuucucucugaaagacacacccaagagaaggagcuggccacuuaaugagggggugauggccgucggacugguaucaaucuuggcuaguucccuccugcgcaacgaugugccuauggcaggcccccuaguugccggugggcugcuuauugcguguuaugugaucacuggaaccucugcugaccucacggucgagaaaguggccgacguaacaugggaagaggaagcagagcaaaccggcgugagccauaaccugaugauaacugucgaugacgauggcacaaugcggauuaaggacgaugaaaccgagaauaucuugacuguuuuacugaaaacagcccuccugaucguguccgggauuuuuccauacucaauaccggcuacccuucugguguggcacacguggcagaagcagacucagagaagcggagucuugugggacgugccuagucccccagagacccaaaaagccgaacuagaggaagguguuuacaggaucaagcagcagggcauuuucgggaagacacagguaggagugggcguccaaaaagaggguguguuucauaccauguggcacguuacacgaggggcagugcugacucacaacggaaagcgccucgagcccaauugggcuucugucaaaaaggaucugaucuccuauggcggcggguggcggcuuagcgcccaguggcagaaaggagaagaggugcaaguaauugcggucgaaccugguaagaacccaaagaauuuccagaccaugcccggcaucuuccagacgacaacuggggagauaggagccaucgcauuagacuuuaaaccuggcaccucggguucaccgauuaucaacagagaagggaaggugguuggacuguacggcaauggcguggucacaaaaaacgggggauaugugucugguauugcucagaccaaugccgagccagauggccccacuccugagcucgaagaggaaauguucaagaaaaggaacuugaccaucauggaccugcauccagggaguggaaagacacguaaguaccuccccgcuauaguucgcgaggcaauuaaacggagacugaggacgcuuauccuggccccuacucgaguggucgccgcugaaauggaggaggcguugaagggccuaccgauccgguaucaaaccacagcaaccaaauccgaacacacuggucgcgagauuguggaucugaugugccaugccacauuuaccaugagacucuuaagccccguaagggugccaaauuacaaccugaucauaauggacgaagcucacuucacggauccugccucuauugcagcccggggguauaucagcacucgaguuggaaugggcgaggcugcggccauuuuuaugacagcaacccccccaggcaccgcugaagccuucccucaguccaaugcacccauccaggacgaggagagagacauaccagaacgcucauggaacagugggaaugaguggauuacugauuuugucggaaagacagugugguucgugccgagcaucaaagccgguaacgacaucgcuaacugucuuaggaagaauggcaagaaagucauucagcugucucguaagaccuuugauacagaauaccaaaaaacucggcucaacgacugggauuucguagugacgaccgacaucuccgagaugggggccaauuuuaaggcggauagaguuauugacccuaggcgcugcuugaaacccgugauacugacagauggaccagagcgagucauccucgcaggccccaugccugugacugccgcuucagccgcucagagacgggguaggguugggcgcaacccacagaaggaaaaugaccaguacauuuucaccggccaaccccugaacaaugaugaggaccaugcacacuggacagaagccaagaugcuucuagacaacaucaauaccccugagggaaucauuccggcucuguucgaaccagagcgugagaaaagugccgcaauagauggcgaauauagauugaagggggagagccggaaaacuuuuguggaauuaaugaggcgcggagaccugcccgucuggcucgcgcacaagguggccuccgaggguaucaaauacacggaucgaaaguggugcuucgacggcgaaagaaacaaucagauucuggaggagaacauggauguagaaaucuggaccaaagagggggaacggaagaagcuuaggccucgcuggcuggacgcuagaacauauucugauccccucgccuugaaagaguuuaaggacuucgcagcuggaaggaaaucgauugcccuggaucuagugacugaaaucggccggguuccaagccaucuggcauaccguacccgcaaugcccucgacaaccuugucaugcugcacacaucagagcauggugggcgagcuuauagacacgcgguggaggaauuaccugagaccauggaaacuuugcugcuccugggccuuaugauacugcucacaggaggcgccauguuguuucugaucuccgggaagggaauugguaaaacgaguaucggcuuaauuugugugaccgucucuagcgggaugcuauggauggcagauguuccccugcaguggaucgcuuccgccauagugcucgaguucuuuaugaugguacuucugauuccagagccugaaaagcagaggacuccgcaagacaaucaguuggccuacguggucaucggaauucugacacucgcagcuaucguggccgcgaacgagaugggccugcuugaaaccaccaagcgggaucucgguaugucaaaagagcccgggguugugucuccaacaagcuaucuggacgucgacuugcacccugcuagugccuggacucuguacgcaguagccacgaccgugauaacacccauguuacgccauacuaucgaaaauuccaccgcuaacguuagccuagcagccauugcgaaccaggcugugguccugaugggccucgauaagggauggccaaucucuaaaauggaccuuggcgugccucuguuggcccuggggugcuacucacaagucaauccccucacacugaccgcagccgugcuuuuacugguuacucacuaugcuauuaucggaccgggccuccaggccaaggcaacgagagaggcucagaaaaggacagccgcggguauaaugaagaacccaaccguggaugggauuaugacuaucgacuuggauccuguaaucuacgacuccaaguucgagaaacagcugggacaagugaugcuacugguccucugugccguucagcuucuguugaugcggaccaguugggcacugugcgaagcucucacacuggccacuggccccauuaccacauuaugggaggguagcccaggcaaguuuuggaauacgaccaucgcagugucgauggcuaacauauuccgagggucuuaucuugccggagccggccuggcguuuuccauuaugaaaagcgucgggacuggaagacgcggcacagguucacagggggaaacccucggagagaaguggaaaaagaagcuaaaucagcugaguaggaaagaauucgauuuguacaagaaaucuggcaucacugagguggaccggacagaggcuaaggaaggucugaaacguggcgagaccacgcaucacgcaguauccagagggagcgccaagcuccaaugguuuguggaaaggaacaugguuauucccgagggacgcgugaucgaucuuggcugugggcggggaggcuggucauauuacugcgcuggucugaaaaaggucaccgaagugcgaggguauacaaagggaggcccuggccaugaggagccgguccccaugaguacuuacggguggaauauagugaaauugaugagcggaaaggacguuuucuaccugccaccugaaaaaugugauacccucuuaugcgacaucggugaguccucucccagcccuacaguagaagaguccagaacuauuagggugcugaagauggucgagccauggcuuaaaaacaaucaguucuguaucaaggugcugaaccccuauaugccuaccguuauugaacaccuagagcgccuccagcggaaguacggcgggaugcuggugagaaauccauugucacguaacucuacacacgaaauguauuggaucaguaauggaaccggcaacauugucucgagcgugaauaugguauccaggcugcuccuuaaccgguuuacuaugacgcaucgccgacccacaaucgagaaagauguggaccugggugccgggaccagacacguuaacgcagaaccggagacuccuaauauggacgucauaggagagaggauuaagcggaucaaagaagagcauucuucaaccuggcacuacgaugacgaaaacccauauaagacaugggccuaccacggcagcuaugaggugaaagcuacgggcuccgcgaguucuaugaucaaugggguggucaaguuacugaccaagcccugggauguugugccuaugguaacucagauggccaugacagacaccacuccauucggacaacagcgcguguuuaaagaaaaggucgauacaagaacccccaggccgaugccugguacacgaaaagugauggagauuacugcagagugguuguggcggacccucggccguaacaagaaacccagacugugcacgcgcgaagaguucaccaagaagguuaggacaaaugcugccaugggggcaguguuuacugaagagaaccagugggacagcgcccgggcugccgucgaagaugaggaguucuggaaacuaguggacagagaacgcgagcuucauaagcugggaaaauguggcucaugcguauacaauaugauggguaagagggaaaaaaagcucggggaguuuggaaaagcgaagggcucccgagcaauaugguacauguggcugggcgcccgguauuuggaguucgaagcucugggguuucucaacgaggaucacugguucaguagagaaaauagcuacucuggaguugagggugaaggccuucauaagcugggguauaucuuaagggacauuuccaaaaucccaggaggcgccauguacgcagaugacaccgcugguugggacacacgcauuacugaggaugaccugcacaacgaggaaaagaucacccaacagauggauccugagcaucgucaguuggccaaugcuauauuuaaacucacguaucagaacaagguggucaaagugcaacggcccacaccaaaggggaccgugauggacaucauuucaagaaaggaucagaggggaagcggccaggucggcacuuacgggcugaauacauucaccaacauggaagcccagcuaguucgccaaauggagggagaaggugugcuuucgaaagcagaccuggagaauccccaccuccuggagaagaaaaucacucagugguuggaaaccaagggcguagagcgauuaaaacggauggcgauuucuggggaugacugcguggucaagccuaucgaugacagauuugccaacgcucugcucgcccuuaacgauaugggaaaggugaggaaagacauaccacaguggcagccgaguaagggcuggcacgauuggcaacagguucccuucuguucccaucacuuccaugaacugauuaugaaagacggucgcaagcuaguggucccuugcagaccacaggacgagcugaucgggcgggcaaggaucagccagggagcuggcuggucacucaaagaaacagccuguuugggcaaggcauaugcccaaauguggucccugauguacuuucaccgucgagaucuucgccuggcgucuaaugcuauuugcagcgccgugcccguacacuggauaccuacgaguagaaccacuugguccauccaugcacaccaucaguggaugacaaccgaggacaugcucacuguuuggaaccggguguggauugaggauaauccauggauggaagacaagacacccgucaccacgugggaggaugugccuuacuuagggaaaagggaagaccagugguguggaagccugaucgguuugacaucucgcgccaccugggcucaaaacauucugacugccauccagcagguuagaucacucauaggcgaugaggaguuccuugacuauaugccgaguaugaagcgguuuaggaaagaagaggaauccgagggggcaaucugguga

SEQ ID NO: 15574 - RNA, 9873 nt, Artificial Sequence
  derived and/or modified CDS sequence (opt3) from DENV-3__EU660410__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaggaauaagcccacacucgacaucgagcugcagaaaaccgaagcaacucaacuugccacacugcggaaguuguguauugagggaaaaaucaccaacauuacgaccgauagccgcugcccuacacagggcgaagcuauccucccagaggaacaggaccagaauuaugucuguaagcacacuuacguugaucgagguugggggaacggaugcggccuguucggcaaagggaguuuagugaccugcgccaaguuucaaugucuggagcccauagagggaaagguagugcaguaugaaaaucucaaauacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgagaaccggucuagauuucaaugagaugauccugcucacuaugaagaacaaagccuggaugguucacaggcagugguuuuucgaccugccccuuccuuggaccagcggggcgacaaccgagacuccaacauggaaucggaaggaacuguuggugacguuuaaaaacgcccaugcaaagaaacaagaggucgugguccucggcucccaggaaggagcuaugcacaccgcccugacuggcgcuacagagauccagaauucagggggaaccaguauuuucgccggucacuuaaagugucgucugaagauggauaaacuagaacucaagggcaugagcuacgcaaugugccugaacacauuugugcuuaaaaaggagguuucugagacucagcaugggaccauauugaucaaaguggaauacaagggagaggacgcccccuguaagauuccuuucuccacggaagauggccaagguaaagcucacaacgggcgccugaucaccgcgaauccaguagucacaaagaaagaggagcccgugaacauagaagcagagccgccuuucggcgaaucaaauauuguuaucggaaucggcgacaaggcccucaaaauuaacugguauaagaaggggagcaguaucggaaaaauguuugaggcuacugccagaggugcaaggcggauggccauucugggcgauaccgcuugggacuucgggucugugggaggcguccuuaauucccuggguaagauggugcaucagauauuugggagcgccuacacagcauuguucucgggcguaucuuggaucaugaaaauuggaaucggcgugcuccugacuuggaucggguuaaacuccaagaauaccucaaugaguuuuagcugcauuguuauaggaaucauuacgcuguaucuaggcgcggucgugcaggcugauauggguugugccaucaacuggaaagggaaggaacucaagugcggauccggcauuuucgugacaaaugagguccacaccuggacugagcaguacaaauuucaagcagacucucccaagcgacuggccacagcuaucgccggugcaugggaaaacggcguuugugggauacgcagcaccacuagaauggagaaucuuuuguggaaacagaucgcuaacgaacugaauuauauucucugggagaacaauaucaagcugaccguggugguaggagauauuaucggcgucuuagaacaggggaaaaggacacugacgccacagccuauggagcuuaaguacucauggaaaaccuggggaaaggccaagauagugacugcggagacacaaaacaguuccuucauuaucgacggccccaacaccccagaaugccccagcgccucucgggcuuggaauguuugggagguggaagacuaugguuuuggggucuucacaacuaacauuugguugaaacuccgcgagguguacacccagucaugugaucauagacugaugagugcagccaucaaggacgaaagggcuguucacgccgauaugggauacuggauagagagccagaaaaauggcuccuggaagcuagagaaagcaucuuuuaucgaagugaagacgugcacauggccuaagucgcacacccuguggagcaacgguguacucgaguccgacaugauuaucccaaaaucacuggcgggcccgauuagucagcauaaucaccgucccggguaucauacucaaaccgccggaccuuggcaccuuggcaaguuggaacuggauuucaacuacugcgaggggacaacugucgugaucaccgagaauuguggaacacggggcccaucuuuacgaacgaccacugugagcgguaaacucauacacgaauggugcuguagauccugcacacugcccccucuuagguauaugggggaggacggauguugguacggcauggaaauucgcccaaucaacgagaaggaagagaauauggucaaaucacugguuagcgcugguucuggcaagguggauaacuuuaccauggggguauugugccucgccauccuguucgaggaagugaugcggggaaaguucggcaaaaagcauaugauugcagggguccuauuuacuuucgugcugcuccuguccggacagaucacauggagagacauggcucacaccuuuauuaugauaggcaguaaugccagcgauaggauggguauggggguuacguaucuugcauugaucgccacuuucaaaauucagcccuuucuggcuuuaggauucuuucuccgcaagcugaccucucgagagaaccuucugcuaggcgugggccucgcgauggccacaacccugcaauugccggaagacaucgagcagauggcaaaugggauugcucugggauuaaugacucucaaacugaucacacaguucgaaaccuaccagcuuuggacagcccuggucuccuugacuuguucaaacaccauauuuacgcucacaguggccuggcggaccgcuacucugguucuagcaggugugagucugcuuccucucugccaaagcucguccaugcguaagaccgauuggcugccaaugacagucgccgcgaugggcguacccccuuugccccuguucaucuuuucuuuaaaggacacuccaaaaagaaggagcuggccucucaaugagggggugauggcuguuggacuggugucaauucuugccaguucccuguugcgcaacgauguccccauggcaggcccacucguggccggugggcugcuaaucgcuuguuauguaauuaccggaacgucugcagaccugacaguggagaaggccgcggacgucaccugggaagaggaagcugagcagacuggcguuagccauaaccuuaugaucacaguggaugacgauggcaccaugcggauaaaagacgaugaaacugagaauauucucacagugcuguugaagaccgccuuacugaucgucuccgggaucuucccguacucaauuccugcaacgcuccugguguggcacacuuggcagaaacagacccaaagaagcggaguucuuugggacguacccaguccacccgagacacagaaggccgaacuggaggaagguguguacaggauaaaacagcagggcaucuuugggaagacccaagucggagugggcguucagaaggaggguguguuccauacaauguggcacgucacucgaggggcuguguugacccacaacggaaaacgccuagagccuaauugggccucuguaaagaaagaucugauuuccuauggcggcggguggcggcucagcgcacaguggcaaaagggagaagagguccaggugaucgcuguugaaccagguaaaaaccccaagaauuuccagacgaugccuggcauuuuucagacaacuaccggggagaucggagccauagcgcuggacuucaagccgggcacaucggguucaccaaucauuaacagagaagggaaaguggucggacuuuacggcaauggcgugguuaccaagaacgggggauaugugucugguaucgcccaaacuaaugcagagcccgauggcccuaccccagaguuagaagaggaaauguuuaaaaagaggaaccugacaauuauggaccuccaucccgggaguggaaaaacgcguaaguacuugccugcuaucguccgcgaggccauaaagcggagacugaggacucucauucuggcuccgacccgagugguagcagccgaaauggaggaggcccuuaaaggccugcccauccgguaucagacaaccgcuacuaaguccgaacacacaggucgcgagaucguggauuugaugugccaugcgaccuucacgaugagacuacugagcccaguuagggucccuaauuacaaccucauuaucauggacgaagcacacuuuacugaucccgccucuauagcugcccggggguauauuagcacacgagugggaaugggcgaggcagccgcuaucuucaugaccgcgaccccaccuggcacugccgaagcauuuccccaguccaaugcuccaauucaggacgaggagagagacaucccggaacgcucauggaacagugggaaugaguggauaacagauuucgugggaaaaaccgucugguuuguaccuagcauuaaggccgguaacgacaucgcaaacuguuuaaggaaaaauggcaagaaggugauccaacugucucguaaaacauucgauacugaauaccagaagacgcggcuuaacgacugggauuuuguugugaccacagacauuuccgagaugggggccaauuucaaagcugauagagucaucgaccccaggcgcugccugaagccagugauucucacugauggacccgagcgaguuauauuggccggcccuaugccagugaccgcggcaucagccgcucagagacgggguagggucgggcgcaacccccagaaagaaaaugaccaauacaucuucacaggccagccucugaacaaugaugaggaccaugcccacuggaccgaagcuaagaugcuccuggacaacauuaauacuccggagggaaucaucccagcacuuuuugaacccgagcgugagaagagugccgcuauugauggcgaauauagacuaaaaggggagagccggaagacguucguggaacugaugaggcgcggagacuugccuguaugguuagcccacaaaguggcauccgaggguauaaaguacaccgaucgaaaauggugcuuugacggcgaaagaaacaaucagauccuggaggagaacauggauguugaaauuuggacaaaggagggggaacggaaaaagcucaggccccgcuggcuggacgcgagaacuuauucugauccacuugcccugaaggaguucaaagacuuugcugccggaaggaagucgaucgcacucgauuuggucaccgaaauuggccgggugccuagccaucuggcuuaccguacacgcaaugcccuagacaaccuggugaugcuccacaccucagagcauggugggcgagcauauagacacgccgucgaggaacuucccgagacuauggaaacacuguuauugcugggccucaugauccugcuuacgggaggcgcuaugcuguuccucauauccgggaaaggaaucgguaagaccaguauuggcuugaucuguguuauugugucuagcgggaugcuguggauggcggauguaccauuacaguggaucgccuccgcaauagugcuagaguuuuucaugaugguccugcucauuccugagccggaaaaacaaaggacuccccaggacaaucagcuugcuuacgugguuaucggaauucugacauuggccgccaucguggcagcuaacgagaugggccugcucgaaaccaccaagcgggaucuggguaugucaaaggagccaggggucguaucuccuacaagcuaucuugacguggaccuccaccccgccagugcguggacucuguacgcuguugccacgaccgugauaacaccaauguugcgccauacuaucgaaaauuccaccgcaaacgucagccuggccgcuauugcaaaccaagccguggucuuaaugggccuagauaaaggauggccuaucucuaagauggaccugggcgcgccccuccuugcucuggggugcuacucacaggugaauccguugacacugaccgccgcaguucuccugcuugugacucacuaugccauuaucggaccaggcuuacaggcuaaagccacgagagaggcacagaagaggacagcugccgguauaaugaaaaacccuaccguagaugggauuaugacuaucgaccuggaucccgugaucuacgacuccaaguuugagaagcaacucggacaggucauguugcugguucuaugugcggugcagcugcuccuuaugcggaccaguugggcccugugcgaagcauugacacuggcuacuggcccaauuaccacacucugggaggguagccccggcaaauucuggaauacgaccaucgccgucucgauggcaaacauauuucgagggucuuaucuggcuggagccggcuuagccuucuccauuaugaagagcguggggacuggaagacgcggcacagguucacagggggaaacccuuggagagaaauggaagaaaaagcugaaucaacucaguaggaaggaauuugaucuauacaaaaagucuggcaucacugagguagaccggacagaggcgaaagaaggucugaagcguggcgagaccacgcaucacgcuguguccagagggagcgcaaaauugcagugguucguugaaaggaacauggugauuccugagggacgcgucaucgaucugggcugugggcggggaggcuggucauauuacugcgccggucucaagaaagugaccgaaguccgaggguauacaaagggaggcccgggccaugaggagcccgugccaaugaguacuuacggguggaauauaguuaagcuuaugagcggaaaagacguauucuaccugccucccgaaaagugugauaccuugcugugcgacaucggugaguccucuccuagcccaacaguggaagaguccagaacuauuaggguccucaaaaugguggagcccugguuaaagaacaaucaguuuuguaucaaaguucugaacccuuauaugccaaccgugauugaacaccuugagcgccugcagcggaaguacggcgggaugcuagucagaaauccccucucacguaacucuacacacgaaauguauuggaucaguaauggaaccggcaacauugugucgagcguaaauaugguguccaggcuguugcugaaccgguucacuaugacgcaucgccgaccgacaaucgagaaggauguugaccucggugcugggaccagacacgucaacgccgaaccugagacuccaaauauggacgugauaggagagaggauuaaacggaucaaggaagagcauucuucaaccuggcacuacgaugacgaaaaccccuauaaaacaugggcauaccacggcagcuaugaggugaaggccacgggcuccgcuaguucuaugaucaauggggucguuaaacuucugaccaagccuugggaugugguaccaauggugacucaaauggcgaugacagacaccacucccuuuggacagcagcgcgucuucaaggaaaaaguggauacaagaaccccgaggccuaugcccgguacacgaaagguuauggagauuacugccgagugguuauggcggacccugggccguaacaaaaagccaagauugugcacgcgcgaagaguuuaccaaaaaggugaggacaaaugcagcuaugggggccgucuucacugaagagaaccaaugggacagcgcacgggccgcuguggaagaugaggaguuuuggaagcucguagacagagaacgcgagcugcauaaacuaggaaaguguggcucaugcguuuacaauaugauggguaaaagggaaaagaaacuuggggaguucggaaaggccaaaggcucccgagcgauaugguacauguggcugggcgcacgguaucucgaguuugaagcccugggguucuugaacgaggaucacugguuuaguagagaaaauagcuacucuggaguggagggugaaggccugcauaagcucggguauauccuuagggacauuuccaagaucccuggaggcgcuauguacgccgaugacaccgcagguugggacacacgcauuacugaggaugaccugcacaacgaggaaaaaaucacccagcagauggaucccgagcaucgucaguuagcuaaugccauauucaagcugacguaucaaaacaaagucgugaaggugcagcggccaacacccaaagggaccgucauggacaucauuucaagaaaggaucagaggggaagcggccagguuggcacuuacggguugaauacauuuaccaacauggaagcucaacucgugcgccagauggagggagaagguguacugucgaaggccgaccuagagaauccucaccuucuggagaaaaagaucacucaguggcucgaaaccaaaggcguggagcgacugaagcggauggcaauuucuggggaugacugcgucgugaaaccaaucgaugacagauucgcgaacgccuuguuagcucugaacgauaugggaaagguuaggaaggacauaccgcaguggcaacccaguaaaggcuggcacgauuggcagcaggugccuuucuguucccaucacuuucaugaacucauuaugaaggacggucgcaaacuugucgugccaugcagaccccaggacgagcugaucgggcgggccaggaucagccaaggagcaggcuggucacuaaaggaaacagcuugucugggcaaagccuaugcacagauguggucccucauguacuuccaccgucgagauuugcgccuggccucuaaugcgauuugcagcgcuguaccuguucacuggauaccaaucaguagaacgaccugguccauucaugcccaccaucaguggaugacuacagaggacaugcuuaccguguggaaccgggucuggaucgaggauaaucccuggauggaagacaagacuccugugacaaccugggaggauguuccguaccuggggaagagggaagaccaaugguguggaagccucauugguuuaacgucucgcgcaacaugggcccagaacauccugaccgcuauacagcaggugagaucauugaucggcgaugaggaguuucuggacuauaugccaaguaugaaacgguucaggaaggaagaggaauccgagggggccauuugguga

SEQ ID NO: 15575 - RNA, 9873 nt, Artificial Sequence
  derived and/or modified CDS sequence (opt3) from DENV-3__EU660411__SS-prME
accagccugugccucaugaugaugcuucccgcaacccuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucagcuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucagugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacuaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgaguccgacaugauuaucccaaagucacuggcaggcccgauuagucagcauaaucacaggcccggguaucauacucaaaccgcgggaccuuggcaccuuggcaaauuggaacuggauuucaacuacugcgaggggacaacuguggugaucaccgagaauuguggaacacguggcccaucuuuacggacgaccacugucagcgguaagcucauacacgaauggugcugucgauccugcacacugcccccucuuagauauaugggggaggacggauguugguacggcauggaaauuaggccaaucaacgagaaagaagagaauaugguuaagucacuggugagcgccgguucuggcaagguagauaacuuuaccauggggguguugugccucgcuauccuguucgaggaagucaugcgcggaaaauucggcaagaaacauaugauugccggggugcuauuuacuuucguucugcuccuguccggacagaucacauggcgggacauggcacacacccuuauuaugauaggcaguaaugcuagcgauagaauggguaugggggugacguauuuggcccugaucgcaacuuuuaagauucagcccuucuuagcccucggauuuuuccugaggaaacuuaccucucgcgagaaccugcuacucggcgucggccuggcuauggcgacaaccuugcaacugccggaagacaucgagcagauggccaaugggauugcauuaggacucaugacucugaaacuuaucacacaguuugaaaccuaccagcuguggacagcuuuggugucccucacuuguucaaacaccauauucacgcugacaguugccuggcgaaccgccacucuaauccuggcuggugugagucuucucccucugugccaaagcucguccaugcggaagaccgauugguugccaaugacagucgcagccaugggcguacccccucugcccuuauuuauuuucucucucaaagacacuccaaagcguagaagcuggccucugaaugagggggugauggcgguuggacuugugucaauccuggcuaguuccuugcucaggaacgauguccccauggccggcccacugguggccggugggcuacugauugccuguuauguaaucaccggaacgucugcugaccuuacaguggagaaagcagccgacgucaccugggaagaggaagcggagcagacuggcguuagccauaaccucaugauaacaguggaugacgauggcaccaugcgcauuaaggacgaugaaacugagaauauccugacaguguuguuaaaaaccgcucugcucaucgucuccgggauuuuuccguacucaauaccugccacgcugcuuguguggcacacuuggcagaagcagacccaacggagcggaguucugugggacguacccaguccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaacggaaagaggcuggagccuaauugggcuucugucaagaaggaucucaucuccuauggcggcggguggcgccugagcgcccaguggcaaaaaggagaagagguccaggugauugcaguugaaccagguaagaaccccaagaauuuccagacgaugccuggcaucuuccagacaacuaccggggagauaggagcuaucgcccuugacuuuaaaccgggcacaucggguucaccaauuaucaaccgggaagggaagauugugggauuauacggcaauggcgucgugaccaaaaacgggggauauguuucugguaucgcgcaaacuaaugccgagcccgauggcccuaccccagagcuggaagaggaaauguucaagaaaagaaaccucacaauaauggacuugcaucccgggaguggaaagacgaggaaguaccugccugcaauugugcgugaggcuaucaaacgccggcucagaacucugauccuugccccgaccagggucguggcugcagaaauggaggaggcccugaagggcuugcccauucgauaucagacaaccgccaucaaauccgaacacacuggucgggagauaguagaucuaaugugccaugcuacauuuaccaugcgccugcucagcccagugagaguuccuaauuacaacuuaauuaucauggacgaagcgcacuucacggaucccgcaucuauugccgcuaggggguauaucagcacucgggucggaaugggcgaggccgcagccauauuuaugacagcuaccccaccuggcaccgcggaagccuucccccaguccaaugcaccaauucaggacgaggagcgagacaucccggaaagaucauggaacagugggaaugaguggaucacugauuuugugggaaagacagugugguucgucccuagcauuaaagcugguaacgacaucgccaacugucugcgcaagaauggcaagaaaguaauucaacuuucuaggaagaccuuugauacagaauaccagaaaacucgucugaacgacugggauuucgugguuacgaccgacauauccgagaugggggcaaauuuuaaggccgaucgggugaucgaccccagaaggugccucaaaccagucauuuugacagauggacccgagcgcgugauccuggcuggcccuaugccaguuacugccgcgucagcagcccagcgaagaggucggguggggaggaacccccagaaggaaaaugaccaauacaucuucaccggccagccucucaacaaugaugaggaccaugcucacuggacagaagccaagaugcugcuugacaacauuaauaccccggagggaauaaucccagcucuauucgaacccgagcgcgagaaaagugcagccauugauggcgaauaucgucugaagggggagagcagaaaaacuuuugucgaauugaugcggaggggagacuuaccuguguggcuggcucacaagguagccuccgaggguaucaaauacacggaucgcaaguggugcuucgacggcgaacgaaacaaucagauucucgaggagaacauggauguggaaaucuggaccaaagagggggaaagaaagaagcugcggcccagguggcuugacgcacgcacauauucugauccacuggcgcucaaagaguuuaaggacuucgccgcuggaagaaaaucgauagccuuggaucugguuacugaaaucggcagggucccuagccaucuagcauaccggacccguaaugcucuggacaaccucgugaugcuucacacaucagagcauggugggcgcgccuaucgacacgcaguggaggaacugcccgagaccauggaaacuuuauugcugcucggccugaugauucuucugacaggaggcgccaugcucuuuuugaucuccgggaagggaauugguaaaacgaguaucggccugauaugugucauuguuucuagcgggauguuauggauggcugaugugccacuacaguggaucgcguccgccauuguacuggaguucuuuaugauggugcuccuuaucccugagccggaaaagcaaagaacaccccaggacaaucagcuggcauacgucgugauaggaaucuugacucuggcugccauuguugccgcaaacgagaugggccuccuggaaacaaccaagagggaucuugguaugucaaaagagccagggguggucucuccuaccagcuaucucgacguagaccugcaccccgcuagugccuggacauuguacgcgguggcuacuacgguuaucaccccaaugcugcggcauacaauugaaaauuccacugccaacgugagcuuagcagccaucgcuaaccaagcagucgugcuaaugggccuggauaagggauggccuauaucuaaaauggaccucggcgucccccuucuggccuuggggugcuacucacaggugaauccgcugacccucacagcggcuguucugcuuuuagugacccacuaugccauuaucggaccaggccugcaggcaaaggccacucgcgaggcucagaaaagaacggccgcagguaucaugaagaacccuacaguagaugggauuaugaccaucgaccucgaucccgugauauacgacuccaaguucgagaaacaauugggacaggucaugcugcuaguucugugugcugugcagcuccuucugaugaggacaaguugggccuugugcgaagcgcugacccucgccacaggcccaauuacuacccugugggaggguagccccggcaaguuuuggaauacaacgaucgcagucucgauggcuaacauuuuccgggggucuuauuuagccggagcaggccuugcuuuuuccaucaugaaaagcguggggaccggacgaagaggcacugguucacagggggaaacacugggagagaaguggaaaaagaagcucaaucaacuaagucgcaaagaguucgaucuguacaagaaaucuggcauaaccgagguagacaggacugaggccaaggaagguuugaaacggggcgagacaacccaucacgccgugucccgugggagcgcgaagcugcagugguuuguugaaagaaacauggugaucccugagggaagggucauugaucucggcugugggcgcggaggcuggucauauuacugcgcuggucuuaaaaaggugacggaaguccggggguauaccaagggaggcccgggccaugaggagcccgugccaaugaguacauacggguggaauaucguuaaacugaugagcggaaaggacguauucuacuugccucccgaaaaaugugauacucugcucugcgacauuggugaguccucuccuagcccaaccguggaagagucccgaacaaucagagucuuaaagaugguggagcccuggcugaaaaacaaucaguucuguauuaagguucuuaacccuuauaugccaacugugaucgaacaccuggagaggcuacagcgcaaguacggcgggaugcucguccggaauccccugucaagaaacucuacccacgaaauguauuggauaaguaauggaacaggcaacauugugucgagcguaaauauggugucccguuugcugcucaacagguuuaccaugacucaucggcgcccgacgaucgagaaagauguugaccuuggugcagggacacgacacgucaacgccgaaccugagaccccaaauauggacgugaucggagagagaauuaagaggauaaaagaagaacacucuucaacuuggcacuacgaugacgaaaaccccuauaagaccugggcuuaccacggcagcuaugaggugaaagccacaggcuccgcaaguucuaugaucaauggggucguuaagcuguuaacgaagccuugggaugugguaccaauggugacccaaauggccaugacugacacaacccccuucggacagcagcgggucuuuaaagaaaagguggauacucgcacaccgagaccuaugcccgguaccaggaaaguuauggagauuacagcugaguggcuguggcgaacuuugggccggaacaagaaaccacgucucugcaccagagaagaguucacgaagaaggugcgcaccaaugcggccaugggggcagucuuuacagaagagaaccaaugggacagcgcuagggccgcaguggaagaugaggaguucuggaaacugguagaccgggaaagagagcuacauaaacuuggaaaauguggcucaugcguuuacaauaugauggguaagcgcgagaaaaagcugggggaguuuggaaaagccaagggcuccagggcuaucugguacauguggcucggcgcccgauaucuggaguucgaagcguugggguuucugaacgaggaucacugguucagucgggaaaauagcuacucuggaguggagggugaaggccuccauaaacuuggguauauucugagagacaucuccaaaauaccuggaggcgcaauguacgccgaugacacugcugguugggacaccaggaucacagaggaugacuuacacaacgaggaaaagauuacucagcagauggaucccgagcaucgccagcuggccaaugcaaucuuuaaauugaccuaucaaaacaaggucgugaaagugcagcguccaacgcccaaggggacagucauggacauuaucucacggaaggaucagagaggaagcggccagguuggcaccuacgggcucaauacuuucacaaacauggaagcucaacuggugaggcagauggagggagaagguguacuaucgaaagccgaccuugagaauccucaucugcucgagaagaaaauaacccaguggcuggaaacuaagggcguggagcgcuugaaacgaauggcuauuucuggggaugacugcgucgugaagccaaucgaugaccgguuugccaacgcauuacuggcgcucaacgauaugggaaagguuagaaaagacaucccgcaguggcaacccaguaagggcuggcacgauuggcaacaggugccuuucuguucccaucacuuccaugaacuuauuaugaaagacgguaggaagcuggucgugccaugccgcccccaggacgagcuaauagggagagcccggaucagccaaggagcuggcuggucacugaaagaaaccgccugucucggcaaggcauaugcucagaugugguccuugauguacuuucacaggcgugaucugcgacuugccucuaaugcaauuugcagcgccguaccuguucacuggaucccaacaagucgcacgaccugguccauucaugcgcaccaucaguggaugacuacagaggacaugcugaccguguggaacagagucuggaucgaggauaaucccuggauggaagacaagacuccugugacaaccugggaggauguuccguaccucgggaaacgggaagaccaaugguguggcagcuuaauaggucugacgucuagggcuacaugggcccagaacaucuugaccgcaauucaacaggugcgcucacugaucggcgaugaggaguuccucgacuauaugccaaguaugaagagauuucggaaagaagaggaauccgagggggccauuugguga

SEQ ID NO: 15576 - RNA, 9873 nt, Artificial Sequence
  derived and/or modified CDS sequence (opt3) from DENV-3__FJ432722__SS-prME
acaagccugugccucaugaugaugcuucccgcaacacuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucaccaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgaguccgacaugauuaucccaaagucacuggcaggcccgauuagucagcauaaucacaggcccggguaucauacucaaaccgcgggaccuuggcaccuuggcaaauuggaacuggauuucaacuacugcgaggggacaacuguggugaucaccgagaauuguggaacacguggcccaucuuuacggacgaccacugucagcgguaagcucauacacgaauggugcugucgauccugcacacugcccccucuuagauauaugggggaggacggauguugguacggcauggaaauuaggccaaucaacgagaaagaagagaauaugguuaagucacuggugagcgccgguucuggcaagguagauaacuuuaccauggggguguugugccucgcuauccuguucgaggaagucaugcgcggaaaauucggcaagaaacauaugauugccggggugcuauuuacuuucguucugcuccuguccggacagaucacauggcgggacauggcacacacccuuauuaugauaggcaguaaugcuagcgauagaauggguaugggggugacguauuuggcccugaucgcaacuuuuaagauucagcccuucuuagcccucggauuuuuccugaggaaacuuaccucucgcgagaaccugcuacucggcgucggccuggcuauggcgacaaccuugcaacugccggaagacaucgagcagauggccaaugggauugcauuaggacucaugacucugaaacuuaucacacaguuugaaaccuaccagcuguggacagcuuuggugucccucacuuguucaaacaccauauucacgcugacaguugccuggcgaaccgccacucuaauccuggcuggugugagucuucucccucugugccaaagcucguccaugcggaagaccgauugguugccaaugacagucgcagccaugggcguacccccucugcccuuauuuauuuucucucucaaagacacuccaaagcguagaagcuggccucugaaugagggggugauggcgguuggacuugugucaauccuggcuaguuccuugcucaggaacgauguccccauggccggcccacugguggccggugggcuacugauugccuguuauguaaucaccggaacgucugcugaccuuacaguggagaaagcagccgacgucaccugggaagaggaagcggagcagacuggcguuagccauaaccucaugauaacaguggaugacgauggcaccaugcgcauuaaggacgaugaaacugagaauauccugacaguguuguuaaaaaccgcucugcucaucgucuccgggauuuuuccguacucaauaccugccacgcugcuuguguggcacacuuggcagaagcagacccaacggagcggaguucugugggacguacccaguccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaacggaaagaggcuggagccuaauugggcuucugucaaaaaggaucucaucuccuauggcggcggguggcgccugagcgcccaguggcaaaaaggagaagagguccaggugauugcaguugaaccagguaagaaccccaagaauuuccagacgaugccuggcaucuuccagacaacuaccggggagauaggagcuaucgcccuugacuuuaaaccgggcacaucggguucaccaauuaucaaccgggaagggaagguggucggauuauacggcaauggcgugguuaccaaaaacgggggauaugugucugguauugcgcaaacuaaugccgagcccgauggcccuaccccagagcuggaagaggaaauguucaagaaaagaaaccucacaaucauggacuugcaucccgggaguggaaagacgaggaaguaccugccugcaauaguccgugaggcuauuaaacgccggcucagaacucugauccuugccccgaccagggugguagcugcagaaauggaggaggcccugaagggcuugcccauccgauaucagacaaccgccacuaaauccgaacacacaggucgggagauuguggaucuaaugugccaugcuaccuuuacgaugcgccugcucagcccaguuagagucccuaauuacaacuuaaucauaauggacgaagcgcacuucacugaucccgcaucuauugccgcuaggggguauaucagcacacgggugggaaugggcgaggccgcagccauuuuuaugaccgcuaccccaccuggcacugcggaagccuucccccaguccaaugcaccaauccaggacgaggagcgagacauaccggaaagaucauggaacagugggaaugaguggauuacagauuuugugggaaagaccgucugguucguaccuagcaucaaagcugguaacgacaucgccaacugucugcgcaagaauggcaagaaagugauucaacuuucuaggaagacauuugauacugaauaccagaaaacgaagcugaacgacugggauuucguugugaccacagacaucuccgagaugggggcaaauuuuaaagccgaucgugucauugacccccggagaugccucaagccagugauauugacugauggacccgagaggguuauccuggcuggcccuaugccagugaccgccgcgucagcagcccagcgccgagguagagucgggcggaacccccagaaggaaaaugaccaauacauuuucacaggccagccucucaacaaugaugaggaccaugcucacuggaccgaagccaaaaugcugcuugacaacaucaauacuccggagggaaucauuccagcucuauucgaacccgagagggagaagagugcagccauagauggcgaauaucgccugaaaggggagagccguaagacguuuguggaauugaugagacggggagacuuaccuguauggcuggcucacaaaguggccuccgaggguaucaaguacaccgauaggaaauggugcuucgacggcgaacgcaacaaucagauucucgaggagaacauggauguugaaaucuggacaaaggagggggaacgaaagaaacugagaccccgguggcuugacgcaaggacuuauucugauccacuggcgcucaaggaguuuaaagacuucgccgcuggacgcaagucgauugccuuggaucuggucaccgaaaucggcagagugccuagccaucuagcauacaggacacggaaugcucuggacaaccucgugaugcuucacaccucagagcauggugggcgugccuaucgccacgcagucgaggaacugcccgagacuauggaaacauuauugcugcucggccugaugauacuucugacgggaggcgccaugcucuuuuugaucuccgggaaaggaauugguaagaccaguaucggccugauuuguguuaucgugucuagcgggauguuauggauggcugauguaccacuacaguggauagcguccgccauugugcuggaguucuuuaugaugguccuccuuaucccugagccggaaaagcaacgaacuccccaggacaaucagcuggcauacgugguuauuggaaucuugacacuggcugccauaguggccgcaaacgagaugggccuccuggaaaccaccaaaagagaucuugguaugucaaaggagccaggggucguaucuccuacaagcuaucucgacguggaccugcaccccgcuagugccuggacuuuguacgcgguugcuacgaccgugaucacaccaaugcugaggcauacuauugaaaauuccaccgccaacgucagcuuagcagccaucgcuaaccaagcagugguccuaaugggccuggauaaaggauggccuauuucuaagauggaccucggcgugccccuucuggccuuggggugcuacucacagguuaauccgcugacacucaccgcggcugugcugcuuuuaguaacucacuaugccaucauaggaccaggccugcaggcaaaagccacgcgggaggcucagaagcgcacagccgcagguauuaugaagaacccuaccguggaugggaucaugacuaucgaccucgaucccgucauuuacgacuccaaauucgagaagcaauugggacagguuaugcugcuagugcugugugcuguccagcuccuucugaugagaaccaguugggccuugugcgaagcgcugacacucgccacuggcccaaucaccacacugugggaggguagccccggcaaauuuuggaauacgaccauagcagugucgauggcuaacauuuucagggggucuuauuuagccggagcaggccuugcuuuuuccaucaugaaaagcguagggacuggacggcgaggcacagguucacagggggaaacccugggagagaaauggaagaagaaacucaaucaacuaaguagaaaggaguucgaucuguacaaaaagucuggcauuacugagguggaccgcacagaggccaaagaagguuugaagaggggcgagaccacgcaucacgccguuucccgggggagcgcgaaacugcagugguuuguggaacguaacauggucaucccugagggaagagugauagaucucggcugugggaggggaggcuggucauauuacugcgcuggucuuaagaaggucaccgaagugcgcggguauacaaaaggaggcccgggccaugaggagcccguuccaaugaguacuuacggguggaauaucguaaagcugaugagcggaaaagacguguucuacuugccucccgaaaagugugauacccugcucugcgacauuggugaguccucuccuagcccaacagucgaagagucccggacuauccgaguguuaaaaaugguugagcccuggcugaagaacaaucaguucuguauuaaggugcuuaacccuuauaugccaaccgucaucgaacaccuggagagacuacagaggaaauacggcgggaugcucgugcgcaauccccugucacggaacucuacacacgaaauguauuggauuaguaauggaaccggcaacaucguaucgagcgugaauaugguuuccagauugcugcucaaccguuuuacuaugacgcauaggcggccgacaauagagaaggaugucgaccuuggugcagggacccgccacgugaacgccgaaccugagacuccaaauauggacgugauuggagagcgaaucaaaagaaucaaggaagaacacucuucaaccuggcacuacgaugacgaaaaccccuauaaaacaugggcuuaccacggcagcuaugaggucaaggccacgggcuccgcaaguucuaugauuaaugggguugugaagcuguuaaccaaaccuugggauguagugccaauggucacucaaauggccaugacagacaccacucccuucggacagcagaggguguuuaaggaaaaaguugauacacggaccccgcgcccuaugcccgguacaagaaaggugauggagauaacugcugaguggcuguggaggaccuugggccgaaacaaaaagccacggcucugcacgcgugaagaguucaccaagaaagucagaacaaaugcggccaugggggcaguguuuacugaagagaaccaaugggacagcgcucgcgccgcaguagaagaugaggaguucuggaagcugguugacagggaacgggagcuacauaaacuuggaaaguguggcucaugcguguacaauaugauggguaaaagagaaaagaaacugggggaguuuggaaaggccaagggcucccgcgcuaucugguacauguggcucggcgccagguaucuggaguucgaagcguugggguuucugaacgaggaucacugguucagucgagaaaauagcuacucuggagucgagggugaaggccuccauaaacuuggguauauucugcgggacaucuccaagauuccuggaggcgcaauguacgccgaugacaccgcugguugggacacaagaaucacugaggaugacuuacacaacgaggagaaaauaacccagcagauggaucccgagcauaggcagcuggccaaugcaaucuuuaaguugacguaucaaaacaaaguggugaagguccagcgcccaacacccaaggggaccguuauggacauuaucucacguaaagaucagcggggaagcggccaggugggcacuuacgggcucaauacauucaccaacauggaagcucaacugguaagacagauggagggagaaggugugcuaucgaaggccgaccuugagaauccucaucugcucgagaaaaagauuacucaguggcuggaaaccaaaggcgucgagagguugaagcgcauggcuaucucuggggaugacugcgugguuaagccaauagaugaccgauuugccaacgcauuacuggcgcucaacgauaugggaaaagugcggaaggacauuccgcaguggcaacccaguaaaggcuggcacgauuggcagcaggucccuuucuguucccaucacuuccaugaacuuaucaugaaggacgguagaaaacuggugguaccaugcaggccccaggacgagcuaaucgggcgcgccagaauuagccaaggagcuggcuggucacugaaggaaacagccugucucggcaaggcauaugcucagaugugguccuugauguacuuucaccggagggaucugcgucuugccucuaaugcaauaugcagcgccguuccugugcacuggaucccaacgagucgaaccacuugguccauucaugcgcaccaucaguggaugacaaccgaggacaugcugacugucuggaaccgcguguggaucgaggauaaucccuggauggaagacaaaacaccuguuaccacgugggaggaugugccguaccucgggaagagagaagaccaaugguguggcagcuuaauuggucugacaucucgggcuaccugggcccagaacaucuugacugcaauacagcaggucaggucacugaucggcgaugaggaguuccucgacuauaugccaaguaugaaacgcuuuagaaaggaagaggaauccgagggggugauuugguga

SEQ ID NO: 15577 - RNA, 9873 nt, Artificial Sequence
  derived and/or modified CDS sequence (opt3) from DENV-3__FJ432728__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgaggacuguggaacacguggcccaucuuuacggacgaccacugugagcgguaagcucauacacgaauggugcugucgauccugcacacugcccccucuuagauauaugggggaggauggauguugguacggcauggaaauuaggccaaucaaugagaaagaagagaacauggucaagucacugguuagcgcugguucuggcaagguggacaauuuuaccauggggguauugugccucgccauccuguucgaggaagugaugcgcggaaaauucggcaagaaacauaugauugcagggguccuauuuacuuucgugcugcuccuguccggacagaucacauggcgggauauggcucacacccuuauuaugauaggcaguaacgccagcgacagaauggguauggggguuacguauuuggcacugaucgccacuuuuaagauucagcccuucuuagcucucggauuuuuccugaggaaacuuaccucucgcgagaaucugcuacucggcgugggccuggcgauggccacaaccuugcaacugccggaagauaucgagcagauggcaaacgggauugcuuuaggacucaugacucugaagcuuaucacacaguuugaaaccuaccagcuguggacagccuuggucucccucacuuguucaaauaccauauucacgcugacaguggccuggcgaaccgcuacucuaauccuggcagguguuagucuucucccucugugccaaagcucguccaugcggaagaccgacugguugccaaugacaguggccgcgaugggcguccccccucugcccuuauuuauuuucucucucaaagauacuccaaagcguagaagcuggccucugaacgaggggguaauggcugugggacuuguuucaauccuggccaguuccuugcucaggaaugacgugcccauggcaggcccacuggucgccggugggcuacugauugcuuguuaugugaucaccggaacgucugcagaccuuacaguagagaaagccgcggaugugaccugggaagaggaagcugagcagacuggcgucagccauaaccucaugauaacaguugacgaugacggcaccaugcgcauuaaggaugacgaaacugagaacauccugacaguguuguuaaaaaccgcccugcucaucguguccgggauuuuuccguacucaauaccugcaacgcugcuugucuggcacacuuggcagaagcagacccaacggagcggagugcugugggauguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaauggaaagcgacuggagccuaacugggccucugugaaaaaggaccucaucuccuauggcggcggguggcgccugagcgcacaguggcaaaaaggagaagagguacaggucauugcuguggaaccagguaagaaucccaagaacuuccagacgaugccuggcaucuuccagacaacuaccggggagauaggagccaucgcgcuugauuuuaaaccgggcacaucggguucaccaauuaucaaucgggaagggaagguugugggauuauacggcaacggcgucgugaccaaaaaugggggauauguuucugguauugcccaaacuaacgcagagcccgacggcccuaccccagagcuggaagaggaaauguucaagaaaagaaaucucacaaucauggauuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaccuaaugugccaugcgaccuuuacgaugcgccugcucagcccagugagaguuccuaacuacaauuuaaucauaauggaugaagcacacuucacugaccccgccucuauugcugccaggggguauaucagcacacgggucggaaugggcgaggcagccgcuauuuuuaugaccgcgaccccaccuggcacugccgaagcauucccccaguccaacgcuccaauccaggacgaggagcgagauauaccggaaagaucauggaauagugggaacgaguggauuacagacuuugugggaaagaccgugugguucgucccuagcaucaaagccgguaaugauaucgcaaacugucugcgcaagaacggcaagaaaguaauucaacuuucuaggaagacauuugacacugaauaccagaaaacgcgucugaaugauugggacuucgugguuaccacagauaucuccgagaugggggccaacuuuaaggcugaccgggugauugaucccagaaggugccucaaaccagucauauugacugacggacccgagcgcgugauccuggccggcccuaugccaguuaccgcggcaucagccgcucagcgaagaggucggguggggaggaauccccagaaggaaaacgaucaauacauuuucacaggccagccucucaauaacgacgaggaccaugcccacuggaccgaagcuaagaugcugcuugauaauaucaacacuccggagggaaucauuccagcacuauucgaacccgagcgcgagaaaagugccgcuauagacggcgaauaucgucugaagggggagagcagaaaaacguuugucgaauugaugcggaggggagauuuaccuguguggcuggcccacaagguagcauccgaggguaucaaauacaccgaccgcaaguggugcuucgauggcgaacgaaauaaccagauucucgaggagaauauggacguggaaaucuggacaaaagagggggaaagaaagaagcugcggcccagguggcuugaugcgcgcacuuauucugacccacuggcccucaaagaguuuaaggauuucgcugccggaagaaaaucgauugcauuggaccugguuaccgaaaucggcagggucccuagccaucuagcuuaccggacacguaacgcccuggauaaucucgugaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggacgugccacuacaguggauagccuccgcaauuguacuggaguucuuuaugauggugcuccuuaucccugagccggaaaagcaaagaacuccccaggauaaccagcuggcuuacgucgugauuggaaucuugacacuggccgccauaguugcagcuaaugagaugggccuccuggaaaccaccaagagggaccuugguaugucaaaagagccagggguggucucuccuacaagcuaucucgacguagaucugcaccccgccagugcguggacuuuguacgcuguggccacgaccguuaucacaccaaugcugcggcauacuauugaaaacuccaccgcaaaugugagcuuagccgcuaucgcaaaccaagccgucgugcuaaugggccuggacaagggauggccuauuucuaaaauggaucucggcgucccccuucuggcguuggggugcuacucacaggugaacccgcugacacucaccgcugccguucugcuuuuagugacucacuaugcaaucauaggaccaggccugcaggccaaggcuacgcgcgaggcccagaaaagaacagcagcugguauuaugaagaauccuaccguagacgggaucaugacuaucgaucucgaccccgugauuuacgauuccaaguucgagaaacaauugggacaggucaugcugcuaguucugugugccgugcagcuccuucugaugaggaccaguugggcguugugcgaagcccugacacucgcaacuggcccaaucaccacacugugggaggguagccccggcaaguuuuggaacacgaccauagcugucucgauggccaauauuuuccgggggucuuauuuagcaggagcuggccuugccuuuuccaucaugaaaagcguggggacuggacgaagaggcacagguucacagggggaaacccugggagagaaguggaaaaagaagcucaaccaacuaagucgcaaagaauucgaccuguacaagaaaucuggcauuacugagguagauaggacagaggccaaggaagguuugaaacggggcgagaccacgcaucacgcggugucccgugggagcgcuaagcugcagugguuuguugaaagaaauauggugaucccugagggaagggucauagaccucggcugugggcgcggaggcuggucauauuacugcgcaggucuuaaaaaggugaccgaaguccggggguauacaaagggaggcccgggccaugaggagcccgugccaaugaguacuuacggguggaaccugguuaaauugaugagcggaaaggauguauucuaccugccucccgaaaaaugugacacccucuuaugcgauaucggugaguccucuccuagcccaacaguggaagagucccgaacuauuagaguccugaagaugguggagcccuggcuuaaaaauaaccaguucuguaucaagguucugaauccuuauaugccaaccgugauugaacaccuagagaggcuccagcgcaaguacggcgggaugcugguccggaaccccuugucaagaaauucuacacacgaaauguauuggaucaguaacggaaccggcaauauugugucgagcguaaacauggugucccgucugcuccuuaauagguuuacuaugacgcaucggcgcccgacaaucgagaaagacguugaccugggugccgggacccgacacgucaacgcugaaccugagacuccaaacauggaugugauaggagagagaauuaagaggaucaaagaagagcauucuucaaccuggcacuacgacgaugaaaaucccuauaagacaugggccuaccacggcagcuaugaggugaaagcaacgggcuccgccaguucuaugaucaacggggucguuaaguuacugaccaagccuugggacgugguaccaauggugacucaaauggcuaugacagauaccacucccuucggacagcagcgggucuuuaaagaaaagguggacacacgcaccccgagaccuaugcccgguacaaggaaaguuauggagauuacugcggagugguuguggcgaacccucggccggaauaagaaaccacgucugugcacgagagaagaguucaccaagaaggugcgcacaaacgccgcaaugggggcugucuuuacugaagagaaucaaugggauagcgccagggcagccguggaagacgaggaguucuggaaacuaguagaucgggaaagagagcuucauaagcugggaaaauguggcucaugcguuuacaacaugauggguaagcgcgaaaaaaagcucggggaguuuggaaaagcuaagggcuccagggccauaugguacauguggcugggcgcgcgauauuuggaguucgaagcacugggguuucucaaugaggaccacugguucagucgggaaaacagcuacucuggaguggagggugaaggccuucauaagcugggguauaucuuaagagauauuuccaaaaucccuggaggcgccauguacgcugacgacaccgccgguugggauacaaggauuacugaggacgaucugcacaaugaggaaaagaucacccagcagauggaccccgagcaucgccaguuggcaaacgcuauauuuaaacucacguaucaaaauaaggucgugaaagugcagcguccaacacccaaggggaccgucauggauaucauuucacggaaggaccagagaggaagcggccagguuggcacuuacgggcugaacacauucaccaauauggaagcccaacuagugaggcagauggagggagaagguguacuuucgaaagcugaucuggagaacccucaccuccuggagaagaaaaucacucagugguuggaaaccaagggcguggagcgcuuaaaacgaauggccauuucuggggacgauugcgucgugaagccaaucgacgaucgguuugcaaaugcgcugcucgcccuuaacgacaugggaaagguuagaaaagauauaccgcaguggcaacccaguaagggcuggcacgacuggcagcaggugccuuucuguucccaucacuuccaugaacugauuaugaaagacgguaggaagcuagucgugccaugccgcccccaggaugagcugaucgggagagcucggaucagccaaggagccggcuggucacucaaagaaacagcauguuugggcaaggcuuaugcccagauguggucccugauguacuuucacaggcgugaccuucgacuggcaucuaacgccauuugcagcgcgguaccuguucacuggauaccaacgagucgcaccacuugguccauccaugcucaccaucaguggaugacaaccgaggauaugcucacuguguggaauagagucuggauugaggacaaccccuggauggaagauaagacaccugugaccacgugggaggacguuccguacuuagggaaacgggaagaucaaugguguggaagccugaucgguuugacaucuagggccaccugggcacagaauauucugacugccauccagcaggugcgcucacucauaggcgacgaggaguuccuugauuauaugccaaguaugaagagauuucggaaagaagaggaauccgagggggcuaucugguga

SEQ ID NO: 15578 - RNA, 9873 nt, Artificial Sequence
  derived and/or modified CDS sequence (opt3) from DENV-3__FJ432731__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuauguucgugcugcuccuguccggacagaucacuuggcgggacauggcucagacacuuauuaugauaggcaguaaugccagcgauagaauggguauggggguuaccuauuuggcacugaucgccacguuuaagauucaacccuucuuagcucucggauuuuuccugaggaaacuuacuucucgcgagaaccugcuacucggcgugggccuggcgaugaccacaaccuugcagcugccggaagacaucgagcagauggccaaugggauugcauuaggacucaugacucugaagcuuaucacacaguuugaaaccuaccaacuguggacagcuuuggucucccucacuuguucaaacaccauauucacgcugacaguggccuggcgaaccgccacucuaauccuggcugguguuagucuucucccucugugccagagcucguccaugcggaagaccgauugguugccaaugacaguggcagccaugggcguccccccucugcccuuauuuauuuucucucucaaagacacuccaaagcguagaagcuggccucugaaugaggggguaauggcggugggacuuguuucaauccuggcuaguuccuugcucaggaacgaugugcccauggccggcccacuggucgcaggugggcuacugauugccuguuaugugaucaccggaacgucugcugaccuuacaguagagaaagcagccgacgugaccugggaagaggaagcggagcagacuggcgucagccacaaccucaugauaacaguugaugacgauggcaccaugcgcauuaaggacgaugaaacugagaauauccugacaguguuguuaaaaaccgcucugcucaucguguccgggauuuuuccguacucaauaccugccacgcugcuugucuggcauacuuggcagaagcaaacccagcggagcggagugcugugggacguucccaguccacccgagacacagaaagcagaauuggaggaagguguauacagaaucaagcagcaaggcauuuucgggaagacccaggugggagucggcgugcagaaagaggguguuuuucacacaauguggcaugugacuaggggggccguccuaacccacaacggaaagcgacuggagccuaauugggcuucugugaaaaaggaucucaucuccuauggcggcggguggcgccugagcgcccaauggcagaaaggagaagagguacaggucauugcaguggaaccagguaagaaccccaagaauuuccagacgaugccuggcaucuuccaaacaacuaccggggagauaggagcuaucgcccuugacuuuaaaccgggcacaucggguucaccaauuaucaaccgggaagggaagguugugggauuauacggcaauggcgucgugaccaaaaacgggggauauguuucugguauugcgcagacuaaugccgagcccgauggcccuaccccagagcuggaagaggaaauguucaagaaaagaaaccucacaaucauggacuugcaccccgggaguggaaagacgaggaaguaccugccugcaauagugcgugaggcuauuaaacgccggcucagaacucugauccuugccccgaccagggucguggcugcagaaauggaggaggcccugaagggcuugcccauccgauaucagacaaccgccacuaaauccgaacauacaggucgggagauuguagaucuaaugugccacgcuaccuuuacgaugcgccugcucagcccagugagaguuccuaauuacaacuuaaucauaauggacgaagcgcauuucacugaucccgcaucuauugccgcuaggggguauaucagcacacgggucggaaugggcgaggccgcagccauuuuuaugaccgcuaccccaccuggcacugcggaagccuucccccaguccaaugcaccaauccaagacgaggagcgagacauaccggaaagaucauggaacagugggaaugaguggauuacagauuuugugggaaagaccgugugguucgucccuagcaucaaagcugguaacgacaucgccaacugucugcgcaagaauggcaagaaaguaauucagcuuucuaggaagacauuugauacugaauaccagaaaacgcgucugaacgacugggauuucgugguuaccacagacaucuccgagaugggggcaaauuuuaaggccgaucgggugauugaccccagaaggugccucaaaccagucauauugacugauggacccgagcgcgugauccuggcuggcccuaugccaguuaccgccgcgucagcagcccagcgaagaggucggguggggaggaacccccaaaaggaaaaugaccaguacauuuucacaggccagccucucaacaaugaugaggaccacgcucauuggaccgaagccaagaugcugcuugacaacaucaauacuccggagggaaucauuccagcucuauucgaacccgagcgcgagaaaagugcagccauagauggcgaauaucgucugaagggggagagcagaaaaacguuugucgaauugaugcggaggggagacuuaccuguguggcuggcucacaagguagccuccgaggguaucaaauacaccgaucgcaaguggugcuucgacggcgaacgaaacaaucagauucucgaggagaacauggauguggaaaucuggacaaaagagggggaaagaaagaagcugcggcccagguggcuugacgcacgcacuuauucugauccacuggcgcucaaagaguuuaaggacuucgccgcuggaagaaaaucgauugccuuggaucugguuaccgaaaucggcagggucccuagccaccuagcauaccggacacguaaugcucuggacaaccucgugaugcuucauaccucagagcacggugggcgcgccuaucgacaugcaguggaggaacugcccgagacuauggaaacauuauugcugcucggccugaugauacuucugacgggaggcgccaugcucuuuuugaucuccgggaagggaauugguaaaaccaguaucggccugauuugugucaucguuucuagcgggauguuauggauggcugaugugccacuacaauggauagcguccgccauuauccuggaguucuuuaugaugguacuccuuauuccugagccggaaaagcagagaacuccccaggacaaucaacuggcauacguggucaucggaauauugacacuggcugccaucguggccgcaaacgagaugggccuccuggaaaccaccaagagggaucuugguaugucaaaagagccagggguugugucuccuacaagcuaucucgacgucgaccugcaccccgcuagugccuggacuuuguacgcgguagcuacgaccgugauuacaccaaugcugcggcacacuaucgaaaauuccaccgccaacguuagcuuagcagccauugcuaaccaggcagugguccuaaugggccuggauaagggauggccuaucucuaaaauggaccucggcgugccccuucuggccuuggggugcuacucacaggucaauccgcugacacucaccgcggcugugcugcuuuuaguuacucauuaugccauaauuggaccaggccugcaggcaaaggccacgcgcgaggcucaaaaaagaacagccgcagguaucaugaagaacccuaccguggaugggaucaugacuauugaccucgaucccguaaucuacgacuccaaguucgagaaacaguugggacaggugaugcugcuaguccugugugcuguucagcuccuucugaugaggaccaguugggccuugugcgaagcgcugacacucgccacuggcccaauaaccacacugugggaggguagccccggcaaguuuuggaauacgaccauugcagugucgauggcuaacaucuuccgggggucuuauuuagccggagcaggccuugcuuuuuccauuaugaaaagcgucgggacuggacgaagaggcacagguucacaaggggaaacccugggagagaaguggaaaaagaagcucaaucagcuaagucgcaaagaauucgaucuguacaagaaaucuggcaucacugagguggacaggacagaggccaaggaagguuugaaacggggcgagaccacgcaccaugccguaucccgugggagcgcgaagcugcagugguuuguggaaagaaacaugguuauaccugagggaagggugaucgaucucggcugugggcgcggaggcuggucauauuacugcgcuggucuuaaaaaggucaccgaagugcggggguauacaaagggaggcccgggccacgaggagcccgucccaaugaguacuuacggguggaaucuggugaaauugaugagcggaaaggacguuuucuaccugccucccgaaaaaugugauacccucuuaugcgacauuggugaguccucuccuagcccaacaguagaagagucccgaacuaucagagugcugaagauggucgagcccuggcuuaaaaacaaucaguucuguauuaaggugcugaacccuuauaugccaaccguuaucgaacaucuagagaggcuccaacgcaaguacggcgggaugcuggugcggaaucccuugucaagaaacucuacacacgaaauguauuggauuaguaauggaaccggcaacaucgucucgagcgugaauaugguaucccgucugcuccuuaacagguuuacuaugacgcaccggcgcccgacaauagagaaagauguggaccugggugcagggacccgacauguuaacgccgaaccugagacuccaaauauggacgucauuggagagagaaucaagaggaucaaagaagagcacucuucaaccuggcauuacgaugacgaaaaccccuauaagacaugggcuuaccacggcagcuaugaggugaaagccacgggcuccgcaaguucuaugauuaaugggguggucaaguuacugaccaagccuugggauguugugccaaugguaacucagauggccaugacagacaccacucccuucggacagcaacggguguuuaaagaaaaggucgauacacgcaccccgagaccuaugcccgguacaaggaaagugauggagauaacugcugagugguuguggcgaacccucggccggaacaagaaaccacgucugugcacgagagaagaguucaccaagaagguucgcacaaaugcggccaugggggcaguguuuacugaagagaaccagugggacagcgcuagggccgcagucgaagaugaggaguucuggaaacuaguggaccgggaaagagagcuucacaagcugggaaaauguggcucaugcguauacaauaugauggguaagcgcgaaaaaaagcucggggaguuuggaaaagccaagggcuccagggcuaucugguacauguggcugggcgcccgauauuuggaguucgaagcgcugggguuucucaacgaggaucauugguucagucgggaaaauagcuacucuggaguugagggugaaggccuucacaagcugggguauauuuuaagagacaucuccaaaauuccuggaggcgcaauguacgccgaugacaccgcugguugggacacaaggaucacugaggaugaccugcauaacgaggaaaagauaacccagcagauggaucccgagcaccgccaauuggccaaugcaaucuuuaaacucacguaucagaacaagguggucaaagugcagcguccaacacccaaggggaccgugauggacauuaucucacggaaggaucagagaggaagcggccaagucggcacuuacgggcugaauacauucaccaacauggaagcucagcuaguuaggcagauggagggagaaggugugcuuucgaaagccgaccuggagaauccucaucuccuggagaagaaaauuacucagugguuggaaaccaagggcguagagcgcuuaaaacgaauggcuaucucuggggaugacugcguggucaagccaauagaugaccgguuugccaacgcacugcucgcgcuuaacgauaugggaaaggugagaaaagacauuccgcaauggcagcccaguaagggcuggcacgauuggcagcagguuccuuucuguucccaccauuuccacgaacugaucaugaaagacgguaggaagcuaguggucccaugccgcccccaagacgagcugaucgggagagcccggauuagccagggagcuggcuggucacucaaagaaacagccuguuugggcaaggcauaugcucagauguggucccugauguacuuucauaggcgugaucuucgacuggccucuaaugcaauaugcagcgccgugccuguacacuggaucccaacgagucgcaccacuugguccauucacgcgcaucaccaauggaugacaaccgaggacaugcucacuguuuggaacagaguguggaucgaggauaaucccuggauggaagacaagacaccugucaccacgugggaggaugugccguacuuagggaaacgggaagaccagugguguggaagccugauugguuugacaucuagggcuaccugggcccagaacauccugacugcaauacagcaaguucgcucacucaucggcgaugaggaguuccuugacuauaugccaaguaugaagagauuucggaaagaagaggaauccgagggggccauuugguga

SEQ ID NO: 15579 - RNA, 9873 nt, Artificial Sequence
  derived and/or modified CDS sequence (opt3) from DENV-3__FJ562097__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgaguccgacaugauuaucccaaagucacuggcaggcccgauuagucagcauaaucacaggcccggguaucauacucaaaccgcgggaccuuggcaccuuggcaaauuggaacuggauuucaacuacugcgaggggacaacuguggugaucaccgagaauuguggaacacguggcccaucuuuacggacgaccacugucagcgguaagcucauacacgaauggugcugucgauccugcacacugcccccucuuagauauaugggggaggacggauguugguacggcauggaaauuaggccaaucaacgagaaagaagagaauaugguuaagucacuggugagcgccgguucuggcaagguagauaacuuuaccauggggguguugugccucgcuauccuguucgaggaagucaugcgcggaaaauucggcaagaaacauaugauugccggggugcuauuuacuuucguucugcuccuguccggacagaucacauggcgggacauggcacacacccuuauuaugauaggcaguaaugcuagcgauagaauggguaugggggugacguauuuggcccugaucgcaacuuuuaagauucagcccuucuuagcccucggauuuuuccugaggaaacuuaccucucgcgagaaccugcuacucggcgucggccuggcuauggcggccacauugcaacugccggaagacaucgagcagauggcaaaugggauugcuuuaggacucaugacccugaagcuuaucacucaguuugaaacauaccagcuguggaccgccuuggugucccucacauguucaaacacuauauucacccugacgguugccuggcgaacagcuacccuaauccuggcaggugugagucuucucccucugugccaaagcucguccaugcggaagacugauugguugccaaugaccgucgccgcgaugggcguacccccucugcccuuauuuauuuucucucucaaagacacaccaaagcguagaagcuggccucugaaugagggggugauggcuguuggacuugugucaauccuggccaguuccuugcucaggaacgauguccccauggcaggcccacugguggccggugggcuacugauugcuuguuauguaaucacuggaaccucugcagaccuuacgguggagaaagccgcggacgucacaugggaagaggaagcugagcagaccggcguuagccauaaccucaugauaacuguggaugacgauggcacaaugcgcauuaaggacgaugaaaccgagaauauccugacuguguuguuaaaaacagcccugcucaucgucuccgggguguuuccguacucaauuccugcaacccugcuuguuuggcacacguggcagaagcagacucaacggagcggaguacugugggacgugcccaguccacccgagacccagaaagccgaauuggaggaaggugucuacagaauaaagcagcagggcaucuucgggaagacacaagugggaguuggcgugcagaaagagggugucuuucauaccauguggcacgugacaaggggggcuguacuaacucacaacggaaagcgacuggagccuaauugggccucugucaaaaaggaucucauuuccuauggcggcggguggcgccugagcgcacaguggcaaaaaggagaagaggugcagguuaucgcuguggaaccagguaagaaccccaagaauuuccagaccaugccuggcauuuuccagacgacaacuggggagaucggagccauagcgcuugacuuuaaaccgggcaccucggguucaccaaucauuaaccgggaagggaaggucgugggauuauacggcaauggcguugugacaaaaaacgggggauaugucucugguaucgcccaaaccaaugcagagcccgauggcccuacuccagagcuggaagaggaaauguucaagaaaagaaaccucaccauuauggacuugcaucccgggaguggaaagacaaggaaguaccugccugcuaucgugcgugaggccauaaaacgccggcucagaacgcugauucuugcuccgacuaggguaguggcagccgaaauggaggaggcccugaagggcuugcccauccgauaucagaccacagcuaccaaauccgaacacacuggucgggagaucguugaucuaaugugccaugcgacauuuaccaugcgccugcucagcccagucagagugccuaauuacaacuuaauuaucauggacgaagcacacuucacggaucccgccucuauagcugccaggggguauauuagcacucgggugggaaugggcgaggcagccgcuaucuuuaugacagcgaccccaccuggcaccgccgaagcauucccccaguccaaugcuccaauucaggacgaggagcgagacaucccggaaagaucauggaacagugggaaugaguggauaacugauuuugucggaaagacaguaugguucgugccuagcauuaaagccgguaacgacaucgcaaacugucugcgcaagaauggcaagaaaguuauccaacuuucuaggaagaccuuugauacagaauaccagaaaacuaagcugaacgacugggauuucguggucacgaccgacauuuccgagaugggggccaauuuuaaagcugaucgugugaucgacccccggagaugccucaagccaguuauuuugacagauggacccgagagggugauacuggccggcccuaugccagucacugcggcaucagccgcucagcgccgagguagaguggggcggaacccccagaaggaaaaugaccaauacaucuucaccggccagccucucaacaaugaugaggaccaugcccacuggacagaagcuaaaaugcugcuugacaacauuaauaccccggagggaaucaucccagcacuauucgaacccgagagggagaagagugccgcuauugauggcgaauaucgccugaaaggggagagccguaagacuuuuguagaauugaugagacggggagacuuaccuguguggcuggcccacaaaguugcauccgaggguauaaaguacacggauaggaaauggugcuucgacggcgaacgcaacaaucagauccucgaggagaacauggaugucgaaauuuggaccaaggagggggaacgaaagaaacugagaccccgguggcuugacgcgaggacauauucugauccacuggcccucaaggaguuuaaagacuucgcugccggacgcaagucgaucgcauuggaucuggugacugaaauuggcagagugccuagccaucuagcuuacaggacccggaaugcccuggacaaccucgucaugcuucacacaucagagcauggugggcgugcauaucgccacgccguugaggaacugcccgagaccauggaaacuuuauugcugcucggccugaugauccuucugacaggaggcgcuaugcucuuuuugauauccgggaaaggaaucgguaagacgaguauuggccugaucugugugauuguaucuagcgggauguuauggauggcggaugugccacuacaguggaucgccuccgcaauaguccuggaguucuuuaugauggugcuccuuauuccugagccggaaaagcaacgaaccccccaggacaaucagcuggcuuacguugugaucggaauuuugacucuggccgccaucgucgcagcuaacgagaugggccuccuggaaacaaccaaaagagaucuugguaugucaaaggagccagggguagugucuccuaccagcuaucucgacguugaccugcaccccgccagugcguggacauuguacgcuguggccacuacggucauaaccccaaugcugaggcauacaaucgaaaauuccacugcaaacgugagcuuagccgcuauugcaaaccaagccgucgugcuaaugggccuggauaaaggauggccuaucucuaagauggaccucggcguuccccuucuggcguuggggugcuacucacaggugaauccgcugacccucacagcugccguacugcuuuuagugacccacuaugcaauuaucggaccaggccugcaggccaaagcuacucgggaggcccagaagcgcacggcagcugguauaaugaagaacccuacagucgaugggauuaugaccaucgaccucgaucccguuaucuacgacuccaaauucgagaagcaauugggacaggugaugcugcuaguccugugugccgugcagcuccuucugaugagaacuaguugggcguugugcgaagcccugacccucgcaacaggcccaauuacuacccugugggaggguagccccggcaaauuuuggaauacaacgaucgcuguaucgauggccaacauauucagggggucuuauuuagcaggagcuggccuugccuuuuccauuaugaagagcguggggaccggacggcgaggcacugguucacagggggaaacacugggagagaaauggaagaagaaacucaaucaacuaaguagaaaggaauucgaucuguacaaaaagucuggcaucaccgagguugaccgcacugaggccaaagaagguuugaagaggggcgagacaacccaucacgcggugucccgggggagcgcuaaacugcagugguuugucgaacguaacauggugauuccugagggaagagucaucgaucucggcugugggaggggaggcuggucauauuacugcgcaggucuuaagaaggugacggaaguucgcggguauaccaaaggaggcccgggccaugaggagcccguaccaaugaguacauacggguggaauauagugaagcugaugagcggaaaagacgucuucuacuugccucccgaaaagugugauacucugcucugcgacaucggugaguccucuccuagcccaaccguggaagagucccggacaauucgaguuuuaaaaaugguggagcccuggcugaagaacaaucaguucuguaucaagguccuuaacccuuauaugccaacugugauugaacaccuggagagacuacagaggaaauacggcgggaugcucguacgcaauccccugucacggaacucuacccacgaaauguauuggaucaguaauggaacaggcaacauugugucgagcguuaauauggucuccagauugcugcucaaccguuuuaccaugacucauaggcggccgacgaucgagaaggauguggaccuuggugccgggacacgccacgugaacgcugaaccugagaccccaaauauggacgucauaggagagcgaauuaaaagaaucaaggaagagcauucuucaacuuggcacuacgaugacgaaaaccccuauaaaaccugggccuaccacggcagcuaugagguuaaggcaacaggcuccgccaguucuaugaucaauggggugguaaagcuguuaacgaaaccuugggauguggucccaauggugacccaaauggcuaugacugacacaacccccuucggacagcagaggguuuuuaaggaaaaaguggauacucggacaccgcgcccuaugcccgguaccagaaaggucauggagauuacagcggaguggcuguggaggacuuugggccgaaacaaaaagccacggcucugcacccgugaagaguucacgaagaaagugagaaccaaugccgcaaugggggcuguauuuacagaagagaaccaaugggacagcgcccgcgcagccguugaagaugaggaguucuggaagcugguggacagggaacgggagcuacauaaacuuggaaaguguggcucaugcgucuacaauaugauggguaaaagagaaaagaaacugggggaguuuggaaaggcuaagggcucccgcgccauaugguacauguggcucggcgcgagguaucuggaguucgaagcauugggguuucugaacgaggaucacugguucagucgagaaaauagcuacucuggaguggagggugaaggccuccauaaacuuggguauauccugcgggacauuuccaagaucccuggaggcgccauguacgcugaugacacugccgguugggacaccagaauuacagaggaugacuuacacaacgaggaaaaaaucacucagcagauggaucccgagcauaggcagcuggcaaaugcuauauuuaaguugaccuaucaaaacaaaguggucaagguucagcgcccaacgcccaaggggacagugauggacaucauuucacguaaagaucagcggggaagcggccagguaggcaccuacgggcucaauacuuucacaaacauggaagcccaacuggugagacagauggagggagaagguguccuaucgaaggcugaccuugagaauccucaccugcucgagaaaaagaucacccaguggcuggaaacuaaaggcguggagagguugaagcgcauggccauuucuggggaugacugcguugugaagccaaucgaugaccgauuugcaaacgcguuacuggcccucaacgauaugggaaaaguccggaaggacauaccgcaguggcaacccaguaaaggcuggcacgauuggcagcaggugccuuucuguucccaucacuuccaugaacuuauuaugaaggacgguagaaaacugguaguuccaugcaggccccaggacgagcuaaucgggcgcgcuagaaucagccaaggagccggcuggucacugaaggaaaccgcaugucucggcaaggcuuaugcccagaugugguccuugauguacuuucaccggagggaucugcgucuugcaucuaaugccauuugcagcgcggugccuguccacuggauaccaacaagucgaacgaccugguccauccaugcucaccaucaguggaugacuacagaggacaugcugaccguguggaaccgcguuuggauugaggauaaucccuggauggaagacaaaacuccugugacaaccugggaggaugucccguaccucgggaagagagaagaccaaugguguggaagcuuaaucggucugacgucucgggccacaugggcacagaacauuuugaccgccauccagcaggugaggucacugauaggcgaugaggaguuccucgacuauaugccaaguaugaaacgcuuuagaaaggaagaggaauccgagggggcuaucugguga

SEQ ID NO: 15580 - RNA, 9873 nt, Artificial Sequence
  derived and/or modified CDS sequence (opt3) from DENV-3__FJ432741__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucgcaaaaaaggaggagcccgugaacauagaagccgagccgccuuucggcgaaucaaauauuguuaucggaaucggcgacaaagcucucaagauuaacugguauaagaaagggagcaguaucggaaagauguuugaggccacagcacgcggugccagaaggauggcuauucugggcgauacugccugggacuucgggucugugggaggcguccuuaauucccuggguaaaauggugcaucagauauuugggagcgcauacaccgcguuguucucgggcguaucuuggaucaugaagauuggaaucggcgugcuccugacauggaucggguuaaacuccaaaaauacuucaaugaguuuuagcugcauuguuauaggaaucauuacccuguaucuaggcgcugucgugcaggccgauauggguugugcaaucaacuggaaggggaaggaacucaaaugcggauccggcauuuucgugacgaaugagguccacacauggaccgagcaguacaaguuucaagccgacucucccaaacggcuggcuacugccaucgcaggugcuugggaaaacggcguuugugggauacgaagcacaacccgcauggagaaucuuuuguggaagcagaucgccaacgaacugaauuauauucucugggagaacaauaucaaacugacuguggugguaggagauauuaucggcgucuuagaacaggggaagagaacccugacaccacagccuauggagcuuaaauacucauggaagacguggggaaaggcgaaaauagugaccgccgagacucaaaacaguuccuucauuaucgacggccccaacacaccagaaugccccagcgcuucuagggcauggaauguuugggagguggaagacuaugguuuuggggucuucaccacaaacauuugguugaagcuccgggaggugcauacucagucaugugaucaccgccugaugagugccgcuaucaaagacgaaagagccguucacgcagauaugggauacuggauagagagccagaagaauggcuccuggaaacuagagaaggcgucuuuuaucgaagugaagaccugcacguggccuaaaucgcauacacuguggagcaacgguguacucgaguccgacauggucauuccaaagucacuggccggcccgaucagucagcacaaucauaggcccggguaccacacccaaacugcuggaccuuggcaccuuggcaaauuggaacuggauuucaacuauugcgaggggaccacaguggugauuacugagaauuguggaacccguggcccaucuuuacggacaacgaccgucagcgguaagcucauccaugaauggugcugucgauccugcacucugcccccucuuagauacaugggggaggacggauguugguauggcauggaaauaaggccaauuaacgagaaagaagagaauaugguuaagucacuggugagcgccgguucuggcaagguagauaacuuuacaauggggguguugugccucgcaauccuguucgaggaagucaugcgcggaaaauucggcaagaaacacaugaucgcuggggugcuauuuaccuucguucugcuccuguccggacagauuacuuggcgggacauggcccauacacuuaucaugauuggcaguaaugcaagcgauagaauggguaugggggugaccuacuuggcccugauagcuacguuuaagauccagcccuucuuagcgcucggauuuuuccugaggaaacuuacuucucgcgagaaccugcuacucggcgucggccuggccauggcaaccacauugcaacugccggaagacauugagcagauggcuaaugggaucgccuuaggacucaugacccugaagcuuauuacucaguuugaaacauaucagcuguggaccgccuuggugucccucacauguucaaacacuaucuucacccugacgguugcuuggcgaacagcaacccuaauacuggccggugugagucuucucccucugugccaaagcucguccaugcggaagacugauugguugccaaugaccgucgcggcuaugggcguacccccucugcccuuauuuaucuucucucucaaagacacaccaaagcguagaagcuggccucugaaugagggggugauggccguuggacuugugucaauucuggcaaguuccuugcucaggaacgauguccccauggccggcccacugguggcuggugggcuacugaucgcauguuacguaauuacuggaaccucugccgaccuuacgguggagaaagcggcugacgucacaugggaagaggaagccgagcagaccggcguuagccacaaccucaugaucacuguggaugacgauggcacaaugcgcauaaaggacgaugaaaccgagaauauucugacuguguuguuaaaaacagcacugcucaucgucuccgggaucuuuccguauucaauuccugccacccugcuuguguggcauacguggcagaagcagacucaacggagcggaguucugugggacguacccaguccacccgagacccagaaagcugaauuggaggaagguguguacagaauaaagcagcagggcaucuucgggaagacacaagucggagugggcguucagaaagaggguguguuucacaccauguggcacgucacaaggggggccgugcuaacucauaacggaaagcgacuggagccuaauugggcaucuguaaaaaaggaucucauuuccuacggcggcggguggcgccugagcgcucaguggcaaaaaggagaagagguccaggugaucgccguugaaccagguaagaaccccaagaauuuccagaccaugccuggcauuuuccagacgacaacuggggagaucggagcgauagcccuugacuuuaaaccgggcaccucggguucaccaaucauuaaccgggaagggaagguggucggauuauauggcaauggcgugguuacaaaaaacgggggauacgugucugguaucgcacaaaccaaugcugagcccgauggcccuacuccagagcuggaagaggaagucuucaagaaaagaaaccucaccauuauggacuugcaccccgggaguggaaagacaaggaaguaucugccugccaucgugcgugaggcuauaaaacgccggcucagaacgcugauucuugcaccgacuaggguaguggccgccgaaauggaggaggcucugaagggcuugcccauccgauaccagaccacagcgaccaaauccgaacauacuggucgggagaucguugaucuaaugugccacgcaacauuuaccaugcgccugcucagcccagucagagugccuaauuauaacuuaauuaucauggacgaagcccauuucacggaucccgcuucuauagccgcaaggggguacauuagcacucgggugggaaugggcgaggccgcugcgaucuuuaugacagccaccccaccuggcaccgcagaagcuuucccccaguccaaugccccaauucaggacgaggagcgagacaucccggaaagaucauggaacagugggaaugaguggauaacugauuuugucggaaagacaguaugguucgugccuagcauuaaagcagguaacgacaucgccaacugucugcgcaagaauggcaagaaaguuauccaacuuucuaggaagaccuuugauacagaauaucagaaaacucgucugaacgacugggauuucguggucacgaccgacauuuccgagaugggggcuaauuuuaaggccgaucgggugaucgaccccagaaggugccucaaaccaguuauuuugacagauggacccgagcgcgugauacuggcgggcccuaugccagucacugcagccucagcugcccagcgaagaggucggguggggaggaacccccagaaggaaaaugaccaauacaucuucaccggccagccucucaacaaugaugaggaccacgcucacuggacagaagcaaagaugcugcuugacaacauuaauaccccggagggaaucaucccagcccuauucgaacccgagcgcgagaaaagugcugccauugauggcgaauaccgucugaagggggagagcagaaaaacuuuuguagaauugaugcggaggggagacuuaccuguguggcuggcacauaagguugcguccgaggguauaaaauauacggaucgcaaguggugcuucgacggcgaacgaaacaaucagauccucgaggagaacauggaugucgaaauuuggaccaaagagggggaaagaaagaagcugcggcccagguggcuugacgcccgcacauacucugauccacuggcucucaaagaguuuaaggacuucgccgcaggaagaaaaucgaucgcuuuggaucuggugacugaaauuggcagggugccuagccaccuagccuaucggacccguaaugcacuggacaaccucgucaugcuucauacaucagagcacggugggcgcgccuaccgacacgcuguugaggaacugcccgagaccauggaaacuuuauugcugcucggccugaugauccuucugacaggaggcgcgaugcucuuuuugauauccgggaagggaaucgguaaaacgaguauuggccugaucugugugauuguaucuagcgggauguuauggauggccgaugugccacuacaguggaucgcauccgcuauaauucuggaguucuuuaugaugguccuccuuaucccugagccggaaaagcaaagaaccccccaggacaaucagcuggccuaugugguuauuggaaucuugacucuggccgcaauaguggcugccaacgagaugggccuccuggaaacaaccaagagggaucuugguaugucaaaagagccaggggucguaucuccuaccagcuaccucgacguggaccugcaucccgcgagugcuuggacauuguaugccguugcaacuacggugaucaccccaaugcugcggcacacaauugaaaauuccacugccaacgucagcuuagcugcaaucgccaaccaagcggugguccuaaugggccuggauaagggauggccuauuucuaaaauggaccucggcgugccccuucuggcuuuggggugcuacucacagguuaauccgcugacccucacagccgcagugcugcuuuuaguaacccauuacgccaucauaggaccaggccugcaggcuaaggccacucgcgaggcacagaaaagaacggcugccgguauuaugaagaacccuacaguggaugggaucaugaccaucgaccucgaucccgucauuuaugacuccaaguucgagaaacaauugggacagguuaugcugcuagugcugugugcgguccagcuccuucugaugaggacuaguugggccuugugcgaagcacugacccucgcuacaggcccaaucacuacccugugggaggguagccccggcaaguuuuggaauacaacgauagccgugucgauggcaaacauuuuccgggggucuuacuuagcuggagccggccuugccuuuuccaucaugaaaagcguagggaccggacgaagaggcacugguucacagggggaaacacugggagagaaguggaaaaagaagcucaaucaacuaagucgcaaagaauucgaucuguauaagaaaucuggcauuaccgagguggacaggacugaggcgaaggaagguuugaaacggggcgagacaacccaccaugcuguuucccgugggagcgcaaagcugcagugguuuguggaaagaaacauggucaucccugagggaagggugauagaucucggcugugggcgcggaggcuggucauacuauugcgccggucuuaaaaaggucacggaagugcggggguacaccaagggaggcccgggccacgaggagcccguuccaaugaguacauauggguggaaucugguaaaauugaugagcggaaaggacguguucuaccugccucccgaaaaaugugauacucucuuaugcgacaucggugaguccucuccuagcccaaccgucgaagagucccgaacaauuagagugcugaagaugguugagcccuggcuuaaaaacaaucaguucuguaucaaggugcugaacccuuacaugccaacugucauugaacaccuagagaggcuccagcgcaaguauggcgggaugcuggugcggaaucccuugucaagaaacucuacccaugaaauguacuggaucaguaauggaacaggcaacauuguaucgagcgugaauaugguuucccgucugcuccuuaacagguuuaccaugacucaccggcgcccgacgaucgagaaagaugucgaccugggugcugggacacgacaugugaacgccgaaccugagaccccaaauauggacgugauaggagagagaauuaagaggaucaaagaagagcacucuucaacuuggcacuaugaugacgaaaaccccuacaagaccugggcauaucauggcagcuacgaggucaaagccacaggcuccgcuaguucuaugaucaaugggguugugaaguuacugacgaagccuugggauguagugccaauggucacccaaauggcgaugacugacacaacccccuucggacagcagcggguguuuaaagaaaagguugauacucgcacaccgagaccuaugcccgguaccaggaaagugauggagauuacagccgagugguuguggcgaacucucggccggaacaagaaaccacgucugugcaccagagaagaguucacgaagaagguccgcaccaaugcagcuaugggggccguguuuacagaagagaaccaaugggacagcgcaagggccgcuguagaagaugaggaguucuggaaacuaguugaccgggaaagaaagcuucacaaacugggaaaguguggcucaugcguguauaauaugauggguaaacgcgagaagaaacucggggaauuuggaaaggccaagggcuccagggcgauaugguacauguggcugggcgcacgauacuuggaguucgaggcccugggguuucucaacgaagaucauugguucagucgggagaauagcuauucuggagucgaaggugagggccuucacaaacugggguacaucuuaagagacauuuccaagaucccuggaggcgcuauguaugccgaugacacugcagguugggacaccaggauuacagaagaugaccugcauaacgaggagaaaaucacucagcagauggaucccgaacaccgccaguuggcuaaugccauauuuaagcucaccuaccaaaacaaaguggugaagguccagcguccaacgcccaaggggacaguuauggacaucauuucacggaaagaucagagaggaagcggccaggugggcaccuaugggcugaauacuuucacaaacauggaggcucaacuaguaaggcagauggaaggagagggugugcuuucgaaggccgaccuggaaaauccucaccuccuggagaaaaagaucacccagugguuggagacuaaaggcgucgaacgcuuaaagcgaauggcaauuucuggggaugacugcgugguuaagccaaucgaugaccgguuugcgaacgcccugcucgcucuuaacgauaugggaaaagugagaaaggacauaccgcaguggcaacccaguaaaggcuggcaugauuggcagcaggucccuuucuguucccaccauuuccacgagcugauuaugaaggacgguaggaaacuagugguaccaugccgcccccaggacgaacugaucgggagagcccggaucagccaaggagcaggcuggucacucaaggagaccgcuuguuugggcaaggccuacgcacagauguggucccugauguauuuucacaggcgugaucuucgacuggccucuaaugcgauuugcagcgcuguuccugugcauuggauaccaacaagucgcacgaccugguccauccacgcccaucaccaguggaugacuacagaagacaugcucaccgucuggaacagaguguggauugaggauaaucccuggauggaggacaaaacuccuguuacaaccugggaagaugugccguacuuagggaagcgggaggaccaaugguguggaagccugaucgguuugacgucuagggcaacaugggcccagaacauucugaccgcuauccagcagguccgcucacucauaggcgaugaagaguuccuugacuacaugccaaguaugaaaagauuucggaaggaggaagaguccgaaggggccaucugguga

SEQ ID NO: 15581 - RNA, 9873 nt, Artificial Sequence
  derived and/or modified CDS sequence (opt3) from DENV-3__FJ562099__SS-prME
acaagccugugccucaugaugaugcuucccgcaacacuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucagcuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucagugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucaccaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgaguccgacaugauuaucccaaagucacuggcaggcccgauuagucagcauaaucacaggcccggguaucauacucaaaccgcgggaccuuggcaccuuggcaaauuggaacuggauuucaacuacugcgaggggacaacuguggugaucaccgagaauuguggaacacguggcccaucuuuacggacgaccacugucagcgguaagcucauacacgaauggugcugucgauccugcacacugcccccucuuagauauaugggggaggacggauguugguacggcauggaaauuaggccaaucaacgagaaagaagagaauaugguuaagucacuggugagcgccgguucuggcaagguagauaacuuuaccauggggguguugugccucgcuauccuguucgaggaagucaugcgcggaaaauucggcaagaaacauaugauugccggggugcuauuuacuuucguucugcuccuguccggacagaucacauggcgggacauggcacacacccuuauuaugauaggcaguaaugcuagcgauagaauggguaugggggugacguauuuggcccugaucgcaacuuuuaagauucagcccuucuuagcccucggauuuuuccugaggaaacuuaccucucgcgagaaccugcuacucggcgucggccuggcuauggcgacaaccuugcaacugccggaagacaucgagcagauggccaaugggauugcauuaggacucaugacucugaaacuuaucacacaguuugaaaccuaccagcuguggacagcuuuggugucccucacuuguucaaacaccauauucacgcugacaguugccuggcgaaccgccacucuaauccuggcuggugugagucuucucccucugugccaaagcucguccaugcggaagaccgauugguugccaaugacagucgcagccaugggcguacccccucugcccuuauuuauuuucucucucaaagacacuccaaagcguagaagcuggccucugaaugagggggugauggcgguuggacuugugucaauccuggcuaguuccuugcucaggaacgauguccccauggccggcccacugguggccggugggcuacugauugccuguuauguaaucaccggaacgucugcugaccuuacaguggagaaagcagccgacgucaccugggaagaggaagcggagcagacuggcguuagccauaaccucaugauaacaguggaugacgauggcaccaugcgcauuaaggacgaugaaacugagaauauccugacaguguuguuaaaaaccgcucugcucaucgucuccgggguguuuccguacucaauuccugccacgcugcuuguuuggcacacuuggcagaagcagacccaacggagcggaguacugugggacgugcccaguccacccgagacacagaaagcagaauuggaggaaggugucuacagaauaaagcagcagggcaucuucgggaagacccaagugggaguuggcgugcagaaagagggugucuuucauacaauguggcacgugacucgaggggcaguacuaacccacaacggaaagaggcuggagccuaauugggcuucugucaaaaaggaucucauuuccuauggcggcggguggcgccugagcgcccaguggcaaaaaggagaagaggugcagguuaucgcaguggaaccagguaagaaccccaagaauuuccagacgaugccuggcauuuuccagacaacuaccggggagaucggagcuauagcccuugacuuuaaaccgggcacaucggguucaccaaucauuaaccgggaagggaaggucgugggauuauacggcaauggcguugugaccaaaaacgggggauaugucucugguaucgcgcaaacuaaugccgagcccgauggcccuaccccagagcuggaagaggaaauguucaagaaaagaaaccucacaauuauggacuugcaucccgggaguggaaagacgaggaaguaccugccugcaaucgugcgugaggcuauaaaacgccggcucagaacucugauucuugccccgaccaggguaguggcugcagaaauggaggaggcccugaagggcuugcccauccgauaucagacaaccgccacuaaauccgaacacacaggucgggagaucguugaucuaaugugccaugcuaccuuuacgaugcgccugcucagcccagucagagugccuaauuacaacuuaauuaucauggacgaagcgcacuucacugaucccgcaucuauagccgcuaggggguauauuagcacacgggugggaaugggcgaggccgcagccaucuuuaugaccgcuaccccaccuggcacugcggaagccuucccccaguccaaugcaccaauucaggacgaggagcgagacaucccggaaagaucauggaacagugggaaugaguggauaacagauuuugucggaaagaccguaugguucgugccuagcauuaaagcugguaacgacaucgccaacugucugcgcaagaauggcaagaaaguuauccaacuuucuaggaagacauuugauacugaauaccagaaaacgaagcugaacgacugggauuucguggucaccacagacauuuccgagaugggggcaaauuuuaaagccgaucgugugaucgacccccggagaugccucaagccaguuauuuugacugauggacccgagagggugauacuggcuggcccuaugccagucaccgccgcgucagcagcccagcgccgagguagaguggggcggaacccccagaaggaaaaugaccaauacaucuucacaggccagccucucaacaaugaugaggaccaugcucacuggaccgaagccaaaaugcugcuugacaacauuaauacuccggagggaaucaucccagcucuauucgaacccgagagggagaagagugcagccauugauggcgaauaucgccugaaaggggagagccguaagacguuuguagaauugaugagacggggagacuuaccuguguggcuggcucacaaaguugccuccgaggguauaaaguacaccgauaggaaauggugcuucgacggcgaacgcaacaaucagauccucgaggagaacauggaugucgaaauuuggacaaaggagggggaacgaaagaaacugagaccccgguggcuugacgcaaggacuuauucugauccacuggcgcucaaggaguuuaaagacuucgccgcuggacgcaagucgaucgccuuggaucuggugaccgaaauuggcagagugccuagccaucuagcauacaggacacggaaugcucuggacaaccucgucaugcuucacaccucagagcauggugggcgugccuaucgccacgcaguugaggaacugcccgagacuauggaaacauuauugcugcucggccugaugauccuucugacgggaggcgccaugcucuuuuugauauccgggaaaggaaucgguaagaccaguauuggccugaucugugugauuguaucuagcgggauguuauggauggcugaugugccacuacaguggaucgcguccgccauaguccuggaguucuuuaugauggugcuccuuauuccugagccggaaaagcaacgaacuccccaggacaaucagcuggcauacguugugaucggaauuuugacacuggcugccaucgucgccgcaaacgagaugggccuccuggaaaccaccaaaagagaucuugguaugucaaaggagccagggguagugucuccuacaagcuaucucgacguugaccugcaccccgcuagugccuggacuuuguacgcgguggcuacgaccgucauaacaccaaugcugaggcauacuaucgaaaauuccaccgccaacgugagcuuagcagccauugcuaaccaagcagucgugcuaaugggccuggauaaaggauggccuaucucuaagauggaccucggcguuccccuucuggccuuggggugcuacucacaggugaauccgcugacacucaccgcggcuguacugcuuuuagugacucacuaugccauuaucggaccaggccugcaggcaaaagccacgcgggaggcucagaagcgcacagccgcagguauaaugaagaacccuaccgucgaugggauuaugacuaucgaccucgaucccguuaucuacgacuccaaauucgagaagcaauugggacaggugaugcugcuaguccugugugcugugcagcuccuucugaugagaaccaguugggccuugugcgaagcgcugacacucgccacuggcccaauuaccacacugugggaggguagccccggcaaauuuuggaauacgaccaucgcaguaucgauggcuaacauauucagggggucuuauuuagccggagcaggccuugcuuuuuccauuaugaaaagcguggggacuggacggcgaggcacagguucacagggggaaacccugggagagaaauggaagaagaaacucaaucaacuaaguagaaaggaguucgaucuguacaaaaagucuggcaucacugagguugaccgcacagaggccaaagaagguuugaagaggggcgagaccacgcaucacgccgugucccgggggagcgcgaaacugcagugguuugucgaacguaacauggugauuccugagggaagagucaucgaucucggcugugggaggggaggcuggucauauuacugcgcuggucuuaagaaggugaccgaaguucgcggguauacaaaaggaggcccgggccaugaggagcccguaccaaugaguacuuacggguggaauauagugaagcugaugagcggaaaagacgucuucuacuugccucccgaaaagugugauacccugcucugcgacaucggugaguccucuccuagcccaacaguggaagagucccggacuauucgaguuuuaaaaaugguggagcccuggcugaagaacaaucaguucuguaucaagguccuuaacccuuauaugccaaccgugauugaacaccuggagagacuacagaggaaauacggcgggaugcucguacgcaauccccugucacggaacucuacacacgaaauguauuggaucaguaauggaaccggcaacauugugucgagcguuaauauggucuccagauugcugcucaaccguuuuacuaugacgcauaggcggccgacaaucgagaaggauguggaccuuggugcagggacccgccacgugaacgccgaaccugagacuccaaauauggacgucauaggagagcgaauuaaaagaaucaaggaagaacacucuucaaccuggcacuacgaugacgaaaaccccuauaaaacaugggcuuaccacggcagcuaugagguuaaggccacgggcuccgcaaguucuaugaucaauggggugguaaagcuguuaaccaaaccuugggauguggucccaauggugacucaaauggccaugacagacaccacucccuucggacagcagaggguuuuuaaggaaaaaguggauacacggaccccgcgcccuaugcccgguacaagaaaggucauggagauuacugcugaguggcuguggaggaccuugggccgaaacaaaaagccacggcucugcacgcgugaagaguucaccaagaaagugagaacaaaugcggccaugggggcaguauuuacugaagagaaccaaugggacagcgcucgcgccgcaguugaagaugaggaguucuggaagcugguggacagggaacgggagcuacauaaacuuggaaaguguggcucaugcgucuacaauaugauggguaaaagagaaaagaaacugggggaguuuggaaaggccaagggcucccgcgcuauaugguacauguggcucggcgccagguaucuggaguucgaagcguugggguuucugaacgaggaucacugguucagucgagaaaauagcuacucuggaguggagggugaaggccuccauaaacuuggguauauccugcgggacauuuccaagaucccuggaggcgcaauguacgccgaugacaccgcugguugggacacaagaauuacugaggaugacuuacacaacgaggagaaaaucacccagcagauggaucccgagcauaggcagcuggccaaugcaauauuuaaguugacguaucaaaacaaaguggucaagguucagcgcccaacacccaaggggaccgugauggacaucauuucacguaaagaucagcggggaagcggccagguaggcacuuacgggcucaauacauucaccaacauggaagcucaacuggugagacagauggagggagaagguguccuaucgaaggccgaccuugagaauccucaucugcucgagaaaaagaucacucaguggcuggaaaccaaaggcguggagagguugaagcgcauggcuauuucuggggaugacugcguugugaagccaaucgaugaccgauuugccaacgcauuacuggcgcucaacgauaugggaaaaguccggaaggacauaccgcaguggcaacccaguaaaggcuggcacgauuggcaacaggugccuuucuguucccaucacuuccaugaacuuauuaugaaggacgguagaaaacugguaguuccaugcaggccccaggacgagcuaaucgggcgcgccagaaucagccaaggagcuggcuggucacugaaggaaacagccugucucggcaaggcauaugcucagaugugguccuugauguacuuucaccggagggaucugcgucuugccucuaaugcaauuugcagcgccgugccuguccacuggauaccaacgagucgaaccacuugguccauccaugcgcaccaucaguggaugacaaccgaggacaugcugacuguguggaaccgcguuuggauugaggauaaucccuggauggaagacaaaacaccugugaccacgugggaggaugucccguaccucgggaagagagaagaccaaugguguggcagcuuaaucggucugacaucucgggcuaccugggcccagaacauuuugacugcaauccaacaggugaggucacugauaggcgaugaggaguuccucgacuauaugccaaguaugaaacgcuuuagaaaggaagaggaauccgagggggccaucugguga

SEQ ID NO: 15582 - RNA, 9873 nt, Artificial Sequence
  derived and/or modified CDS sequence (opt3) from DENV-3__KF955457__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggcaaccguggagauuacuccucaggcuuccacggucgaagccgugcuuccagaguauggaacacugggcuuggaaugcucuccgcgaaccggucuagauuucaaugagaugauccugcucacuaugaaaaacaaggcguggaugguacacagacagugguuuuucgaccugccccuuccuuggaccagcggggccacaaccgagacuccaacauggaauaggaaagaacuguugguuacguuuaagaacgcacaugcuaaaaagcaagagguggucgugcucggcucccaggaaggagccaugcacaccgcucugacuggcgccacagagauccagaauucagggggaaccaguauuuucgcaggucacuuaaagugucggcugaaaauggauaagcuagaacucaaaggcaugagcuacgccaugugccugaacacauuuguccuuaagaaagaggugucugagacucagcaugggaccauauugaucaagguugaauacaagggagaggacgcucccuguaaaauuccuuucuccacggaagauggccaagguaaggcgcacaacgggcgucugaucaccgcaaauccagugguaacaaaaaaggaggagcccgucaacauagaagccgagccgccuuucggcgaaucaaauauugugaucggaaucggcgacaaagcucucaagauuaacugguauaagaaagggagcaguaucggaaagauguuugaggccacugcacgcggugccagaaggauggcuauucugggcgauaccgccugggacuucgggucuguuggaggcgugcuuaauucccuggguaaaaugguccaucagauauuugggagcgcauacacagcguuguucucgggcgugucuuggaucaugaagauuggaaucggcguacuccugacuuggaucggguuaaacuccaaaaauaccucaaugaguuuuagcugcauugugauaggaaucauuacgcuguaucuaggcgcuguuguccaggccgauauggguugugcaaucaacuggaaggggaaggaacucaaaugcggauccggcauuuucgugacaaaugaggugcacaccuggacugagcaguacaaguuucaagccgacucucccaaacggcuggcuacagccaucgcaggugcuugggaaaacggcgucugugggauacgaagcaccacucgcauggagaaucuuuuguggaagcagaucgccaacgaacugaauuauauucucugggagaacaauaucaaacugaccguuguggugggagauauuaucggcguauuagaacaggggaagagaacacugacgccacagccuauggagcuuaaauacucauggaagaccuggggaaaggcgaaaauagucacugccgagacacaaaacuucaguuuuauuaucgacggccccaacaccccagaaugccccuccgcuagcagggcauggaaugugugggagguugaagacuaugguuucgggguguuuacaacuaacauuugguugaagcuccgggaggucuacacccagucuugugaucaucgccugaugucagccgcuaucaaagacgaaagagccgugcacgcagauaugggauacuggauagagagucagaagaauggcagcuggaaacuagagaaggcguccuucaucgaaguuaagacgugcacauggccuaaaucucacacccuguggucgaacggugugcucgagagcgacaugauuaucccaaagucccuggccggcccgauuucacagcauaaucacaggcccggguaucauacucaaaccgcuggaccuuggcaccuuggcaaauuggaacuggauuuuaacuacugcgaggggacaacuguagucaucaccgaggacuguggaacacguggcccaaguuuacggacgaccacugugucugguaagcucauacacgaauggugcugucgaagcugcacacugcccccucuuagauauaugggggaggauggauguugguacggcauggaaauuaggccaaucaaugagaaagaagagaacauggugaagucccuggucucagccgguagcggcaagguugacaauuucaccauggggguguugugccucgcaauccuguucgaggaaguaaugcgcggaaaauuuggcaagaaacauaugauugcuggggugcuauucacuuuuguccugcuccugucuggacagaucacauggcgggauauggcccacacccuuauuaugauaggcuccaacgcaagugacagaauggguaugggggugacguauuuggcccugaucgcuacuuucaagauucagcccuuuuuagcgcucggauucuuucugaggaaacuuaccagccgcgagaaucugcuacucggcguuggccuggccauggcaacaaccuugcaacugccggaagauaucgagcagauggcuaacgggauugccuuaggacucaugacucugaagcuuaucacacaguucgaaaccuaccagcuguggacagccuuggugucucucacuuguuccaauaccauauuuacgcugacagucgcuuggcgaaccgcaacucuaauccuggccggugugucacuucucccucugugccaaaguagcucgaugcggaagaccgacugguugccaaugacaguugcggcuaugggcgugcccccucugcccuuauucauuuuuucccucaaagauacuccaaagcguagaucuuggccucugaacgagggggucauggccguaggacuugugagcauccuggcaucaaguuugcucaggaaugacguucccauggccggcccacugguggcuggugggcuacugauugcauguuaugucaucaccggaacguccgccgaccuuacaguggagaaagcggcugauguaaccugggaagaggaagccgagcagacuggcgugucucauaaccucaugauaacagucgacgaugacggcaccaugcgcauuaaggaugacgaaacugagaacauccugacaguuuuguuaaaaaccgcacugcucaucgugagcgggauuuucccguacuccauaccugccacgcugcuuguguggcacacuuggcagaagcagacccaacggucaggaguccugugggaugugcccagcccacccgagacacagaaagcugaauuggaggaagguguuuacagaaucaagcagcagggcauuuuugggaagacccaaguaggagugggcguccagaaagaggguguguuccauacaauguggcacguuacuaggggggccgugcuaacccacaauggaaagcgacuggagccuaacugggcaagugucaaaaaggaccucaucucuuauggcggcggguggcgccuguccgcucaguggcaaaaaggagaagaggugcagguaauugccgucgaaccagguaagaaucccaagaacuuccagacgaugccuggcaucuuucagacaacuaccggggagauaggagcgaucgcccuugauuucaaaccgggcacaagcgguucgccaauuaucaaucgggaagggaaggugguuggauuauacggcaacggcguggucaccaaaaaugggggauaugugucagguauugcacaaacuaacgcugagcccgacggcccuaccccagagcuggaagaggaaauguuuaagaaaagaaaucucacaaucauggauuugcaucccgggucuggaaagacgaggaaguaccugccugccauaguucgugaggcuauuaaacgccggcucagaacucugauccuugcaccgaccaggguggucgccgccgaaauggaggaggcucugaagggcuugcccauccgauaucagacaaccgcgacuaaaagugaacacacaggucgggagauuguggaccuaaugugccaugcaaccuucacgaugcgccugcucuccccaguaagagugccuaacuacaauuuaaucauaauggaugaagcccacuuuacugaccccgcuagcauugccgcaaggggguauaucucuacacggguuggaaugggcgaggccgcugcgauuuucaugaccgccaccccaccuggcacugcagaagcuuuuccccagagcaacgccccaauccaggacgaggagcgagauauaccggaaagauccuggaauucagggaacgaguggauuacagacuucgucggaaagaccgugugguuugugccuaguaucaaagcagguaaugauaucgccaacugucugcgcaagaacggcaagaaagucauucaacuuagcaggaagacauucgacacugaauaccagaaaacgcgucugaaugauugggacuuuguagugaccacagauaucucugagaugggggcuaacuucaaggccgaccggguuauugaucccagaaggugccucaaaccagugauauugacugacggacccgagcgcgucauccuggcgggcccuaugccagugaccgcagccuccgcugcccagcgaagaggucggguugggaggaauccccagaaggaaaacgaucaauacauuuucacaggccagccucucaauaacgacgaggaccaugcucacuggaccgaagcaaagaugcugcuugauaauaucaacacuccggagggaaucauuccagcccuauuugaacccgagcgcgagaaaucagcugccauagacggcgaauaucgucugaagggggagaguagaaaaacguucguggaauugaugcggaggggagauuuaccugucuggcuggcacacaagguggcgagcgaggguaucaaauacaccgaccgcaaguggugcuuugauggcgaacgaaauaaccagauucucgaggagaauauggacguagaaaucuggacaaaagagggggaaagaaagaagcugcggcccagguggcuugaugcccgcacuuauuccgacccacuggcucucaaagaguucaaggauuuugccgcaggaagaaaaucuauugcuuuggaccuggugaccgaaaucggcaggguuccuucgcaucuagccuaccggacacguaacgcacuggauaaucucgucaugcuucacaccagcgagcauggugggcgcgccuaucgacacgcuguggaggaacugcccgagacuauggaaacauuauugcugcucggccugaugauacuucugacgggaggcgcgaugcucuucuugaucucagggaagggaauugguaaaaccuccaucggccugauuugugugaucgucaguucugggauguuauggauggccgacguuccacuacaguggauagcaagcgcuauugugcuggaguuuuucaugaugguacuccuuaucccugagccggaaaagcaaagaacuccccaggauaaccagcuggccuacguggucauuggaaucuugacacuggccgcaauaguggcugccaaugagaugggccuccuggaaaccaccaagagggaccuugguauguccaaagagccagggguugugucaccuacaucuuaucucgacgucgaucugcaccccgcgagcgcuuggacuuuguacgccguagcaacgaccgugaucacaccaaugcugcggcauacuauugaaaacaguaccgccaauguuuccuuagcugcaaucgccaaccaagcggugguccuaaugggccuggacaagggauggccuauuagcaaaauggaucucggcgugccccuucuggcuuuggggugcuacucucaggucaacccgcugacacucaccgccgcagugcugcuuuuaguuacucacuaugccaucauaggaccaggccugcaggcuaaggccacgcgcgaggcacagaaaagaacagcugccgguauuaugaagaauccuaccguggacgggaucaugacuaucgaucucgaccccguaauuuacgauucaaaguuugagaaacaauugggacaggugaugcugcuaguccugugugcgguucagcuccuucugaugaggaccuccugggccuugugcgaagcacugacacucgcuacuggcccaaucaccacacugugggaggguagucccggcaaguucuggaacacgaccauagccgugagcauggcaaauauuuuucgggggucguauuuagcuggagccggccuugccuucucuaucaugaaauccgucgggacuggacgaagaggcacagguagccagggggaaacccugggagagaaguggaaaaagaagcucaaccaacuaucacgcaaagaauuugaccuguacaagaaaaguggcauuacugagguggauaggacagaggcgaaggaagguuugaaacggggcgagaccacgcaucacgcuguaucucguggguccgcaaagcugcagugguucguggacagaaauaugguuaucccugaaggaagggugauagaucucggcugugggcgcggaggcuggagcuauuacugcgccggucuuaaaaaggucaccgaggugcggggguauacaaagggaggcccgggccaugaagagcccgucccaaugucaacuuacggguggaaccuggugaaauugaugaguggaaaggacguuuucuaccugccucccgagaaaugugauacccucuuaugcgacaucggugaaagcuccccuucuccaacaguagaggaaagccgaacuauuagagugcugaagauggucgagcccuggcuuaaaaauaaccaguuuuguaucaaggugcugaauccuuauaugccaaccguuauugagcaccuagaaaggcuccagcgcaaguacggcgggaugcuggugcggaaccccuuguccagaaauucaacacacgagauguauuggaucucuaacggaaccggcaauauugucaguucggugaacaugguaagccgucugcuccuuaauagguucacuaugacgcaucggcgcccgacaaucgaaaaagacguggaucugggugcugggacccgacacguuaacgccgagccugaaacuccaaacauggacgucauaggagagagaauuaagaggaucaaagaggaacauuccucuaccuggcacuacgaugacgagaaucccuauaagacaugggcauaccacggcucauaugaagugaaagccacgggcagcgcuuccaguaugaucaacgggguggucaaguuacugaccaagccuugggauguugugccaaugguaacucaaauggcgaugacagacaccacucccuuuggacagcagcggguguucaaagagaaggucgauacacgcaccccgagaccuaugcccgguacaaggaaagugauggaaauuacugccgagugguuguggcgaacccucggccggaauaagaaaccacgucugugcacgagagaggaauuuaccaagaagguucgcacaaacgcagcuaugggggccguguucacugaggaaaaucaaugggacucugcaagggccgcugucgaggaugaagaguuuuggaaacuaguggaccgggagagagaacuucauaagcugggaaaauguggcagcugcguauacaacaugauggguaagcgcgagaaaaagcucggggaauucggaaaagccaagggcucaagggcgauaugguacauguggcugggcgcacgauauuuggaguuugaggcccugggguuccucaaugaagaucacugguuuucccgggagaacaguuacagcggaguugaaggugagggccuucauaagcugggguauaucuuaagagacauuucuaaaaucccuggaggcgcuauguacgccgacgauaccgcagguugggacacaaggauuacugaagaugaccugcacaaugaggagaagaucacccagcagauggaucccgaacaucgccaguuggcuaacgccauauucaaacucacguaucaaaauaagguggucaaagugcagcguccaacacccaaggggaccgugauggacaucauuucccggaaggaucagagaggaucaggccaggucggcacuuacgggcugaacacauuuaccaauauggaggcucaacuaguuaggcagauggaaggagagggugugcuuagcaaagccgaccuggaaaacccucaccuccuggagaagaaaaucacucagugguuggagaccaagggcguagaacgcuuaaaacgaauggcaauuucgggggaugacugcguggucaagccaaucgaugaccgguucgcgaaugcccugcucgcucuuaacgauaugggaaaggugagaaaagacauaccgcaguggcaacccucuaagggcuggcacgacuggcagcagguuccuuucuguagucaucacuuucaugagcugauuaugaaagaugguaggaagcuaguggucccaugccgcccccaggacgaacugaucgggagagcccggaucucccaaggagcaggcuggagccucaaagagacagcuuguuugggcaaggccuaugcacagauguggucacugauguacuuccacaggcgugaucuucgacuggccuccaacgcgauuugcucugcugugccuguacacuggauaccaacgagccgcaccacuuggaguauccaugcccaccaucaguggaugacaaccgaagacaugcucacuguuuggaauagaguguggauugaggauaaccccuggauggaggacaagacaccugucaccacgugggaagaugugccguacuuagggaaacgggaggaccaaugguguggaucccugaucgguuugacaagcagggcaaccugggcccagaauauucugacugcuauccagcagguucgcucucucauaggcgaugaagaguuucuugacuauaugccaucaaugaagagauuccggaaagaggaagagagugaaggggccaucugguga

SEQ ID NO: 15583 - RNA, 9873 nt, Artificial Sequence
  derived and/or modified CDS sequence (opt3) from DENV-3__FJ562100__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuauccuuccagaguauggaacacugggcuuggaaugcucuccgcgaaccggucuagauuucaaugagaugauccugcucacuaugaaaaacaaggccuggaugguacacagacagugguuuuucgaccugccccuuccuuggaccagcggggcgacaaccgagacuccaacauggaauaggaaagaacuguugguuacguuuaagaacgcccaugcaaaaaagcaagagguggucgugcucggcucccaggaaggagcuaugcacaccgcccugacuggcgcuacagagauucagaauucagggggaaccaguauauucgccggucacuuaaagugucggcugaaaauggauaagcuagaacucaaaggcaugagcuacgcaaugugccugaacacauuuguccuuaagaaagaggugucugagacucagcaugggaccaucuugauuaagguugaauacaagggagaggacgcccccuguaaaaucccuuucuccacggaagauggccaagguaaggcucacaacgggcgucugauaaccgcgaauccagugguaacaaaaaaggaggagcccgucaacauugaagcagagccgccuuucggcgaaucaaauaucgugaucggaauuggcgacaaagcccucaagaucaacugguauaagaaagggagcaguauuggaaagauguuugaggcuacugcccgcggugcaagaaggauggccauacugggcgauaccgcuugggacuucgggucuguuggaggcgugcuuaauucccuggguaaaaugguccaucagaucuuugggagcgccuacacagcauuguucucgggcgugucuuggauuaugaagaucggaaucggcguacuccugacuuggauuggguuaaacuccaaaaauaccucaaugaguuuuagcugcauagugaucggaauuaucacgcuguaucuaggcgcgguuguccaggcugauauggguugugccauuaacuggaaggggaaggaacucaaaugcggauccggcaucuucgugacaaaugaggugcacaccuggacugagcaguacaaguuucaagcagacucucccaaacggcuggccacagcuauagccggugcaugggaaaacggcgucugugggauccgaagcaccacucgcauggagaaucuuuuguggaagcagauugcuaacgaacugaauuauauccucugggagaacaauauuaaacugaccguuguggugggagauaucauaggcguauuagaacaggggaagagaacacugacgccacagccuauggagcuuaaauacucauggaagaccuggggaaaggccaaaauugucacugcggagacacaaaacaguuccuucaucauugacggccccaacaccccagaaugccccagcgccucuagggcuuggaaugugugggagguugaagacuaugguuuugggguguucacaacuaacaucugguugaagcuccgggaggucuacacccagucaugugaucaucgccugaugagugcagccauaaaagacgaaagagcugugcacgccgauaugggauacuggaucgagagccagaagaauggcuccuggaaacuagagaaggcaucuuuuauugaaguuaagacgugcacauggccuaaaucgcacacccuguggagcaacggugugcucgaguccgacaugaucauuccaaagucacuggcgggcccgaucagucagcauaaucacaggcccggguaucauacucaaaccgccggaccuuggcaccuuggcaaauuggaacuggauuucaacuacugcgaggggacaacuguagucauaaccgagaauuguggaacacguggcccaucuuuacggacgaccacugugagcgguaagcucauucacgaauggugcugucgauccugcacacugcccccucuuagauauaugggggaggacggauguugguacggcauggaaaucaggccaaucaacgagaaagaagagaauauggugaagucacuggucagcgcugguucuggcaagguugauaacuuuaccauggggguguugugccucgccauucuguucgaggaaguaaugcgcggaaaauucggcaagaaacauaugaucgcaggggugcuauuuacuuucguccugcuccuguccggacagauuacauggcgggacauggcucacacccuuauaaugaucggcaguaaugccagcgauagaauggguaugggggugacguauuuggcacugauugccacuuuuaagauccagcccuucuuagcucucggauuuuuccugaggaaacuuaccucucgcgagaaccugcuacucggcguuggccuggcgauggccacaaccuugcaacugccggaagacauugagcagauggcaaaugggaucgcuuuaggacucaugacucugaagcuuauaacacaguuugaaaccuaccagcuguggacagccuuggugucccucacuuguucaaacaccaucuucacgcugacagucgccuggcgaaccgcuacucuaauucuggcaggugugagucuucucccucugugccaaagcucguccaugcggaagaccgauugguugccaaugacaguugccgcgaugggcgugcccccucugcccuuauuuaucuucucucucaaagacacuccaaagcguagaagcuggccucugaaugagggggucauggcuguaggacuugugucaauucuggccaguuccuugcucaggaacgauguucccauggcaggcccacugguggccggugggcuacugaucgcuuguuaugucauaaccggaacgucugcagaccuuacaguggagaaagccgcggacguaaccugggaagaggaagcugagcagacuggcgugagccauaaccucaugauuacagucgaugacgauggcaccaugcgcaucaaggacgaugaaacugagaauauccugacaguuuuguuaaaaaccgcccugcucauuguguccgggauauuuccguacucaaucccugcaacgcugcuuguguggcacacuuggcagaagcagacccaacggagcggaguccugugggacgugcccaguccacccgagacacagaaagccgaauuggaggaagguguuuacagaauuaagcagcagggcaucuucgggaagacccaaguaggagugggcguccagaaagaggguguguuucauacaauguggcacguuacuaggggggcugugcuaacccacaacggaaagcgacuggagccuaauugggccucugucaaaaaggaucucauuuccuauggcggcggguggcgccugagcgcacaguggcaaaaaggagaagaggugcagguaaucgcugucgaaccagguaagaaccccaagaauuuccagacgaugccuggcauauuccagacaacuaccggggagaucggagccauugcgcuugacuuuaaaccgggcacaucggguucaccaaucauuaaccgggaagggaaggugguuggauuauacggcaauggcguggucaccaaaaacgggggauaugugucugguaucgcccaaacuaaugcagagcccgauggcccuaccccagagcuggaagaggaaauguucaagaaaagaaaccucacaauaauggacuugcaucccgggaguggaaagacgaggaaguaccugccugcuauuguucgugaggccaucaaacgccggcucagaacucugauccuugcuccgaccaggguggucgcagccgaaauggaggaggcccugaagggcuugcccauucgauaucagacaaccgcuacuaaauccgaacacacaggucgggagaucguggaucuaaugugccaugcgaccuuuacgaugcgccugcucagcccaguaagagugccuaauuacaacuuaauaauuauggacgaagcacacuucacugaucccgccucuaucgcugccaggggguauauuagcacacggguuggaaugggcgaggcagccgcuaucuuuaugaccgcgaccccaccuggcacugccgaagcauucccccaguccaaugcuccaauacaggacgaggagcgagacauuccggaaagaucauggaacagugggaaugaguggaucacagauuuugucggaaagaccgugugguucgugccuagcaucaaagccgguaacgacauugcaaacugucugcgcaagaauggcaagaaagucauccaacuuucuaggaagacauuugauacugaauaccagaaaacgcgucugaacgacugggauuucguagugaccacagacauuuccgagaugggggccaauuuuaaggcugaucggguuauagaccccagaaggugccucaaaccagugaucuugacugauggacccgagcgcgucauucuggccggcccuaugccagugaccgcggcaucagccgcucagcgaagaggucggguugggaggaacccccagaaggaaaaugaccaauacaucuucacaggccagccucucaacaaugaugaggaccaugcccacuggaccgaagcuaagaugcugcuugacaacaucaauacuccggagggaauuauaccagcacuauucgaacccgagcgcgagaaaagugccgcuaucgauggcgaauaucgucugaagggggagagcagaaaaacguuuguggaauugaugcggaggggagacuuaccugucuggcuggcccacaagguggcauccgaggguauuaaauacaccgaucgcaaguggugcuucgacggcgaacgaaacaaucagauccucgaggagaacauggauguagaaauuuggacaaaagagggggaaagaaagaagcugcggcccagguggcuugacgcgcgcacuuauucugauccacuggcccucaaagaguuuaaggacuucgcugccggaagaaaaucgaucgcauuggaucuggugaccgaaauaggcaggguuccuagccaucuagcuuaccggacacguaaugcccuggacaaccucgucaugcuucacaccucagagcauggugggcgcgcauaucgacacgccguggaggaacugcccgagacuauggaaacauuauugcugcucggccugaugauccuucugacgggaggcgcuaugcucuuuuugauuuccgggaagggaaucgguaaaaccaguauuggccugaucugugugacugucucuagcgggauguuauggauggcggauguuccacuacaguggauagccuccgcaauugugcuggaguucuuuaugaugguacuccuuaucccugagccggaaaagcaaagaacaccccaggacaaucagcuggcuuacguggucauuggaaucuugacccuggccgccauaguggcagcuaacgagaugggccuccuggaaaccacaaagagggaucuugguaugucaaaagagccagggguugugucuccuacuagcuaucucgacgucgaccugcaccccgccagugcguggacguuguacgcuguagccaccacagugaucacuccaaugcugcggcauaccauugaaaauuccacagcaaacguuagcuuagccgcuaucgcaaaccaagccgugguccuaaugggccuggauaagggauggccuauuucuaaaauggaccucggcgugccccuucuggcguuggggugcuacucacaggucaauccgcugacccucacugcugccgugcugcuuuuaguuacgcacuaugcaaucauaggaccaggccugcaggccaaggcuacacgcgaggcccagaaaagaaccgcagcugguauuaugaagaacccuacuguggaugggaucaugaccaucgaccucgaucccguaauuuacgacuccaaguucgagaaacaauugggacaggugaugcugcuaguccugugugccguucagcuccuucugaugaggacaaguugggcguugugcgaagcccugacucucgcaaccggcccaaucacaacgcugugggaggguagccccggcaaguuuuggaauaccacuauagcugugucgauggccaacauuuuccgggggucuuauuuagcaggagcuggccuugccuuuuccaucaugaaaagcgucgggacaggacgaagaggcaccgguucacagggggaaacucugggagagaaguggaaaaagaagcucaaucaacuaagucgcaaagaauucgaucuguacaagaaaucuggcauuacagagguggacaggaccgaggccaaggaagguuugaaacggggcgagacgacccaucacgcgguaucccgugggagcgcuaagcugcagugguuuguggaaagaaacaugguuaucccugagggaagggugauagaucucggcugugggcgcggaggcuggucauauuacugcgcaggucuuaaaaaggucacagaagugcggggguauacuaagggaggcccgggccaugaggagcccgucccaaugaguaccuacggguggaaucuggugaaauugaugagcggaaaggacguuuucuaccugccucccgaaaaaugugauacacucuuaugcgacaucggugaguccucuccuagcccaacuguagaagagucccgaaccauuagagugcugaagauggucgagcccuggcuuaaaaacaaucaguucuguaucaaggugcugaacccuuauaugccaacaguuauugaacaccuagagaggcuccagcgcaaguacggcgggaugcuggugcggaaucccuugucaagaaacucuacccacgaaauguauuggaucaguaauggaacuggcaacauugucucgagcgugaauaugguaucccgucugcuccuuaacagguuuacgaugacacaucggcgcccgaccaucgagaaagauguggaccugggugccgggacucgacacguuaacgcugaaccugagaccccaaauauggacgucauaggagagagaauuaagaggaucaaagaagagcauucuucaacauggcacuacgaugacgaaaaccccuauaagacgugggccuaccacggcagcuaugaggugaaagcaaccggcuccgccaguucuaugaucaaugggguggucaaguuacugacuaagccuugggauguugugccaaugguaacacaaauggcuaugaccgacacuacacccuucggacagcagcggguguuuaaagaaaaggucgauacccgcacaccgagaccuaugcccgguacuaggaaagugauggagauuaccgcggagugguuguggcgaacgcucggccggaacaagaaaccacgucugugcaccagagaagaguucacaaagaagguucgcacuaaugccgcaaugggggcuguguuuaccgaagagaaccaaugggacagcgccagggcagccgucgaagaugaggaguucuggaaacuaguggaccgggaaagagagcuucauaagcugggaaaauguggcucaugcguauacaauaugauggguaagcgcgaaaaaaagcucggggaguuuggaaaagcuaagggcuccagggccauaugguacauguggcugggcgcgcgauauuuggaguucgaagcacugggguuucucaacgaggaucacugguucagucgggaaaauagcuacucuggaguugagggugaaggccuucauaagcugggguauaucuuaagagacauuuccaaaaucccuggaggcgccauguacgcugaugacacagccgguugggacacuaggauuaccgaggaugaccugcacaacgaggaaaagaucacgcagcagauggaucccgagcaucgccaguuggcaaaugcuauauuuaaacucacauaucaaaacaagguggucaaagugcagcguccaacccccaaggggacugugauggacaucauuucacggaaggaucagagaggaagcggccaggucggcacauacgggcugaauaccuucacuaacauggaagcccaacuaguuaggcagauggagggagaaggugugcuuucgaaagcugaccuggagaauccucaccuccuggagaagaaaaucacccagugguuggaaacaaagggcguagagcgcuuaaaacgaauggccauuucuggggaugacugcguggucaagccaaucgaugaccgguuugcaaacgcgcugcucgcccuuaacgauaugggaaaggugagaaaagacauaccgcaguggcaacccaguaagggcuggcacgauuggcagcagguuccuuucuguucccaucacuuccaugaacugauuaugaaagacgguaggaagcuaguggucccaugccgcccccaggacgagcugaucgggagagcucggaucagccaaggagccggcuggucacucaaagaaacggcauguuugggcaaggcuuaugcccagauguggucccugauguacuuucacaggcgugaucuucgacuggcaucuaaugccauuugcagcgcggugccuguacacuggauaccaaccagucgcacuacaugguccauccaugcucaccaucaguggaugaccacugaggacaugcucacaguuuggaacagaguguggauugaggauaaucccuggauggaagacaagaccccugucacgacaugggaggaugugccguacuuagggaaacgggaagaccaaugguguggaagccugaucgguuugaccucuagggccacuugggcacagaacauucugaccgccauccagcagguucgcucacucauaggcgaugaggaguuccuugacuauaugccaaguaugaagagauuucggaaagaagaggaauccgagggggcuaucugguga

SEQ ID NO: 15584 - RNA, 9873 nt, Artificial Sequence
  derived and/or modified CDS sequence (opt3) from DENV-3__FJ547062__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuucuacaucguuaacucagaagguugugaucuucauacugcuuauguuggucaccccaucaaugacaaugcgcugugugggcguaggcaacagagacuuuguugaagggcugagcggagccaccuggguggaugucgugcuagagcaugguggcugcgugacgacuauggcgaagaauaaacccacacucgacaucgagcugcagaagaccgaagcaacucaacuugccacacugaggaaauuguguauugaggggaagaucaccaacauuacgaccgauagucggugcccuacacagggagaagcuauccucccagaggaacaggaccagaauuaugucuguaaacacacuuacguugaucgcggcugggguaacgggugcggacuguucggcaagggcuccuuagugaccugcgccaaguuucaaugucuggagcccauagaggggaaaguagugcaguaugaaaaucucaaguacacagucauuaucacugugcacaccggagaccagcaucagguugguaacgacacacaaggcgugaccgucgagauuacuccucaggcaucuacgguggaagcuauccuuccagaguaugggacacugggauuggaaugcagcccgcgaaccggccuagauuucaaugagaugauccugcucacuaugaaaaacaaggccuggaugguacacagacagugguuuuucgaccugccccuuccuuggaccuccggugcgacaaccgagacuccaacauggaauaggaaagaacuguugguuacguuuaagaacgcccaugcaaaaaagcaagagguggucgugcucgggucacaggaaggcgcuaugcacaccgcccugacuggagcuacagagauucagaauaguggcgggaccagcauauucgccggacacuuaaagugucggcugaaaauggauaagcuagaacucaaagguaugucuuacgcaaugugccugaacacauuuguccuuaagaaagagguguccgagacucagcauggcaccaucuugauuaagguugaauacaagggggaggacgcccccuguaaaaucccuuucucaacggaagauggacaaggcaaggcucacaacggucgucugauaaccgcgaauccagugguaacaaaaaaggaggagcccgucaacauugaagcagagccgccuuucggggaaagcaauaucgugaucggcauuggagacaaagcccucaagaucaacugguauaagaaaggcaguucuauugggaagauguuugaggcuacugcccgcggagcaagaaggauggccauacugggugauaccgcuugggacuucggcuccguugggggagugcuuaauagccugggcaaaaugguccaucagaucuuugguucggccuacacagcauuguucucugggguguccuggauuaugaagaucggcaucggaguacuccugacuuggauuggcuuaaacucaaaaaauaccaguaugagcuuuuccugcauagugaucgggauuaucacgcuguaucuaggagcgguuguccaggcugauaugggcugugccauuaacuggaaggguaaggaacucaaaugcgggucuggaaucuucgugacaaaugaggugcacaccuggacugagcaguacaaguuucaagcagacagccccaaacggcuggccacagcuauagccggcgcaugggaaaacggugucuguggcauccgaucaaccacucgcauggagaaucuuuuguggaagcagauugcuaacgaacugaauuauauccucugggagaacaauauuaaacugaccguuguggugggggauaucauaggaguauuagaacagggcaagagaacacugacgccacagccuauggagcuuaaauacaguuggaagaccugggggaaggccaaaauugucacugcggagacacaaaacuccagcuucaucauugacggacccaacaccccagaaugccccucugccucaagggcuuggaaugugugggagguugaagacuauggcuuugguguguucacaacuaacaucugguugaagcuccgggaggucuacacccagaguugugaucaucgccugaugagcgcagccauaaaagacgaaagagcugugcacgccgauaugggguacuggaucgagucccagaagaauggaucuuggaaacuagagaaggcaucguuuauugaaguuaagacgugcacauggccuaaaagccacacccugugguccaacggcgugcucgagucagacaugaucauuccaaagagucuggcggguccgaucucucagcauaaucacaggcccggcuaucauacucaaaccgccgggccuuggcaccuuggaaaauuggaacuggauuucaacuacugcgagggcacaacuguagucauaaccgagaauugugggacacguggaccaagcuuacggacgaccacuguguccggcaagcucauucacgaauggugcugucgaucaugcacacugcccccucuuagauauaugggugaggacggguguugguacggaauggaaaucaggccaaucaacgagaaagaagagaauauggugaagagccuggucucugcuggcuccgguaagguugauaacuuuaccaugggcguguugugccucgccauucuguucgaggaaguaaugcgcgggaaauucggaaagaaacauaugaucgcaggcgugcuauuuacuuucguccugcuccugagugggcagauuacauggcgggacauggcucacacccuuauaaugaucggaagcaaugccucugauagaaugggcaugggugugacguauuuggcacugauugccacuuuuaagauccagcccuucuuagcucucggguuuuuccugaggaaacuuaccucccgcgagaaccugcuacucggaguuggccuggcgauggccacaaccuugcaacugccggaagacauugagcagauggcaaauggcaucgcuuuagggcucaugacucugaagcuuauaacacaguuugaaaccuaccagcuguggacagccuuggugucacucacuuguaguaacaccaucuucacgcugacagucgccuggcgaaccgcuacucuaauucuggcaggagugagccuucucccucugugccaaucguccucuaugcggaagaccgauugguugccaaugacaguugccgcgaugggugugcccccucugcccuuauuuaucuucagccucaaagacacuccaaagcguagaucauggccucugaaugagggcgucauggcuguagggcuugugaguauucuggccuccucuuugcucaggaacgauguucccauggcaggaccacugguggccggcggucuacugaucgcuuguuaugucauaaccgggacgagcgcagaccuuacaguggagaaagccgcggacguaaccugggaagaggaagcugagcagacuggagugucccauaaccucaugauuacagucgaugacgauggcaccaugcgcaucaaggacgaugaaacugagaauauccugacaguuuuguuaaaaaccgcccugcucauugugucaggcauauuuccguacagcaucccugcaacgcugcuuguguggcacacuuggcagaagcagacccaacggagugggguccugugggacgugcccucuccacccgagacacagaaagccgaauuggaggaaggaguuuacagaauuaagcagcaggguaucuucggcaagacccaaguaggggugggaguccagaaagagggcguguuucauacaauguggcacguuacuaggggugcugugcuaacccacaacgggaagcgacuggagccuaauugggccuccgucaaaaaggaucucauuagcuauggaggcggcuggcgccugucggcacaguggcaaaaaggggaagaggugcagguaaucgcugucgaaccaggaaagaaccccaagaauuuccagacgaugccugguauauuccagacaacuaccggcgagaucggggccauugcgcuugacuuuaaaccgggaacaucaggcucuccaaucauuaaccgggaagguaaggugguuggguuauacggaaauggcguggucaccaaaaacggcggguaugugaguggaaucgcccaaacuaaugcagagcccgaugguccuaccccagagcuggaagaggaaauguucaagaaaagaaaccucacaauaauggacuugcaucccggcuccgggaagacgaggaaguaccugccugcuauuguucgugaggccaucaaacgccggcucagaacucugauccuugcuccgaccaggguggucgcagccgaaauggaggaggcccugaagggauugcccauucgauaucagacaaccgcuacuaaaagcgaacacacaggccgggagaucguggaucuaaugugccaugcgaccuuuacgaugcgccugcucucuccaguaagagugccuaauuacaacuuaauaauuauggacgaagcacacuucacugaucccgccagcaucgcugccagggguuauauuuccacacggguugggaugggagaggcagccgcuaucuuuaugaccgcgaccccaccuggcacugccgaagcauucccccagucaaaugcuccaauacaggacgaggagcgagacauuccggaaagaaguuggaacagcggcaaugaguggaucacagauuuugucgggaagaccgugugguucgugccuucuaucaaagccggaaacgacauugcaaacugucugcgcaagaaugguaagaaagucauccaacuuuccaggaagacauuugauacugaauaccagaaaacgcgucugaacgacugggauuucguagugaccacagacauuucagagaugggcgccaauuuuaaggcugaucggguuauagaccccagaaggugccucaaaccagugaucuugacugaugggcccgagcgcgucauucuggccggaccuaugccagugaccgcggcaagugccgcucagcgaagaggccggguugguaggaacccccagaaggaaaaugaccaauacaucuucacagggcagccucucaacaaugaugaggaccaugcccacuggaccgaagcuaagaugcugcuugacaacaucaauacuccggagggcauuauaccagcacuauucgaacccgagcgcgagaaaagcgccgcuaucgauggagaauaucgucugaagggcgaguccagaaaaacguuuguggaauugaugcggaggggggacuuaccugucuggcuggcccacaagguggcaucugagggaauuaaauacaccgaucgcaaguggugcuucgacggugaacgaaacaaucagauccucgaggagaacauggauguagaaauuuggacaaaagagggcgaaagaaagaagcugcggcccagguggcuugacgcgcgcacuuauucggauccacuggcccucaaagaguuuaaggacuucgcugccgggagaaaaagcaucgcauuggaucuggugaccgaaauaggaaggguuccuucacaucuagcuuaccggacacguaaugcccuggacaaccucgucaugcuucacaccuccgagcauggcggucgcgcauaucgacacgccguggaggaacugcccgagacuauggaaacauuauugcugcucgggcugaugauccuucugacgggcggagcuaugcucuuuuugauuaguggcaaggggaucggaaaaaccucuauuggucugaucugugugauagucagcuccggcauguuauggauggcggauguuccacuacaguggauugccucagcaaucgugcuggaguucuuuaugaugguacuccuuauuccugagccggaaaagcaaagaacuccccaggacaaucagcuggcuuacguggucaucgggauauugacacuggccgccaucguggcagcuaacgagaugggacuccuggaaaccaccaagagggaucuuggcaugucuaaagagccagguguugugagcccuacaaguuaucucgacgucgaccugcaccccgccuccgcguggacuuuguacgcuguagccacgaccgugauuacaccaaugcugcggcauacuaucgaaaauagcaccgcaaacguuucuuuagccgcuauugcaaaccaagccgugguccuaauggggcuggauaagggcuggccuaucucaaaaauggaccucggagugccccuucuggcguugggcugcuacucccaggucaauccgcugacacucaccgcugccgugcugcuuuuaguuacucacuaugcaauaauugggccaggacugcaggccaaggcuacgcgcgaggcccagaaaagaacagcagcuggcaucaugaagaacccuaccguggaugguaucaugacuauugaccucgaucccguaaucuacgacaguaaguucgagaaacaauuggggcaggugaugcugcuaguccugugugccguucagcuccuucugaugaggaccagcugggcguugugcgaagcccugacacucgcaacuggaccaauaaccacacugugggagggcucgcccgguaaguuuuggaauacgaccauugcugugucuauggccaacaucuuccggggcuccuauuuagcaggggcuggacuugccuuuagcauuaugaaaucagucggcacugggcgaagaggaacaggcagucagggugaaacccugggggagaaguggaaaaagaagcucaaucaacuaucucgcaaagaauucgaucuguacaagaaauccggaaucacugagguggacaggacagaggccaaggaaggcuugaaacggggugagaccacgcaucacgcgguaagccguggcucagcuaagcugcagugguuuguggaaagaaacaugguuauaccugaggggagggugaucgaucucggauguggccgcgggggauggaguuauuacugcgcaggccuuaaaaaggucaccgaagugcgggguuauacaaaggggggaccgggccaugaggagcccgucccaaugagcacuuacggcuggaaucuggugaaauugauguccgggaaggacguuuucuaccugccucccgaaaaaugugauacccucuuaugcgacauuggagagucuagcccuuccccaacaguagaagagucacgaacuaucagagugcugaagauggucgagcccuggcuuaaaaacaaucaguucuguauuaaggugcugaacccuuauaugccaaccguuaucgaacaccuagagaggcuccagcgcaaguacgguggcaugcuggugcggaaucccuugucuagaaacaguacacacgaaauguauuggauuucgaaugggaccggaaacaucgucagcuccgugaauaugguaucucgucugcuccuuaacagguuuacuaugacgcaucggcgcccgacaauagagaaagauguggaccugggcgccgguacccgacacguuaacgcugaaccugagacuccaaauauggacgucauuggggagagaaucaagaggaucaaagaagagcauucaagcaccuggcacuacgaugacgaaaaccccuauaagacaugggccuaccacggauccuaugaggugaaagcaacgggcagugccucuagcaugauuaauggcguggucaaguuacugaccaagccuugggauguugugccaaugguaacucaaauggcuaugacagacaccacucccuucgggcagcagcggguguuuaaagaaaaggucgauacacgcaccccgagaccuaugcccggaacaaggaaagugauggagauaacugcggagugguuguggcgaacccucggucggaacaagaaaccacgucugugcacgagagaagaguucaccaagaagguucgcacaaaugccgcaaugggcgcuguguuuacugaagagaaccaaugggacucagccagggcagccgucgaagaugaggaguucuggaaacuaguggaccgggaaagagagcuucauaagcuggggaaauguggauccugcguauacaauaugaugggcaagcgcgaaaaaaagcucggugaguuugggaaagcuaagggaaguagggccaucugguacauguggcugggcgcgcgauauuuggaguucgaagcacugggcuuucucaacgaggaucacugguucagccgggaaaauucuuacuccgggguugagggagaaggucuucauaagcugggcuauauuuuaagagacaucucaaaaauuccugggggagccauguacgcugaugacaccgccggcugggacacaaggaucacugaggaugaccugcacaacgaggaaaagauaacccagcagauggaucccgagcaucgccaguuggcaaaugcuaucuuuaaacucacguaucaaaacaagguggucaaagugcagcguccaacacccaaggguaccgugauggacauuaucagccggaaggaucagagagggucgggacaggucggcacuuacggccugaauacauucaccaacauggaagcccaacuaguuaggcagauggagggggaaggagugcuuucuaaagcugaccuggagaauccucaccuccuggagaagaaaauuacucagugguuggaaaccaaggguguagagcgcuuaaaacgaauggccaucaguggcgaugacugcguggucaagccaauagaugaccgguuugcaaacgcgcugcucgcccuuaacgauauggggaaggugagaaaagacauuccgcaguggcaacccuccaagggauggcacgauuggcagcagguuccuuucuguagccaucacuuccaugaacugaucaugaaagacggcaggaagcuaguggucccaugccgcccccaggacgagcugaucgguagagcucggauuucacaaggggccggauggucccucaaagaaacagcauguuugggcaaggcuuaugcccagauguggucucugauguacuuucacaggcgugaucuucgacuggcaagcaaugccauaugcagugcggugccuguacacuggaucccaacgucccgcaccacuuggagcauucaugcucaccaucaguggaugacaaccgaggacaugcucacuguuuggaacagaguguggaucgaggauaaucccuggauggaagacaagacaccugucaccacgugggaggaugugccguacuuaggcaaacgggaagaccaauggugugggucucugauuggauugacaucaagggccaccugggcacagaacauccugacugccauacagcagguucgcagucucaucggugaugaggaguuccuugacuauaugccauccaugaagagauuucggaaagaagaggaaagcgagggcgcuauuugguga

SEQ ID NO: 15585 - RNA, 9873 nt, Artificial Sequence
  derived and/or modified CDS sequence (opt3) from DENV-3__FJ461322__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcgcacaguggcaaaaaggagaagagguacaggucauugcuguggaaccagguaagaaccccaagaauuuccagacgaugccuggcaucuuccagacaacuaccggggagauaggagccaucgcgcuugacuuuaaaccgggcacaucggguucaccaauuaucaaccgggaagggaagguugugggauuauacggcaauggcgucgugaccaaaaacgggggauauguuucugguauugcccaaacuaaugcagagcccgauggcccuaccccagagcuggaagaggaaauguucaagaaaagaaaccucacaaucauggacuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaucuaaugugccaugcgaccuuuacgaugcgccugcucagcccagugagaguuccuaauuacaacuuaaucauaauggacgaagcacacuucacugaucccgccucuauugcugccaggggguauaucagcacacgggucggaaugggcgaggcagccgcuauuuuuaugaccgcgaccccaccuggcacugccgaagcauucccccaguccaaugcuccaauccaggacgaggagcgagacauaccggaaagaucauggaacagugggaaugaguggauuacagauuuugugggaaagaccgugugguucgucccuagcaucaaagccgguaacgacaucgcaaacugucugcgcaagaauggcaagaaaguaauucaacuuucuaggaagacauuugauacugaauaccagaaaacgcgucugaacgacugggauuucgugguuaccacagacaucuccgagaugggggccaauuuuaaggcugaucgggugauugaccccagaaggugccucaaaccagucauauugacugauggacccgagcgcgugauccuggccggcccuaugccaguuaccgcggcaucagccgcucagcgaagaggucggguggggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuugucgaauugaugcggaggggagacuuaccuguguggcuggcccacaagguagcauccgaggguaucaaauacaccgaucgcaaguggugcuucgacggcgaacgaaacaaucagauucucgaggagaacauggauguggaaaucuggacaaaagagggggaaagaaagaagcugcggcccagguggcuugacgcgcgcacuuauucugauccacuggcccucaaagaguuuaaggacuucgcugccggaagaaaaucgauugcauuggaucugguuaccgaaaucggcagggucccuagccaucuagcuuaccggacacguaaugcccuggacaaccucgugaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggaggugccacuacaguggauagccuccgcaauuguacuggaguucuuuaugauggugcuccuuaucccugaaccggagaagcaaagaacuccccaggauaaucagcuggcuuacgucgugauuggaaucuugacacuggccgccauaguugcagcuaacgaaaugggccuccuggagaccaccaagagggaccuugguaugucaaaagaaccagggguggucucuccuacaagcuaucucgauguagaccugcaccccgccagugcguggacuuuguacgcuguggccacgaccguuaucacaccaaugcugcggcauacuauugagaauuccaccgcaaacgugagcuuagccgcuaucgcaaaccaagccgucgugcuaaugggccuggacaagggauggccuauuucuaaaauggaucucggcgucccccuucuggcguuggggugcuacucacaggugaauccgcugacacucaccgcugccguucugcuuuuagugacucacuaugcaaucauaggaccaggccugcaggccaaggcuacgcgcgaggcccagaaaagaacagcagcugguauuaugaagaacccuaccguagacgggaucaugacuaucgaucucgaccccgugauuuacgauuccaaguucgaaaaacaauugggacaggucaugcugcuaguucugugugccgugcagcuccuucugaugaggaccaguugggcguugugcgaggcccugacacucgcaacuggcccaaucaccacacugugggaagguagccccggcaaguuuuggaauacgaccauagcugucucgauggccaacauuuuccgggggucuuauuuagcaggagcuggccuugccuuuuccaucaugaaaagcguggggacuggacgaagaggcacagguucacagggggagacccugggagaaaaguggaaaaagaagcucaaucaacuaagucgcaaagaguucgaccuguacaagaaaucuggcauuacugagguagauaggacagaagccaaggaggguuugaaacggggcgaaaccacgcaucacgcggugucccgugggagcgcuaagcugcagugguuuguugagagaaacauggugaucccugaaggaagggucauagaccucggcugugggcgcggaggcuggucauauuacugcgcaggucuuaaaaaggugaccgagguccggggguauacaaagggaggcccgggccaugaggaacccgugccaaugaguacuuacggguggaauaucguuaaacugaugagcggaaaggauguauucuacuugccucccgagaaaugugacacccugcucugcgauauuggugaauccucuccuagcccaacaguggaggagucccgaacuaucagagucuuaaagaugguggaacccuggcugaaaaacaaucaguucuguauuaagguucuuaacccuuauaugccaaccgugaucgagcaccuggaaaggcuacagcgcaaguacggcgggaugcucguccggaauccccugucaagaaacucuacacacgagauguauuggauuaguaauggaaccggcaacaucgugucgagcguaaauauggugucccguuugcugcucaacagguuuacuaugacgcaucggcgcccgacaauagaaaaagacguugaucuuggugccgggacccgacacgucaacgcugagccugagacuccaaauauggacgugauuggagaaagaaucaagaggaucaaagaggaacauucuucaaccuggcacuacgacgaugagaaccccuauaagacaugggccuaccacggcagcuaugaagugaaagcaacgggcuccgccaguucuaugauuaauggggucguuaagcuguuaaccaagccuugggacgugguaccaauggugacucaaauggcuaugacagauaccacucccuucggacagcagcgggucuuuaaagagaagguggacacacgcaccccgagaccuaugcccgguacaaggaaaguuauggagauaacugcggaauggcuguggcgaaccuugggccggaacaagaaaccacgucucugcacgagagaggaauucaccaagaaggugcgcacaaaugccgcaaugggggcugucuuuacugaggaaaaccaaugggauagcgccagggcagccguggaggacgaggaauucuggaaacugguagaucgggagagagaacuacauaagcuuggaaaauguggcucaugcguuuacaauaugauggguaagcgcgagaaaaagcugggggaguuuggaaaagcuaagggcuccagggccaucugguacauguggcucggcgcgcgauaucuggaauucgaggcauugggguuucugaacgaagaccacugguucagucgggagaauagcuacucuggaguggaaggugagggccuccauaagcuuggguauauucugagagauaucuccaaaauuccuggaggcgccauguacgcugacgauaccgccgguugggacacaaggaucacugaggacgauuuacacaacgaagagaagauaacccagcagauggaccccgaacaucgccagcuggcaaaugcuaucuuuaaauugacguaucaaaacaaggucgugaaagugcagcguccaacacccaaggggaccgucauggauauuaucucacggaaggaccagagaggaagcggccagguuggcacuuacgggcucaauacauucaccaacauggaggcccaacuggugaggcagauggaaggagaggguguacuaucgaaagcugaucuugagaauccucaccugcucgaaaagaaaauuacucaguggcuggagaccaagggcguggaacgcuugaaacgaauggccaucucuggggacgauugcgucgugaagccaauagacgaucgguuugcaaacgcguuacuggcccucaacgacaugggaaagguuagaaaagauauuccgcaguggcaacccaguaagggcuggcacgacuggcagcaggugccuuucuguucccaucacuuccaugagcuuaucaugaaagaugguaggaagcuggucgugccaugccgcccccaggacgaacuaaucgggagagcucggauuagccaaggagccggcuggucacugaaagagacagcaugucucggcaaggcuuaugcccagaugugguccuugauguacuuucacaggcgugaccugcgacuugcaucuaaugccauaugcagcgcgguaccuguucacuggaucccaacgagucgcaccacuugguccauucaugcucaccaucaguggaugacaaccgaggauaugcugacuguguggaacagagucuggaucgaagacaaucccuggauggaggauaagacaccugugaccacgugggaagacauuccguaccucgggaaacgggaggaucaaugguguggaagcuuaaucggucugacaucuagggccaccugggcacagaacauauugacugccauccagcagguucgcucacugauuggcgacgaggaauuccucgauuauaugccaaguaugaagagauuucggaaagaggaagaguccgaaggggcuaucugguga

SEQ ID NO: 15586 - RNA, 9873 nt, Artificial Sequence
  derived and/or modified CDS sequence (opt3) from DENV-3__KF955458__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggaggugaauacccagucaugugaucaucgccugaugagugcagccaucaaagacgaaagagcuguucacgccgauaugggauacuggauagagagccagaagaacggcuccuggaaacuagagaaggcaucuuuuaucgaagugaagacgugcacauggccuaaaucgcacacccuguggagcaaugguguacucgaguccgacaugauuaucccaaagucacuggcgggcccgauuagucagcauaaccacaggcccggguaccauacucaaaccgccggaccuuggcaccuuggcaaauuggaacuggauuucaauuauugcgaggggacaacugucgugaucaccgagaacuguggaacacguggcccaucuuuacggacgaccacugugagcgguaagcucauacacgaauggugcugucgauccugcacacugcccccucuuagauacaugggggaggacggauguugguauggcauggaaauuaggccaaucaaugagaaagaagagaacauggucaagucacugguuagcgcugguucuggcaagguggauaauuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaacgccagcgauagaauggguauggggguuacguacuuggcacugaucgccacuuuuaagauucagcccuucuuagcucucggauuuuuccugaggaaacuuaccucucgcgagaaucugcuacucggcgugggccuggcgauggccacaaccuugcaacugccggaagacaucgagcagauggcaaacgggauugcuuuaggacucaugacucugaagcuuaucacacaguuugaaaccuaucagcuguggacagccuuggucucccucacuuguucaaauaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaacgaggggguaauggcugugggacuuguuucaauccuggccaguuccuugcucaggaacgaugugcccauggcaggcccacuggucgccggugggcuacugauugcuuguuacgugaucaccggaacgucugcagaccuuacaguagagaaagccgcggacgugaccugggaagaggaagcugagcagacuggcgucagccauaaucucaugauaacaguugaugacgauggcaccaugcgcauuaaggacgaugaaacugagaacauccugacaguguuguuaaaaaccgcccugcucaucguguccgggauuuuuccguauucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaauggaaagcgacuggagccuaacugggccucugugaaaaaggaucucaucuccuacggcggcggguggcgccugagcgcacaguggcaaaaaggagaagagguacaggucauugcuguggaaccagguaagaaucccaagaacuuccagacgaugccuggcaucuuccagacaacuaccggggagauaggagccaucgcgcuugacuuuaaaccgggcacaucggguucaccaauuaucaaucgggaagggaagguugugggauuauauggcaacggcgucgugaccaaaaaugggggauacguuucugguauugcccaaacuaacgcagagcccgauggcccuaccccagagcuggaagaggaaauguucaagaaaagaaaucucacaaucauggacuugcaucccgggaguggaaagacgaggaaguaucugccugcuauagugcgugaggccauuaaacgccggcucagaacucugauccuugcuccgaccagggucguggcagccgaaauggaggaggcccugaagggcuugcccauccgauaccagacaaccgcuacuaaauccgaacacacaggucgggagauuguagaucuaaugugccaugcgaccuuuacgaugcgccugcucagcccagugagaguuccuaacuauaauuuaaucauaauggacgaagcacacuucacugaucccgccucuauugcugccaggggguacaucagcacacgggucggaaugggcgaggcagccgcuauuuuuaugaccgcgaccccaccuggcacugccgaagcauucccccaguccaacgcuccaauccaggacgaggagcgagacauaccggaaagaucauggaauagugggaacgaguggauuacagauuuugugggaaagaccgugugguucgucccuagcaucaaagccgguaacgacaucgcaaauugucugcgcaagaacggcaagaaaguaauucaacuuucuaggaagacauuugauacugaauaucagaaaacgcgucugaaugacugggauuucgugguuaccacagacaucuccgagaugggggccaacuuuaaggcugaucgggugauugaccccagaaggugccucaaaccagucauauugacugauggacccgagcgcgugauccuggccggcccuaugccaguuaccgcggcaucagccgcucagcgaagaggucggguggggaggaauccccagaaggaaaacgaccaauacauuuucacaggccagccucucaauaacgaugaggaccaugcccacuggaccgaagcuaagaugcugcuugacaauaucaacacuccggagggaaucauuccagcacuauucgaacccgagcgcgagaaaagugccgcuauagauggcgaauaccgucugaagggggagagcagaaaaacguuugucgaauugaugcggaggggagacuuaccuguguggcuggcccacaagguagcauccgaggguaucaaauauaccgaucgcaaguggugcuucgacggcgaacgaaauaaccagauucucgaggagaauauggauguggaaaucuggacaaaagagggggaaagaaagaagcugcggcccagguggcuugacgcgcgcacuuacucugauccacuggcccucaaagaguuuaaggacuucgcugccggaagaaaaucgauugcauuggaucugguuaccgaaaucggcagggucccuagccaucuagcuuaucggacacguaacgcccuggacaaucucaugaugcuucacaccucagagcauggugggcgcgcauaccgacacgccguggaggaacugcccgagacuauggaaacauuauugcugcucggccugaugauacuucugacgggaggcgcuaugcucuuuuugaucuccgggaagggaauugguaaaaccaguaucggccugauuugugugaucgucucuagcgggauguuauggauggcggauguuccacuacaguggauagccuccgcaauugugcuggaguucuuuaugaugguacuccuuaucccugagccggaaaagcaaagaacuccccaggacaaccagcuggcuuauguggucauuggaaucuugacacuggccgccauaguggcagcuaaugagaugggccuccuggaaaccaccaagagggaucuugguaugucaaaagagccagggguugugucuccuacaagcuaccucgacgucgaccugcaccccgccagugcguggacuuuguaugcuguagccacgaccgugaucacaccaaugcugcggcauacuauugaaaacuccaccgcaaacguuagcuuagccgcuaucgcaaaucaagccgugguccuaaugggccuggauaagggauggccuauuucuaaaauggaccucggcgugccccuucuggcguuggggugcuacucacaggucaacccgcugacacucaccgcugccgugcugcuuuuaguuacucacuacgcaaucauaggaccaggccugcaggccaaggcuacgcgcgaggcccagaaaagaacagcagcugguauuaugaagaauccuaccguggaugggaucaugacuaucgaccucgaucccguaauuuaugacuccaaguucgagaaacaauugggacaggugaugcugcuaguccugugugccguucagcuccuucugaugaggaccaguugggcguugugcgaagcccugacacucgcaacuggcccaaucaccacacugugggaggguagccccggcaaguuuuggaacacgaccauagcugugucgauggccaauauuuuccgggggucuuacuuagcaggagcuggccuugccuuuuccaucaugaaaagcgucgggacuggacgaagaggcacagguucacagggggaaacccugggagagaaguggaaaaagaagcucaaccaacuaagucgcaaagaauucgaucuguauaagaaaucuggcauuacugagguggacaggacagaggccaaggaagguuugaaacggggcgagaccacgcaucacgcgguaucccgugggagcgcuaagcugcagugguuuguggaaagaaauaugguuaucccugagggaagggugauagaucucggcugugggcgcggaggcuggucauacuauugcgcaggucuuaaaaaggucaccgaagugcggggguacacaaagggaggcccgggccaugaggagcccgucccaaugaguacuuauggguggaaccuggugaaauugaugagcggaaaggacguuuucuaccugccucccgaaaaaugugauacccucuuaugcgacaucggugaguccucuccuagcccaacaguagaagagucccgaacuauuagagugcugaagauggucgagcccuggcuuaaaaauaaccaguucuguaucaaggugcugaauccuuacaugccaaccguuauugaacaccuagagaggcuccagcgcaaguauggcgggaugcuggugcggaaccccuugucaagaaauucuacacacgaaauguacuggaucaguaacggaaccggcaauauugucucgagcgugaacaugguaucccgucugcuccuuaacagguuuacuaugacgcaucggcgcccgacaaucgagaaagauguggaccugggugccgggacccgacacguuaaugcugaaccugagacuccaaacauggacgucauaggagagagaauuaagaggaucaaagaagagcauucuucaaccuggcacuaugaugacgaaaaucccuacaagacaugggccuaucacggcagcuacgaggugaaagcaacgggcuccgccaguucuaugaucaacgggguggucaaguuacugaccaagccuugggauguugugccaaugguaacucaaauggcuaugacagacaccacucccuucggacagcagcggguguuuaaagaaaaggucgauacacgcaccccgagaccuaugcccgguacaaggaaagugauggagauuacugcggagugguuguggcgaacccucggccggaauaagaaaccacgucugugcacgagagaagaguucaccaagaagguucgcacaaacgccgcaaugggggcuguguuuacugaagagaaucaaugggacagcgccagggcagccgucgaagaugaggaguucuggaaacuaguggaccgggaaagagagcuucauaagcugggaaaauguggcucaugcguauauaacaugauggguaagcgcgaaaaaaagcucggggaguuuggaaaagcuaagggcuccagggccauaugguacauguggcugggcgcgcgauacuuggaguucgaagcacugggguuucucaaugaggaucacugguucagucgggaaaacagcuauucuggaguugagggugaaggccuucauaagcugggguacaucuuaagagacauuuccaaaaucccuggaggcgccauguaugcugaugacaccgccgguugggacacaaggauuacugaggaugaccugcacaaugaggaaaagaucacccagcagauggaucccgagcaucgccaguuggcaaacgcuauauuuaaacucacguaccaaaauaagguggucaaagugcagcguccaacacccaaggggaccgugauggacaucauuucacggaaggaucagagaggaagcggccaggucggcacuuaugggcugaacacauucaccaauauggaagcccaacuaguuaggcagauggagggagaaggugugcuuucgaaagcugaccuggagaacccucaccuccuggagaagaaaaucacucagugguuggaaaccaagggcguagagcgcuuaaaacgaauggccauuucuggggaugacugcguggucaagccaaucgaugaccgguuugcaaacgcgcugcucgcccuuaaugauaugggaaaggugagaaaagacauaccgcaguggcaacccaguaagggcuggcacgauuggcagcagguuccuuucuguucccaucacuuccaugaacugauuaugaaagacgguaggaagcuaguggucccaugccgcccccaggacgagcugaucgggagagcucggaucagccaaggagccggcuggucacucaaagaaacagcauguuugggcaaggcuuacgcccagauguggucccugauguauuuucacaggcgugaucuucgacuggcaucuaacgccauuugcagcgcggugccuguacacuggauaccaacgagucgcaccacuugguccauccaugcucaccaucaguggaugacaaccgaggacaugcucacuguuuggaauagaguguggauugaggauaaccccuggauggaagacaagacaccugucaccacgugggaggaugugccguacuuagggaaacgggaagaccaaugguguggaagccugaucgguuugacaucuagggccaccugggcacagaauauucugacugccauccagcagguucgcucacucauaggcgaugaggaguuccuugacuacaugccaaguaugaagagauuucggaaagaagaggaauccgagggggcuaucugguga

SEQ ID NO: 15587 - RNA, 9873 nt, Artificial Sequence
  derived and/or modified CDS sequence (opt3) from DENV-3__FJ562102__SS-prME
acaagccugugccucaugaugaugcuucccgcaacacuggcuuuccacuugacuuccagggacggagaaccuaggaugaucguggggaagaacgaacggggaaaaucuuuacuguuuaagacggcaucagguauuaauauguguacccuaauugcaauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcgucgcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucaccaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacaccuuuauuaugauaggcaguaaugccagcgauagaauggguauggggguuacguaucuugcauugaucgccacuuucaagauucagcccuuucuggcuuuaggauucuuucucaggaaacugaccucucgcgagaaccuucugcuaggcgugggccucgcgauggccacaacccugcaauugccggaagacaucgagcagauggcaaaugggauugcucugggauuaaugacucucaagcugaucacacaguucgaaaccuaccagcuuuggacagcccuggucuccuugacuuguucaaacaccauauuuacgcucacaguggccuggcgaaccgcuacucugauccuagccgguguuagucugcuuccucucugccaaagcucguccaugcggaagaccgauuggcugccaaugacaguggccgcgaugggcguacccccuuugccccuguucauauuuucuuuaaaagacacuccaaagcguagaagcuggccucucaaugaggggguaauggcugugggacugguuucaauccuugccaguucccuguugaggaacgaugugcccauggcaggcccacucgucgccggugggcugcuaauugcuuguuaugugaucaccggaacgucugcagaccugacaguagagaaagccgcggacgugaccugggaagaggaagcugagcagacuggcgucagccauaaccuuaugauaacaguugaugacgauggcaccaugcgcauuaaggacgaugaaacugagaauauccucacagugcuguugaaaaccgccuuacugaucguguccgggauuuucccguacucaauaccugcaacgcuccuggucuggcacacuuggcagaagcagacccaacggagcggagugcuuugggacguucccaguccacccgagacacagaaagccgaacuggaggaagguguauacagaaucaagcagcagggcauuuuugggaagacccaagugggagucggcgugcagaaagaggguguuuuccauacaauguggcacgugacuagaggggcugucuugacccacaacggaaagcgacuagagccuaauugggccucugugaaaaaggaucugaucuccuauggcggcggguggcgccucagcgcacaguggcaaaaaggagaagagguacaggucauugcuguggaaccagguaagaaccccaagaauuuccagacgaugccuggcaucuuucagacaacuaccggggagauaggagccaucgcgcuggacuucaaaccgggcacaucggguucaccaauuaucaaccgggaagggaagguugugggacuuuacggcaauggcgucgugaccaaaaacgggggauauguuucugguauugcccaaacuaaugcagagcccgauggcccuaccccagaguuagaagaggaaauguuuaagaaaagaaaccugacaaucauggaccuccaucccgggaguggaaagacgaggaaguacuugccugcuauagugcgugaggccauuaaacgccggcugagaacucucauccuggcuccgaccagggucguggcagccgaaauggaggaggcccuuaagggccugcccauccgauaucagacaaccgcuacuaaauccgaacacacaggucgggagauuguagauuugaugugccaugcgaccuucacgaugcgccuacugagcccagugagaguuccuaauuacaaccucaucauaauggacgaagcacacuuuacugaucccgccucuauugcugccaggggguauaucagcacacgggucggaaugggcgaggcagccgcuauuuucaugaccgcgaccccaccuggcacugccgaagcauuuccccaguccaaugcuccaauccaggacgaggagcgagacauaccggaaagaucauggaacagugggaaugaguggauuacagauuucgugggaaagaccgugugguuugucccuagcaucaaagccgguaacgacaucgcaaacuguuuacgcaagaauggcaagaaaguaauucaacugucuaggaagacauucgauacugaauaccagaaaacgcgucuuaacgacugggauuuugugguuaccacagacaucuccgagaugggggccaauuucaaggcugaucgggugauugaccccagaaggugccugaaaccagucauacucacugauggacccgagcgcgugaucuuggccggcccuaugccaguuaccgcggcaucagccgcucagcgaagaggucggguggggaggaacccccagaaggaaaaugaccaauacauuuucacaggccagccucugaacaaugaugaggaccaugcccacuggaccgaagcuaagaugcuccuggacaacaucaauacuccggagggaaucauuccagcacuuuuugaacccgagcgcgagaaaagugccgcuauagauggcgaauaucgucuaaagggggagagcagaaaaacguucgucgaacugaugcggaggggagacuugccugugugguuagcccacaagguagcauccgaggguaucaaauacaccgaucgcaaguggugcuuugacggcgaacgaaacaaucagauucuggaggagaacauggauguggaaaucuggacaaaagagggggaaagaaagaagcuccggcccagguggcuggacgcgcgcacuuauucugauccacuugcccugaaagaguucaaggacuuugcugccggaagaaaaucgauugcacucgauuugguuaccgaaaucggcagggucccuagccaucuggcuuaccggacacguaaugcccuagacaaccuggugaugcuccacaccucagagcauggugggcgcgcauaucgacacgccguggaggaacuucccgagacuauggaaacacuguuauugcugggccucaugauacugcuuacgggaggcgcuaugcuguuccucaucuccgggaagggaauugguaaaaccaguaucggcuugauuugugucaucguuucuagcgggaugcuguggauggcggaugugccauuacaguggauagccuccgcaauuauccuagaguuuuucaugaugguacugcucauuccugagccggaaaagcaaagaacuccccaggacaaucagcuugcuuacguggucaucggaauacugacauuggccgccaucguggcagcuaacgagaugggccugcucgaaaccaccaagagggaucuggguaugucaaaagagccagggguugugucuccuacaagcuaucuugacgucgaccuccaccccgccagugcguggacucuguacgcuguagccacgaccgugauuacaccaauguugcggcauacuaucgaaaauuccaccgcaaacguuagccuggccgcuauugcaaaccaagccguggucuuaaugggccuagauaagggauggccuaucucuaaaauggaccugggcgugccccuccuugcgcuggggugcuacucacaggucaauccguugacacugaccgcugccgugcuccugcuuguuacucacuaugcaauaauuggaccaggcuuacaggccaaggcuacgcgcgaggcccagaaaagaacagcagcugguaucaugaagaacccuaccguggaugggaucaugacuauugaccuggaucccguaaucuacgacuccaaguuugagaaacaacucggacaggugauguugcugguccuaugugccguucagcugcuccuuaugaggaccaguugggcgcugugcgaagccuugacacuggcaacuggcccaauaaccacacucugggaggguagccccggcaaguucuggaauacgaccauugcugugucgauggccaacaucuuucgggggucuuaucuggcaggagcuggcuuagccuucuccauuaugaaaagcgucgggacuggacgaagaggcacagguucacagggggaaacccuuggagagaaguggaaaaagaagcugaaucaacucagucgcaaagaauuugaucuauacaagaaaucuggcaucacugagguggacaggacagaggccaaggaaggucugaaacggggcgagaccacgcaucacgcgguaucccgugggagcgcuaaguugcagugguucguggaaagaaacaugguuauaccugagggaagggugaucgaucugggcugugggcgcggaggcuggucauauuacugcgcaggucucaaaaaggucaccgaagugcggggguauacaaagggaggcccgggccaugaggagcccgucccaaugaguacuuacggguggaaucuugugaaacugaugagcggaaaggacguuuucuacuugccucccgaaaaaugugauacccugcucugcgacauuggugaguccucuccuagcccaacaguagaagagucccgaacuaucagaguguuaaagauggucgagcccuggcugaaaaacaaucaguuuuguauuaaggugcuuaacccuuauaugccaaccguuaucgaacaccuggagaggcuacagcgcaaguacggcgggaugcucgugcggaauccccugucaagaaacucuacacacgaaauguauuggauuaguaauggaaccggcaacaucgucucgagcgugaauaugguaucccguuugcugcucaacagguucacuaugacgcaucggcgcccgacaauagagaaagauguggaccuuggugccgggacccgacacguuaacgcugaaccugagacuccaaauauggacgucauuggagagagaaucaagaggaucaaagaggaacacucuucaaccuggcacuacgaugacgaaaaccccuauaagacaugggccuaccacggcagcuaugaggugaaagcaacgggcuccgccaguucuaugauuaaugggguggucaagcuguuaaccaagccuugggauguugugccaaugguaacucaaauggcuaugacagacaccacucccuuuggacagcagcggguguucaaagaaaaggucgauacacgcaccccgagaccuaugcccgguacaaggaaagugauggagauaacugcggaguggcuguggcgaaccuugggccggaacaagaaaccacgucucugcacgagagaagaguuuaccaagaagguucgcacaaaugccgcaaugggggcuguguucacugaagagaaccaaugggacagcgccagggcagccgucgaagaugaggaguuuuggaaacugguggaccgggaaagagagcuacauaaacuuggaaaauguggcucaugcguauacaauaugauggguaagcgcgagaaaaagcugggggaguucggaaaagcuaagggcuccagggccaucugguacauguggcucggcgcgcgauaucuggaguuugaagcauugggguuccugaacgaggaucacugguuuagucgggaaaauagcuacucuggaguugagggugaaggccuccauaaacuuggguauauucugagagacaucuccaaaauuccuggaggcgccauguacgcugaugacaccgccgguugggacacaaggaucacugaggaugacuuacacaacgaggaaaagauaacccagcagauggaucccgagcaucgccagcuggcaaaugcuaucuucaaauugacguaucaaaacaagguggucaaagugcagcguccaacacccaaggggaccgugauggacauuaucucacggaaggaucagagaggaagcggccaggucggcacuuacgggcucaauacauuuaccaacauggaagcccaacugguuaggcagauggagggagaaggugugcuaucgaaagcugaccuugagaauccucaucugcucgagaagaaaauuacucaguggcuggaaaccaagggcguagagcgcuugaaacgaauggccaucucuggggaugacugcguggucaagccaauagaugaccgguucgcaaacgcguuacuggcccucaacgauaugggaaaggugagaaaagacauuccgcaguggcaacccaguaagggcuggcacgauuggcagcagguuccuuucuguucccaucacuuucaugaacuuaucaugaaagacgguaggaagcugguggucccaugccgcccccaggacgagcuaaucgggagagcucggauuagccaaggagccggcuggucacugaaagaaacagcaugucucggcaaggcuuaugcccagaugugguccuugauguacuuccacaggcgugaucugcgacuugcaucuaaugccauaugcagcgcggugccuguacacuggaucccaacgagucgcaccacuugguccauucaugcucaccaucaguggaugacaaccgaggacaugcugacuguuuggaacagaguguggaucgaggauaaucccuggauggaagacaagacaccugucaccacgugggaggaugugccguaccucgggaaacgggaagaccaaugguguggcagcuuaauuggucugacaucuagggccaccugggcacagaacaucuugacugccauacagcagguucgcucacugaucggcgaugaggaguuucucgacuauaugccaaguaugaagagauuccggaaagaagaggaauccgagggggcuauuugguga

SEQ ID NO: 15588 - RNA, 9873 nt, Artificial Sequence
  derived and/or modified CDS sequence (opt3) from DENV-3__FJ410229__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcgcacaguggcaaaaaggagaagagguacaggucauugcuguggaaccagguaagaaccccaagaauuuccagacgaugccuggcaucuuccagacaacuaccggggagauaggagccaucgcgcuugacuuuaaaccgggcacaucggguucaccaauuaucaaccgggaagggaagguugugggauuauacggcaauggcgucgugaccaaaaacgggggauauguuucugguauugcccaaacuaaugcagagcccgauggcccuaccccagagcuggaagaggaaauguucaagaaaagaaaccucacaaucauggacuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaucuaaugugccaugcgaccuuuacgaugcgccugcucagcccagugagaguuccuaauuacaacuuaaucauaauggacgaagcacacuucacugaucccgccucuauugcugccaggggguauaucagcacacgggucggaaugggcgaggcagccgcuauuuuuaugaccgcgaccccaccuggcacugccgaagcauucccccaguccaaugcuccaauccaggacgaggagcgagacauaccggaaagaucauggaacagugggaaugaguggauuacagauuuugugggaaagaccgugugguucgucccuagcaucaaagccgguaacgacaucgcaaacugucugcgcaagaauggcaagaaaguaauucaacuuucuaggaagacauuugauacugaauaccagaaaacgcgucugaacgacugggauuucgugguuaccacagacaucuccgagaugggggccaauuuuaaggcugaucgggugauugaccccagaaggugccucaaaccagucauauugacugauggacccgagcgcgugauccuggccggcccuaugccaguuaccgcggcaucagccgcucagcgaagaggucggguggggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuugucgaauugaugcggaggggagacuuaccuguguggcuggcccacaagguagcauccgaggguaucaaauacaccgaucgcaaguggugcuucgacggcgaacgaaacaaucagauucucgaggagaacauggauguggaaaucuggacaaaagagggggaaagaaagaagcugcggcccagguggcuugacgcgcgcacuuauucugauccacuggcccucaaagaguuuaaggacuucgcugccggaagaaaaucgauugcauuggaucugguuaccgaaaucggcagggucccuagccaucuagcuuaccggacacguaaugcccuggacaaccucgugaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggaugugccacuacaguggauagccuccgcaauuauccuggaguucuuuaugaugguacuccuuauuccugagccggaaaagcaaagaacuccccaggacaaucagcuggcuuacguggucaucggaauauugacacuggccgccaucguggcagcuaacgagaugggccuccuggaaaccaccaagagggaucuugguaugucaaaagagccagggguugugucuccuacaagcuaucucgacgucgaccugcaccccgccagugcguggacuuuguacgcuguagccacgaccgugauuacaccaaugcugcggcauacuaucgaaaauuccaccgcaaacguuagcuuagccgcuauugcaaaccaagccgugguccuaaugggccuggauaagggauggccuaucucuaaaauggaccucggcgugccccuucuggcguuggggugcuacucacaggucaauccgcugacacucaccgcugccgugcugcuuuuaguuacucacuaugcaauaauuggaccaggccugcaggccaaggcuacgcgcgaggcccagaaaagaacagcagcugguaucaugaagaacccuaccguggaugggaucaugacuauugaccucgaucccguaaucuacgacuccaaguucgagaaacaauugggacaggugaugcugcuaguccugugugccguucagcuccuucugaugaggaccaguugggcguugugcgaagcccugacacucgcaacuggcccaauaaccacacugugggaggguagccccggcaaguuuuggaauacgaccauugcugugucgauggccaacaucuuccgggggucuuauuuagcaggagcuggccuugccuuuuccauuaugaaaagcgucgggacuggacgaagaggcacagguucacagggggaaacccugggagagaaguggaaaaagaagcucaaucaacuaagucgcaaagaauucgaucuguacaagaaaucuggcaucacugagguggacaggacagaggccaaggaagguuugaaacggggcgagaccacgcaucacgcgguaucccgugggagcgcuaagcugcagugguuuguggaaagaaacaugguuauaccugagggaagggugaucgaucucggcugugggcgcggaggcuggucauauuacugcgcaggucuuaaaaaggucaccgaagugcggggguauacaaagggaggcccgggccaugaggagcccgucccaaugaguacuuacggguggaaucuggugaaauugaugagcggaaaggacguuuucuaccugccucccgaaaaaugugauacccucuuaugcgacauuggugaguccucuccuagcccaacaguagaagagucccgaacuaucagagugcugaagauggucgagcccuggcuuaaaaacaaucaguucuguauuaaggugcugaacccuuauaugccaaccguuaucgaacaccuagagaggcuccagcgcaaguacggcgggaugcuggugcggaaucccuugucaagaaacucuacacacgaaauguauuggauuaguaauggaaccggcaacaucgucucgagcgugaauaugguaucccgucugcuccuuaacagguuuacuaugacgcaucggcgcccgacaauagagaaagauguggaccugggugccgggacccgacacguuaacgcugaaccugagacuccaaauauggacgucauuggagagagaaucaagaggaucaaagaagagcauucuucaaccuggcacuacgaugacgaaaaccccuauaagacaugggccuaccacggcagcuaugaggugaaagcaacgggcuccgccaguucuaugauuaaugggguggucaaguuacugaccaagccuugggauguugugccaaugguaacucaaauggcuaugacagacaccacucccuucggacagcagcggguguuuaaagaaaaggucgauacacgcaccccgagaccuaugcccgguacaaggaaagugauggagauaacugcggagugguuguggcgaacccucggccggaacaagaaaccacgucugugcacgagagaagaguucaccaagaagguucgcacaaaugccgcaaugggggcuguguuuacugaagagaaccaaugggacagcgccagggcagccgucgaagaugaggaguucuggaaacuaguggaccgggaaagagagcuucauaagcugggaaaauguggcucaugcguauacaauaugauggguaagcgcgaaaaaaagcucggggaguuuggaaaagcuaagggcuccagggccaucugguacauguggcugggcgcgcgauauuuggaguucgaagcacugggguuucucaacgaggaucacugguucagucgggaaaauagcuacucuggaguugagggugaaggccuucauaagcugggguauauuuuaagagacaucuccaaaauuccuggaggcgccauguacgcugaugacaccgccgguugggacacaaggaucacugaggaugaccugcacaacgaggaaaagauaacccagcagauggaucccgagcaucgccaguuggcaaaugcuaucuuuaaacucacguaucaaaacaagguggucaaagugcagcguccaacacccaaggggaccgugauggacauuaucucacggaaggaucagagaggaagcggccaggucggcacuuacgggcugaauacauucaccaacauggaagcccaacuaguuaggcagauggagggagaaggugugcuuucgaaagcugaccuggagaauccucaccuccuggagaagaaaauuacucagugguuggaaaccaagggcguagagcgcuuaaaacgaauggccaucucuggggaugacugcguggucaagccaauagaugaccgguuugcaaacgcgcugcucgcccuuaacgauaugggaaaggugagaaaagacauuccgcaguggcaacccaguaagggcuggcacgauuggcagcagguuccuuucuguucccaucacuuccaugaacugaucaugaaagacgguaggaagcuaguggucccaugccgcccccaggacgagcugaucgggagagcucggauuagccaaggagccggcuggucacucaaagaaacagcauguuugggcaaggcuuaugcccagauguggucccugauguacuuucacaggcgugaucuucgacuggcaucuaaugccauaugcagcgcggugccuguacacuggaucccaacgagucgcaccacuugguccauucaugcucaccaucaguggaugacaaccgaggacaugcucacuguuuggaacagaguguggaucgaggauaaucccuggauggaagacaagacaccugucaccacgugggaggaugugccguacuuagggaaacgggaagaccaaugguguggaagccugauugguuugacaucuagggccaccugggcacagaacauccugacugccauacagcagguucgcucacucaucggcgaugaggaguuccuugacuauaugccaaguaugaagagauuucggaaagaagaggaauccgagggggcuauuugguga

SEQ ID NO: 15589 - RNA, 9873 nt, Artificial Sequence
  derived and/or modified CDS sequence (opt3) from DENV-3__FJ461326__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuucuacaucguuaacucagaagguugugaucuucauacugcuuauguuggucaccccaucaaugacaaugcgcugugugggcguaggcaacagagacuuuguugaagggcugagcggagccaccuggguggaugucgugcuagagcaugguggcugcgugacgacuauggcgaggaauaagcccacacucgacaucgagcugcagaaaaccgaagcaacucaacuugccacacugcggaaguuguguauugaggggaaaaucaccaacauuacgaccgauagucgcugcccuacacagggagaagcuauccucccagaggaacaggaccagaauuaugucuguaagcacacuuacguugaucgaggcugggguaacgggugcggacuguucggcaaaggcuccuuagugaccugcgccaaguuucaaugucuggagcccauagaggggaagguagugcaguaugaaaaucucaaauacacagucauuaucacugugcacaccggagaccagcaucagguugguaacgacacacaaggcgugaccgucgagauuacuccucaggcaucuacgguggaagcuguacuuccagaguaugggacacugggauuggaaugcagcccgagaaccggccuagauuucaaugagaugauccugcucacuaugaagaacaaagccuggaugguucacaggcagugguuuuucgaccugccccuuccuuggaccuccggugcgacaaccgagacuccaacauggaaucggaaggaacuguuggugacguuuaaaaacgcccaugcaaagaaacaagaggucgugguccucgggucacaggaaggcgcuaugcacaccgcccugacuggagcuacagagauccagaauaguggcgggaccagcauuuucgccggacacuuaaagugucgucugaagauggauaaacuagaacucaaggguaugucuuacgcaaugugccugaacacauuugugcuuaaaaaggagguuuccgagacucagcauggcaccauauugaucaaaguggaauacaagggggaggacgcccccuguaagauuccuuucucaacggaagauggacaaggcaaagcucacaacggucgccugaucaccgcgaauccaguagucacaaagaaagaggagcccgugaacauagaagcagagccgccuuucggggaaagcaauauuguuaucggcaucggagacaaggcccucaaaauuaacugguauaagaagggcaguucuaucgggaaaauguuugaggcuacugccagaggagcaaggcggauggccauucugggugauaccgcuugggacuucggcuccguggggggaguccuuaauagccugggcaagauggugcaucagauauuugguucggccuacacagcauuguucucugggguauccuggaucaugaaaauuggcaucggagugcuccugacuuggaucggcuuaaacucaaagaauaccaguaugagcuuuuccugcauuguuauagggaucauuacgcuguaucuaggagcggucgugcaggcugauaugggcugugccaucaacuggaaagguaaggaacucaagugcgggucuggaauuuucgugacaaaugagguccacaccuggacugagcaguacaaauuucaagcagacagccccaagcgacuggccacagcuaucgccggcgcaugggaaaacgguguuuguggcauacgcucaaccacuagaauggagaaucuuuuguggaaacagaucgcuaacgaacugaauuauauucucugggagaacaauaucaagcugaccguggugguaggggauauuaucggagucuuagaacagggcaaaaggacacugacgccacagccuauggagcuuaaguacaguuggaaaaccugggggaaggccaagauagugacugcggagacacaaaacuccagcuucauuaucgacggacccaacaccccagaaugccccucugccucacgggcuuggaauguuugggagguggaagacuauggcuuuggugucuucacaacuaacauuugguugaaacuccgcgagguguacacccagaguugugaucauagacugaugagcgcagccaucaaggacgaaagggcuguucacgccgauaugggguacuggauagagucccagaaaaauggaucuuggaagcuagagaaagcaucguuuaucgaagugaagacgugcacauggccuaagagccacacccugugguccaacggcguacucgagucagacaugauuaucccaaaaagucuggcggguccgauuucucagcauaaucaccgucccggcuaucauacucaaaccgccgggccuuggcaccuuggaaaguuggaacuggauuucaacuacugcgagggcacaacugucgugaucaccgagaauugugggacacggggaccaagcuuacgaacgaccacuguguccggcaaacucauacacgaauggugcuguagaucaugcacacugcccccucuuagguauaugggugaggacggguguugguacggaauggaaauucgcccaaucaacgagaaggaagagaauauggucaaaagccugguuucugcuggcuccgguaagguggauaacuuuaccaugggcguauugugccucgccauccuguucgaggaagugaugcgggggaaguucggaaaaaagcauaugauugcaggcguccuauuuacuuucgugcugcuccugagugggcagaucacauggagagacauggcucacacccuuauuaugauaggaagcaaugccucugauaggaugggcauggguguuacguauuuggcacugaucgccacuuuuaaaauucagcccuucuuagcucucggguuuuuccugcgcaagcuuaccucccgagagaaccugcuacucggagugggccuggcgauggccacaaccuugcaacugccggaagacaucgagcagauggcaaauggcauugcuuuagggcucaugacucugaaacuuaucacacaguuugaaaccuaccagcuguggacagccuuggucucacucacuuguaguaacaccauauucacgcugacaguggccuggcggaccgcuacucuaauccuggcaggaguuagccuucucccucugugccaaucguccucuaugcguaagaccgauugguugccaaugacaguggccgcgauggguguccccccucugcccuuauuuauuuucagccucaaggacacuccaaaaagaaggucauggccucugaaugagggcguaauggcuguggggcuuguuaguauccuggccuccucuuugcuccgcaacgaugugcccauggcaggaccacuggucgccggcggucuacugauugcuuguuaugugaucaccgggacgagcgcagaccuuacaguagagaaggccgcggacgugaccugggaagaggaagcugagcagacuggagucucccauaaccucaugauaacaguugaugacgauggcaccaugcggauuaaagacgaugaaacugagaauauccugacaguguuguuaaagaccgcccugcucaucgugucaggcauuuuuccguacagcauaccugcaacgcugcuugucuggcacacuuggcagaaacagacccaaagaaguggggugcugugggacguucccucuccacccgagacacagaaggccgaauuggaggaaggaguauacaggaucaaacagcaggguauuuucggcaagacccaagugggggucggagugcagaaggagggcguuuuucauacaauguggcacgugacucgaggugcuguccuaacccacaacgggaaacgccuggagccuaauugggccuccgugaagaaagaucucaucagcuauggaggcggcuggcggcugucggcacaguggcaaaagggggaagagguacaggucauugcuguggaaccaggaaaaaaccccaagaauuuccagacgaugccugguaucuuccagacaacuaccggcgagauaggggccaucgcgcuugacuuuaagccgggaacaucaggcucuccaauuaucaacagagaagguaaaguugugggguuauacggaaauggcgucgugaccaagaacggcggguauguuaguggaauugcccaaacuaaugcagagcccgaugguccuaccccagagcuggaagaggaaauguucaaaaagaggaaccucacaaucauggacuugcaucccggcuccgggaaaacgcguaaguaccugccugcuauagugcgcgaggccauuaagcggagacucaggacucugauccuugcuccgacccgagucguggcagccgaaauggaggaggcccugaaaggauugcccauccgguaucagacaaccgcuacuaagagcgaacacacaggccgcgagauuguagaucuaaugugccaugcgaccuuuacgaugagacugcucucuccagugaggguuccuaauuacaacuuaaucauaauggacgaagcacacuucacugaucccgccagcauugcugcccgggguuauaucuccacacgagucgggaugggagaggcagccgcuauuuuuaugaccgcgaccccaccuggcacugccgaagcauucccccagucaaaugcuccaauccaggacgaggagagagacauaccggaacgcaguuggaacagcggcaaugaguggauuacagauuuuguggggaaaaccgugugguucgucccuucuaucaaggccggaaacgacaucgcaaacugucugaggaaaaaugguaagaagguaauucaacuuucccguaaaacauuugauacugaauaccagaagacgcggcugaacgacugggauuucgugguuaccacagacaucucagagaugggcgccaauuuuaaagcugauagagugauugaccccaggcgcugccucaagccagucauauugacugaugggcccgagcgagugauccuggccggaccuaugccaguuaccgcggcaagugccgcucagagacggggcagggugggucgcaacccccagaaagaaaaugaccaauacauuuucacagggcagccucucaacaaugaugaggaccaugcccacuggaccgaagcuaagaugcugcuugacaacaucaauacuccggagggcaucauuccagcacuauucgaacccgagcgugagaagagcgccgcuauagauggagaauauagacugaaaggcgagucccggaagacguuugucgaauugaugaggcgcggggacuuaccuguguggcuggcccacaaaguagcaucugagggaaucaaguacaccgaucgaaaauggugcuucgacggugaaagaaacaaucagauucucgaggagaacauggauguggaaaucuggacaaaggagggcgaacggaaaaagcugaggccccgcuggcuugacgcgagaacuuauucggauccacuggcccucaaggaguuuaaagacuucgcugccgggaggaagagcauugcauuggaucugguuaccgaaaucggacgggucccuucacaucuagcuuaccguacacgcaaugcccuggacaaccucgugaugcuucacaccuccgagcauggcggucgagcauauagacacgccguggaggaacugcccgagacuauggaaacauuauugcugcucgggcugaugauacuucugacgggcggagcuaugcucuuuuugaucaguggcaaagggauuggaaagaccucuaucggucugauuugugucaucgcgagcuccggcauguuauggauggccgauguuccacuacaguggauagcaucagcuauuauccuggaguucuuuaugauggugcuccuuauuccugagccggaaaaacaaaggacuccccaggacaaucagcuggccuacguagugaucgggauauugacacuggccgcaaucgucgcugccaacgagaugggacuccuggaaaccaccaagcgggaucuuggcaugucuaaggagccaggugugguuagcccuacaaguuaucucgacguggaccugcaccccgcguccgcuuggacuuuguacgccgucgcaacgaccguaauuacaccaaugcugcgccauacuaucgaaaauagcaccgccaacgugucuuuagcugcaauugccaaccaagcgguugugcuaauggggcuggauaaaggcuggccuaucucaaagauggaccucggagucccccuucuggcuuugggcugcuacucccaggugaauccgcugacacucaccgccgcaguccugcuuuuagugacucacuaugccauaauugggccaggacugcaggcuaaagccacgagagaggcacagaagaggacagcugccggcaucaugaaaaacccuaccguugaugguaucaugacuauugaccucgaucccgugaucuacgacaguaaguucgagaagcaauuggggcagguaaugcugcuagugcugugugcgguccagcuccuucugaugcggaccagcugggccuugugcgaagcacugacacucgcuacuggaccaauaaccacacugugggagggcucgcccgguaaauuuuggaauacgaccauugccguuucuauggcaaacaucuuccgaggcuccuauuuagcuggggccggacuugccuuuagcauuaugaagucagugggcacugggagacgcggaacaggcagucagggugaaacccugggggagaaauggaagaaaaagcucaaucaacuaucuaggaaggaauucgaucuguacaaaaaguccggaaucacugaggucgaccggacagaggcgaaagaaggcuugaagcguggugagaccacgcaucacgcugugagcagaggcucagcaaaacugcagugguuuguagaaaggaacauggugauaccugaggggcgcguuaucgaucucggauguggccgggggggauggaguuauuacugcgccggccuuaagaaagugaccgaaguccgagguuauacaaaggggggaccgggccaugaggagcccgugccaaugagcacuuacggcuggaaucuggucaaguugauguccgggaaagacguguucuaccugccucccgaaaagugugauacccucuuaugcgacauuggagagucuagcccuuccccaacaguugaagagucaagaacuaucaggguacugaaaaugguggagcccuggcuuaagaacaaucaguucuguauuaaaguccugaacccuuauaugccaaccgugaucgaacaccuagagcgccuccagcggaaguacgguggcaugcugguuagaaaucccuugucucguaacaguacacacgaaauguauuggauuucgaaugggaccggaaacaucgugagcuccgucaauauggugucuaggcugcuccuuaaccgguuuacuaugacgcaucgccgaccgacaauagagaaggauguagaccugggcgcugguaccagacacgugaacgccgaaccugagacuccaaauauggacguuauuggggagaggaucaaacggaucaaggaagagcauucaagcaccuggcacuacgaugacgaaaaccccuauaaaacaugggcauaccacggauccuaugaggucaaggccacgggcagugcuucuagcaugauuaauggcguggugaaauuacugaccaagccuugggaugucguuccaauggugacucaaauggcgaugacagacaccacucccuucgggcagcagcgcguauuuaaggaaaaaguggauacaagaaccccgaggccuaugcccggaacacgaaaggucauggagauaacugccgagugguuguggcggacccucggucguaacaaaaagccaagacugugcacgcgcgaagaguucaccaaaaaggugaggacaaaugcagcuaugggcgccguuuuuacugaagagaaccaaugggacucagcacgggccgcuguggaagaugaggaguucuggaagcuagucgacagagaacgcgagcuucauaaacuggggaaguguggauccugcguguacaauaugaugggcaaaagggaaaagaaacucggugaguuugggaaggccaaaggaagucgagcgaucugguacauguggcugggcgcacgguauuuggaguucgaagcccugggcuuucucaacgaggaucacugguucagcagagaaaauucuuacuccgggguagagggagaaggucuucauaagcugggcuauauuuuaagggacaucucaaagauuccugggggagcuauguacgccgaugacaccgcaggcugggacacacgcaucacugaggaugaccugcacaacgaggaaaaaauaacccagcagauggaucccgagcaucguaaguuggcuaaugccaucuuuaaacucacguaucagaacaagguugugaaaguccaacggccaacacccaaggguaccgugauggacauuaucagcagaaaggaucagagggggucgggacaggugggcacuuacggccugaauacauucaccaacauggaagcucagcuaguccgccaaauggagggggaaggaguucuuucuaaagccgaccuggagaauccucaccuccuggagaagaaaauuacucagugguuggaaaccaaggguguggagcgauuaaaacggauggcaaucaguggcgaugacugcguagugaagccaauagaugacagauuugcgaacgcccugcucgcucuuaacgauauggggaaggucaggaaagacauuccgcaguggcagcccuccaagggauggcacgauuggcaacaggugccuuucuguagccaucacuuccaugaacugaucaugaaagacggccgcaagcuaguugugccaugcagaccccaggacgagcugaucggucgggccaggauuucacagggggcaggauggucccucaaagaaacagcuuguuugggcaaggccuaugcacaaauguggucucugauguacuuucaccgucgagaucuucgccuggccagcaaugcgauaugcagugcugucccugugcacuggaucccaacguccagaaccacuuggagcauucaugcccaccaucaguggaugacaaccgaggacaugcucacuguauggaaccggguuuggaucgaggauaaucccuggauggaagacaagacaccugugaccacgugggaggaugucccguacuuaggcaaaagggaagaccaguggugugggucucugauuggauugacaucacgcgcaaccugggcccaaaacauccugacugcuauacagcaggugagaagucucaucggugaugaggaguuccuugacuauaugccauccaugaagcgguuuaggaaagaagaggaaagcgagggcgccauuugguga

SEQ ID NO: 15590 - RNA, 9873 nt, Artificial Sequence
  derived and/or modified CDS sequence (opt3) from DENV-3__FJ461329__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgaggacuguggaacacguggcccaucuuuacggacgaccacugugagcgguaagcucauacacgaauggugcugucgauccugcacacugcccccucuuagauauaugggggaggauggauguugguacggcauggaaauuaggccaaucaaugagaaagaagagaacauggucaagucacugguuagcgcugguucuggcaagguggacaauuuuaccauggggguauugugccucgccauccuguucgaggaagugaugcgcggaaaauucggcaagaaacauaugauugcagggguccuauuuacuuucgugcugcuccuguccggacagaucacauggcgggauauggcucacacccuuauuaugauaggcaguaacgccagcgacagaauggguauggggguuacguauuuggcacugaucgccacuuuuaagauucagcccuucuuagcucucggauuuuuccugaggaaacuuaccucucgcgagaaucugcuacucggcgugggccuggcgauggccacaaccuugcaacugccggaagauaucgagcagauggcaaacgggauugcuuuaggacucaugacucugaagcuuaucacacaguuugaaaccuaccagcuguggacagccuuggucucccucacuuguucaaauaccauauucacgcugacaguggccuggcgaaccgcuacucuaauccuggcagguguuagucuucucccucugugccaaagcucguccaugcggaagaccgacugguugccaaugacaguggccgcgaugggcguccccccucugcccuuauuuauuuucucucucaaagauacuccaaagcguagaagcuggccucugaacgaggggguaauggcugugggacuuguuucaauccuggccaguuccuugcucaggaaugacgugcccauggcaggcccacuggucgccggugggcuacugauugcuuguuaugugaucaccggaacgucugcagaccuuacaguagagaaagccgcggaugugaccugggaagaggaagcugagcagacuggcgucagccauaaccucaugauaacaguugacgaugacggcaccaugcgcauuaaggaugacgaaacugagaacauccugacaguguuguuaaaaaccgcccugcucaucguguccgggauuuuuccguacucaauaccugcaacgcugcuugucuggcacacuuggcagaagcagacccaacggagcggagugcugugggauguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaauggaaagcgacuggagccuaacugggccucugugaaaaaggaccucaucuccuauggcggcggguggcgccugagcgcacaguggcaaaaaggagaagagguacaggucauugcuguggaaccagguaagaaucccaagaacuuccagacgaugccuggcaucuuccagacaacuaccggggagauaggagccaucgcgcuugauuuuaaaccgggcacaucggguucaccaauuaucaaucgggaagggaagguugugggauuauacggcaacggcgucgugaccaaaaaugggggauauguuucugguauugcccaaacuaacgcagagcccgacggcccuaccccagagcuggaagaggaaauguucaagaaaagaaaucucacaaucauggauuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaccuaaugugccaugcgaccuuuacgaugcgccugcucagcccagugagaguuccuaacuacaauuuaaucauaauggaugaagcacacuucacugaccccgccucuauugcugccaggggguauaucagcacacgggucggaaugggcgaggcagccgcuauuuuuaugaccgcgaccccaccuggcacugccgaagcauucccccaguccaacgcuccaauccaggacgaggagcgagauauaccggaaagaucauggaauagugggaacgaguggauuacagacuuugugggaaagaccgugugguucgucccuagcaucaaagccgguaaugauaucgcaaacugucugcgcaagaacggcaagaaaguaauucaacuuucuaggaagacauuugacacugaauaccagaaaacgcgucugaaugauugggacuucgugguuaccacagauaucuccgagaugggggccaacuuuaaggcugaccgggugauugaucccagaaggugccucaaaccagucauauugacugacggacccgagcgcgugauccuggccggcccuaugccaguuaccgcggcaucagccgcucagcgaagaggucggguggggaggaauccccagaaggaaaacgaucaauacauuuucacaggccagccucucaauaacgacgaggaccaugcccacuggaccgaagcuaagaugcugcuugauaauaucaacacuccggagggaaucauuccagcacuauucgaacccgagcgcgagaaaagugccgcuauagacggcgaauaucgucugaagggggagagcagaaaaacguuugucgaauugaugcggaggggagauuuaccuguguggcuggcccacaagguagcauccgaggguaucaaauacaccgaccgcaaguggugcuucgauggcgaacgaaauaaccagauucucgaggagaauauggacguggaaaucuggacaaaagagggggaaagaaagaagcugcggcccagguggcuugaugcgcgcacuuauucugacccacuggcccucaaagaguuuaaggauuucgcugccggaagaaaaucgauugcauuggaccugguuaccgaaaucggcagggucccuagccaucuagcuuaccggacacguaacgcccuggauaaucucgugaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugucaucguuucuagcgggauguuauggauggcggacauaccacuacaguggauugccuccgcaaucgugcuggaguucuuuaugaugguacuccuuauuccugagccggaaaagcaaagaacuccccaggauaaccagcuggcuuacguggucaucggaauauugacacuggccgccaucguggcagcuaaugagaugggccuccuggaaaccaccaagagggaccuugguaugucaaaagagccagggguugugucuccuacaagcuaucucgacgucgaucugcaccccgccagugcguggacuuuguacgcuguagccacgaccgugauuacaccaaugcugcggcauacuaucgaaaacuccaccgcaaauguuagcuuagccgcuauugcaaaccaagccgugguccuaaugggccuggacaagggauggccuaucucuaaaauggaucucggcgugccccuucuggcguuggggugcuacucacaggucaacccgcugacacucaccgcugccgugcugcuuuuaguuacucacuaugcaauaauuggaccaggccugcaggccaaggcuacgcgcgaggcccagaaaagaacagcagcugguaucaugaagaauccuaccguggacgggaucaugacuauugaucucgaccccguaaucuacgauuccaaguucgagaaacaauugggacaggugaugcugcuaguccugugugccguucagcuccuucugaugaggaccaguugggcguugugcgaagcccugacacucgcaacuggcccaauaaccacacugugggaggguagccccggcaaguuuuggaacacgaccauugcugugucgauggccaauaucuuccgggggucuuauuuagcaggagcuggccuugccuuuuccauuaugaaaagcgucgggacuggacgaagaggcacagguucacagggggaaacccugggagagaaguggaaaaagaagcucaaccaacuaagucgcaaagaauucgaccuguacaagaaaucuggcaucacugagguggauaggacagaggccaaggaagguuugaaacggggcgagaccacgcaucacgcgguaucccgugggagcgcuaagcugcagugguuuguggaaagaaauaugguuauaccugagggaagggugaucgaccucggcugugggcgcggaggcuggucauauuacugcgcaggucuuaaaaaggucaccgaagugcggggguauacaaagggaggcccgggccaugaggagcccgucccaaugaguacuuacggguggaaccuggugaaauugaugagcggaaaggauguuuucuaccugccucccgaaaaaugugacacccucuuaugcgauauuggugaguccucuccuagcccaacaguagaagagucccgaacuaucagagugcugaagauggucgagcccuggcuuaaaaauaaccaguucuguauuaaggugcugaauccuuauaugccaaccguuaucgaacaccuagagaggcuccagcgcaaguacggcgggaugcuggugcggaaccccuugucaagaaauucuacacacgaaauguauuggauuaguaacggaaccggcaauaucgucucgagcgugaacaugguaucccgucugcuccuuaauagguuuacuaugacgcaucggcgcccgacaauagagaaagacguggaccugggugccgggacccgacacguuaacgcugaaccugagacuccaaacauggaugucauuggagagagaaucaagaggaucaaagaagagcauucuucaaccuggcacuacgacgaugaaaaucccuauaagacaugggccuaccacggcagcuaugaggugaaagcaacgggcuccgccaguucuaugauuaacgggguggucaaguuacugaccaagccuugggacguugugccaaugguaacucaaauggcuaugacagauaccacucccuucggacagcagcggguguuuaaagaaaaggucgacacacgcaccccgagaccuaugcccgguacaaggaaagugauggagauaacugcggagugguuguggcgaacccucggccggaauaagaaaccacgucugugcacgagagaagaguucaccaagaagguucgcacaaacgccgcaaugggggcuguguuuacugaagagaaucaaugggauagcgccagggcagccgucgaagacgaggaguucuggaaacuaguggaucgggaaagagagcuucauaagcugggaaaauguggcucaugcguauacaacaugauggguaagcgcgaaaaaaagcucggggaguuuggaaaagcuaagggcuccagggccaucugguacauguggcugggcgcgcgauauuuggaguucgaagcacugggguuucucaaugaggaccacugguucagucgggaaaacagcuacucuggaguugagggugaaggccuucauaagcugggguauauuuuaagagauaucuccaaaauuccuggaggcgccauguacgcugacgacaccgccgguugggauacaaggaucacugaggacgaucugcacaaugaggaaaagauaacccagcagauggaccccgagcaucgccaguuggcaaacgcuaucuuuaaacucacguaucaaaauaagguggucaaagugcagcguccaacacccaaggggaccgugauggauauuaucucacggaaggaccagagaggaagcggccaggucggcacuuacgggcugaacacauucaccaauauggaagcccaacuaguuaggcagauggagggagaaggugugcuuucgaaagcugaucuggagaacccucaccuccuggagaagaaaauuacucagugguuggaaaccaagggcguagagcgcuuaaaacgaauggccaucucuggggacgauugcguggucaagccaauagacgaucgguuugcaaaugcgcugcucgcccuuaacgacaugggaaaggugagaaaagauauuccgcaguggcaacccaguaagggcuggcacgacuggcagcagguuccuuucuguucccaucacuuccaugaacugaucaugaaagacgguaggaagcuaguggucccaugccgcccccaggaugagcugaucgggagagcucggauuagccaaggagccggcuggucacucaaagaaacagcauguuugggcaaggcuuaugcccagauguggucccugauguacuuucacaggcgugaccuucgacuggcaucuaacgccauaugcagcgcggugccuguacacuggaucccaacgagucgcaccacuugguccauucaugcucaccaucaguggaugacaaccgaggauaugcucacuguuuggaauagaguguggaucgaggacaaccccuggauggaagauaagacaccugucaccacgugggaggacgugccguacuuagggaaacgggaagaucaaugguguggaagccugauugguuugacaucuagggccaccugggcacagaauauccugacugccauacagcagguucgcucacucaucggcaacgaggaguuccuugacuauaugccaaguaugaagagauuucggaaagaagaggaauccgagggggcuauuugguga

SEQ ID NO: 15591 - RNA, 9873 nt, Artificial Sequence
  derived and/or modified CDS sequence (opt3) from DENV-3__KF955459__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcgcuacccgcauggagaaucuuuuguggaagcagaucgccaacgaacugaauuauauucucugggagaacaauaucaaacugacuguggugguaggagauauuaucggcgucuuagaacaggggaagagaacccugacaccacagccuauggagcuuaaauacucauggaagacguggggaaaggcgaaaauagugaccgccgagacucaaaacaguuccuucauuaucgacggccccaacacaccagaaugccccagcgcuucuagggcauggaauguuugggagguggaagacuaugguuuuggggucuucaccacaaacauuugguugaagcuccgggagguguacacucagucaugugaucaucgccugaugagugccgcuaucaaagacgaaagagccguucacgcagauaugggauacuggauagagagccagaagaauggcuccuggaaacuagagaaggcgucuuuuaucgaagugaagaccugcacguggccuaaaucgcacacacuguggagcaacgguguacucgaguccgacaugauuaucccaaagucacuggccggcccgauuagucagcauaaucacaggcccggguaucauacccaaacugcuggaccuuggcaccuuggcaaauuggaacuggauuucaacuacugcgaggggaccacagucgugaucacugagaauuguggaacccguggcccaucuuuacggacaacgaccgugagcgguaagcucauacacgaauggugcugucgauccugcacucugcccccucuuagauauaugggggaggacggauguugguacggcauggaaauuaggccaaucaacgagaaagaagagaauauggucaagucacugguuagcgccgguucuggcaagguggauaacuuuacaauggggguauugugccucgcaauccuguucgaggaagugaugcgcggaaaauucggcaagaaacauaugauugcugggguccuauuuaccuucgugcugcuccuguccggacagaucacuuggcgggacauggcccacacacuuauuaugauaggcaguaaugcaagcgauagaauggguauggggguuaccuauuuggcccugaucgcuacguuuaagauucagcccuucuuagcgcucggauuuuuccugaggaaacuuacuucucgcgagaaccugcuacucggcgugggccuggccauggcaaccacauugcaacugccggaagacaucgagcagauggcuaaugggauugccuuaggacucaugacccugaagcuuaucacucaguuugaaacauaccagcuguggaccgccuuggucucccucacauguucaaacacuauauucacccugacgguggcuuggcgaacagcaacccuaauccuggccgguguuagucuucucccucugugccaaagcucguccaugcggaagacugauugguugccaaugaccguggcggcuaugggcguccccccucugcccuuauuuauuuucucucucaaagacacaccaaagcguagaagcuggccucugaaugaggggguaauggccgugggacuuguuucaauccuggcaaguuccuugcucaggaacgaugugcccauggccggcccacuggucgcuggugggcuacugauugcauguuaugugaucacuggaaccucugccgaccuuacgguagagaaagcggcugacgugacaugggaagaggaagccgagcagaccggcgucagccauaaccucaugauaacuguugaugacgauggcacaaugcgcauuaaggacgaugaaaccgagaauauccugacuguguuguuaaaaacagcacugcucaucguguccgggauuuuuccguacucaauaccugccacccugcuugucuggcacacguggcagaagcagacucaacggagcggagugcugugggacguucccaguccacccgagacccagaaagcugaauuggaggaagguguauacagaaucaagcagcagggcauuuucgggaagacacaagugggagucggcgugcagaaagaggguguuuuucauaccauguggcacgugacaaggggggccguccuaacucacaacggaaagcgacuggagccuaauugggcaucugugaaaaaggaucucaucuccuauggcggcggguggcgccugagcgcucaguggcaaaaaggagaagagguacaggucauugccguggaaccagguaagaaccccaagaauuuccagaccaugccuggcaucuuccagacgacaacuggggagauaggagcgaucgcccuugacuuuaaaccgggcaccucggguucaccaauuaucaaccgggaagggaagguugugggauuauacggcaauggcgucgugacaaaaaacgggggauauguuucugguauugcacaaaccaaugcugagcccgauggcccuacuccagagcuggaagaggaaauguucaagaaaagaaaccucaccaucauggacuugcaucccgggaguggaaagacaaggaaguaccugccugccauagugcgugaggcuauuaaacgccggcucagaacgcugauccuugcaccgacuagggucguggccgccgaaauggaggaggcucugaagggcuugcccauccgauaucagaccacagcgaccaaauccgaacacacuggucgggagauuguagaucuaaugugccaugcaacauuuaccaugcgccugcucagcccagugagaguuccuaauuacaacuuaaucauaauggacgaagcccacuucacggaucccgcuucuauugccgcaaggggguauaucagcacucgggucggaaugggcgaggccgcugcgauuuuuaugacagccaccccaccuggcaccgcagaagcuuucccccaguccaaugccccaauccaggacgaggagcgagacauaccggaaagaucauggaacagugggaaugaguggauuacugauuuugugggaaagacagugugguucgucccuagcaucaaagcagguaacgacaucgccaacugucugcgcaagaauggcaagaaaguaauucaacuuucuaggaagaccuuugauacagaauaccagaaaacucgucugaacgacugggauuucgugguuacgaccgacaucuccgagaugggggcuaauuuuaaggccgaucgggugauugaccccagaaggugccucaaaccagucauauugacagauggacccgagcgcgugauccuggcgggcccuaugccaguuacugcagccucagcugcccagcgaagaggucggguggggaggaacccccagaaggaaaaugaccaauacauuuucaccggccagccucucaacaaugaugaggaccaugcucacuggacagaagcaaagaugcugcuugacaacaucaauaccccggagggaaucauuccagcccuauucgaacccgagcgcgagaaaagugcugccauagauggcgaauaucgucugaagggggagagcagaaaaacuuuugucgaauugaugcggaggggagacuuaccuguguggcuggcacacaagguagcguccgaggguaucaaauacacggaucgcaaguggugcuucgacggcgaacgaaacaaucagauucucgaggagaacauggauguggaaaucuggaccaaagagggggaaagaaagaagcugcggcccagguggcuugacgcccgcacauauucugauccacuggcucucaaagaguuuaaggacuucgccgcaggaagaaaaucgauugcuuuggaucugguuacugaaaucggcagggucccuagccaucuagccuaccggacccguaaugcacuggacaaccucgugaugcuucacacaucagagcauggugggcgcgccuaucgacacgcuguggaggaacugcccgagaccauggaaacuuuauugcugcucggccugaugauacuucugacaggaggcgcgaugcucuuuuugaucuccgggaagggaauugguaaaacgaguaucggccugauuugugucaucguuucuagcgggauguuauggauggccgaugugccacuacaguggauagcauccgcuauuauccuggaguucuuuaugaugguacuccuuauuccugagccggaaaagcaaagaaccccccaggacaaucagcuggccuacguggucaucggaauauugacucuggccgcaaucguggcugccaacgagaugggccuccuggaaacaaccaagagggaucuugguaugucaaaagagccagggguugugucuccuaccagcuaucucgacgucgaccugcaccccgcgagugcuuggacauuguacgccguagcaacuacggugauuaccccaaugcugcggcauacaaucgaaaauuccacugccaacguuagcuuagcugcaauugccaaccaagcggugguccuaaugggccuggauaagggauggccuaucucuaaaauggaccucggcgugccccuucuggcuuuggggugcuacucacaggucaauccgcugacccucacagccgcagugcugcuuuuaguuacccacuaugccauaauuggaccaggccugcaggcuaaggccacucgcgaggcacagaaaagaacggcugccgguaucaugaagaacccuacaguggaugggaucaugaccauugaccucgaucccguaaucuacgacuccaaguucgagaaacaauugggacaggugaugcugcuaguccugugugcgguucagcuccuucugaugaggacuaguugggccuugugcgaagcacugacccucgcuacaggcccaauaacuacccugugggaggguagccccggcaaguuuuggaauacaacgauugccgugucgauggcaaacaucuuccgggggucuuauuuagcuggagccggccuugccuuuuccauuaugaaaagcgucgggaccggacgaagaggcacugguucacagggggaaacacugggagagaaguggaaaaagaagcucaaucaacuaagucgcaaagaauucgaucuguacaagaaaucuggcaucaccgagguggacaggacugaggcgaaggaagguuugaaacggggcgagacaacccaucacgcuguaucccgugggagcgcaaagcugcagugguuuguggaaagaaacaugguuauaccugagggaagggugaucgaucucggcugugggcgcggaggcuggucauauuacugcgccggucuuaaaaaggucacggaagugcggggguauaccaagggaggcccgggccaugaggagcccgucccaaugaguacauacggguggaaucuggugaaauugaugagcggaaaggacguuuucuaccugccucccgaaaaaugugauacucucuuaugcgacauuggugaguccucuccuagcccaaccguagaagagucccgaacaaucagagugcugaagauggucgagcccuggcuuaaaaacaaucaguucuguauuaaggugcugaacccuuauaugccaacuguuaucgaacaccuagagaggcuccagcgcaaguacggcgggaugcuggugcggaaucccuugucaagaaacucuacccacgaaauguauuggauuaguaauggaacaggcaacaucgucucgagcgugaauaugguaucccgucugcuccuuaacagguuuaccaugacucaucggcgcccgacgauagagaaagauguggaccugggugcugggacacgacacguuaacgccgaaccugagaccccaaauauggacgucauuggagagagaaucaagaggaucaaagaagagcauucuucaacuuggcacuacgaugacgaaaaccccuauaagaccugggcauaccacggcagcuaugaggugaaagccacaggcuccgcuaguucuaugauuaaugggguggucaaguuacugacgaagccuugggauguugugccaaugguaacccaaauggcgaugacugacacaacccccuucggacagcagcggguguuuaaagaaaaggucgauacucgcacaccgagaccuaugcccgguaccaggaaagugauggagauaacagccgagugguuguggcgaacucucggccggaacaagaaaccacgucugugcaccagagaagaguucacgaagaagguucgcaccaaugcagcuaugggggccguguuuacagaagagaaccaaugggacagcgcaagggccgcugucgaagaugaggaguucuggaaacuaguggaccgggaaagagagcuucauaagcugggaaaauguggcucaugcguauacaauaugauggguaagcgcgaaaaaaagcucggggaguuuggaaaagccaagggcuccagggcgaucugguacauguggcugggcgcacgauauuuggaguucgaagcccugggguuucucaacgaggaucacugguucagucgggaaaauagcuacucuggaguugagggugaaggccuucauaagcugggguauauuuuaagagacaucuccaaaauuccuggaggcgcuauguacgccgaugacacugcagguugggacaccaggaucacagaggaugaccugcacaacgaggaaaagauaacucagcagauggaucccgagcaucgccaguuggcuaaugccaucuuuaaacucaccuaucaaaacaagguggucaaagugcagcguccaacgcccaaggggacagugauggacauuaucucacggaaggaucagagaggaagcggccaggucggcaccuacgggcugaauacuuucacaaacauggaagcucaacuaguuaggcagauggagggagaaggugugcuuucgaaagccgaccuggagaauccucaccuccuggagaagaaaauuacccagugguuggaaacuaagggcguagagcgcuuaaaacgaauggcaaucucuggggaugacugcguggucaagccaauagaugaccgguuugcgaacgcccugcucgcucuuaacgauaugggaaaggugagaaaagacauuccgcaguggcaacccaguaagggcuggcacgauuggcagcagguuccuuucuguucccaucacuuccaugaacugaucaugaaagacgguaggaagcuaguggucccaugccgcccccaggacgagcugaucgggagagcccggauuagccaaggagcaggcuggucacucaaagaaaccgcuuguuugggcaaggccuaugcacagauguggucccugauguacuuucacaggcgugaucuucgacuggccucuaaugcgauaugcagcgcugugccuguacacuggaucccaacaagucgcacgaccugguccauucaugcccaccaucaguggaugacuacagaggacaugcucaccguuuggaacagaguguggaucgaggauaaucccuggauggaagacaagacuccugucacaaccugggaggaugugccguacuuagggaaacgggaagaccaaugguguggaagccugauugguuugacgucuagggcaacaugggcccagaacauccugaccgcuauacagcagguucgcucacucaucggcgaugaggaguuccuugacuauaugccaaguaugaagagauuucggaaagaagaggaauccgagggggccauuugguga

SEQ ID NO: 15592 - RNA, 9873 nt, Artificial Sequence
  derived and/or modified CDS sequence (opt3) from DENV-3__FJ547066__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaauggagccggaagacauugauugcugguguaaccuuaccaguacauggguuaccuaugggacuugcaaucaggcuggagagcaucgccgagacaagcguagcguggcccuggcaccccacguaggcauggguuuggauacaagaacccaaacguggauguccgccgagggggcuuggaggcagguggaaaaagucgagacuugggcacuccggcauccuggauucaccauccuggcccuguuucucgcucacuacauuggcacaucuuuaacucagaaggugguuaucuucauacugcuuauguuggugaccccaucgaugacaaugcgcugugucggcguggggaacagagacuuuguagaaggacugucaggugccaccuggguugaugugguccuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuauguguguaaacacacuuacgucgaucgcgguugggggaacggaugcggccuguucggcaaggggaguuuaguuaccugcgccaaguuucaaugucuggagcccauagagggaaaagugguacaguaugaaaaucucaaguacacagugauuaucacuguccacaccggugaccagcaucaggugggcaacgacacacaagggguuaccguggagauuacuccucaggcauccacggucgaagcugugcuuccagaguauggaacacugggcuuggaaugcucuccgcgaaccggucuagauuucaaugagaugauccugcucacuaugaaaaacaaggccuggaugguacacagacagugguuuuucgaccugccccuuccuuggaccagcggggcgacaaccgagacuccaacauggaauaggaaagaacuguugguuacguuuaagaacgcccaugcaaaaaagcaagagguggucgugcucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuuguccuuaagaaagaggugucugagacucagcaugggaccauauugaucaagguugaauacaagggagaggacgcccccuguaaaauuccuuucuccacggaagauggccaagguaaggcucacaacgggcgucugaucaccgcgaauccagugguaacaaaaaaggaggagcccgucaacauagaagcagagccgccuuucggcgaaucaaauauugugaucggaaucggcgacaaagcccucaagauuaacugguauaagaaagggagcaguaucggaaagauguuugaggcuacugcccgcggugcaagaaggauggccauucugggcgauaccgcuugggacuucgggucuguuggaggcgugcuuaauucccuggguaaaaugguccaucagauauuugggagcgccuacacagcauuguucucgggcgugucuuggaucaugaagauuggaaucggcguacuccugacuuggaucggguuaaacuccaaaaauaccucaaugaguuuuagcugcauugugauaggaaucauuacgcuguaucuaggcgcgguuguccaggcugauauggguugugccaucaacuggaaggggaaggaacucaaaugcggauccggcauuuucgugacaaaugaggugcacaccuggacugagcaguacaaguuucaagcagacucucccaaacggcuggccacagcuaucgccggugcaugggaaaacggcgucugugggauacgaagcaccacucgcauggagaaucuuuuguggaagcagaucgcuaacgaacugaauuauauucucugggagaacaauaucaaacugaccguuguggugggagauauuaucggcguauuagaacaggggaagagaacacugacgccacagccuauggagcuuaaauacucauggaagaccuggggaaaggccaaaauagucacugcggagacacaaaacaguuccuucauuaucgacggccccaacaccccagaaugccccagcgccucuagggcuuggaaugugugggagguugaagacuaugguuuugggguguucacaacuaacauuugguugaagcuccgggaggucuacacccagucaugugaucaucgccugaugagugcagccaucaaagacgaaagagcugugcacgccgauaugggauacuggauagagagccagaagaauggcuccuggaaacuagagaaggcaucuuuuaucgaaguuaagacgugcacauggccuaaaucgcacacccuguggagcaacggugugcucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacuguagucaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggugaagucacuggucagcgcugguucuggcaagguugauaacuuuaccauggggguguugugccucgccauccuguucgaggaaguaaugcgcggaaaauucggcaagaaacauaugauugcaggggugcuauuuacuuucguccugcuccuguccggacagaucacauggcgggacauggcucacacccuuauuaugauaggcaguaaugccagcgauagaauggguaugggggugacguauuuggcacugaucgccacuuuuaagauucagcccuucuuagcucucggauuuuuccugaggaaacuuaccucucgcgagaaccugcuacucggcguuggccuggcgauggccacaaccuugcaacugccggaagacaucgagcagauggcaaaugggauugcuuuaggacucaugacucugaagcuuaucacacaguuugaaaccuaccagcuguggacagccuuggugucccucacuuguucaaacaccauauucacgcugacagucgccuggcgaaccgcuacucuaauccuggcaggugugagucuucucccucugugccaaagcucguccaugcggaagaccgauugguugccaaugacaguugccgcgaugggcgugcccccucugcccuuauuuauuuucucucucaaagacacuccaaagcguagaagcuggccucugaaugagggggucauggcuguaggacuugugucaauccuggccaguuccuugcucaggaacgauguucccauggcaggcccacugguggccggugggcuacugauugcuuguuaugucaucaccggaacgucugcagaccuuacaguggagaaagccgcggacguaaccugggaagaggaagcugagcagacuggcgugagccauaaccucaugauaacagucgaugacgauggcaccaugcgcauuaaggacgaugaaacugagaauauccugacaguuuuguuaaaaaccgcccugcucaucguguccgggauuuuuccguacucaauaccugcaacgcugcuuguguggcacacuuggcagaagcagacccaacggagcggaguccugugggacgugcccaguccacccgagacacagaaagccgaauuggaggaagguguuuacagaaucaagcagcagggcauuuucgggaagacccaaguaggagugggcguccagaaagaggguguguuucauacaauguggcacguuacuaggggggcugugcuaacccacaacggaaagcgacuggagccuaauugggccucugucaaaaaggaucucaucuccuauggcggcggguggcgccugagcgcacaguggcaaaaaggagaagaggugcagguaauugcugucgaaccagguaagaaccccaagaauuuccagacgaugccuggcaucuuccagacaacuaccggggagauaggagccaucgcgcuugacuuuaaaccgggcacaucggguucaccaauuaucaaccgggaagggaaggugguuggauuauacggcaauggcguggucaccaaaaacgggggauaugugucugguauugcccaaacuaaugcagagcccgauggcccuaccccagagcuggaagaggaaauguucaagaaaagaaaccucacaaucauggacuugcaucccgggaguggaaagacgaggaaguaccugccugcuauaguucgugaggccauuaaacgccggcucagaacucugauccuugcuccgaccaggguggucgcagccgaaauggaggaggcccugaagggcuugcccauccgauaucagacaaccgcuacuaaauccgaacacacaggucgggagauuguggaucuaaugugccaugcgaccuuuacgaugcgccugcucagcccaguaagagugccuaauuacaacuuaaucauaauggacgaagcacacuucacugaucccgccucuauugcugccaggggguauaucagcacacggguuggaaugggcgaggcagccgcuauuuuuaugaccgcgaccccaccuggcacugccgaagcauucccccaguccaaugcuccaauccaggacgaggagcgagacauaccggaaagaucauggaacagugggaaugaguggauuacagauuuugucggaaagaccgugugguucgugccuagcaucaaagccgguaacgacaucgcaaacugucugcgcaagaauggcaagaaagucauucaacuuucuaggaagacauuugauacugaauaccagaaaacgcgucugaacgacugggauuucguagugaccacagacaucuccgagaugggggccaauuuuaaggcugaucggguuauugaccccagaaggugccucaaaccagugauauugacugauggacccgagcgcgucauccuggccggcccuaugccagugaccgcggcaucagccgcucagcgaagaggucggguugggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauucgaacccgagcgcgagaaaagugccgcuauagauggcgaauaucgucugaagggggagagcagaaaaacguuuguggaauugaugcggaggggagacuuaccugucuggcuggcccacaagguggcauccgaggguaucaaauacaccgaucgcaaguggugcuucgacggcgaacgaaacaaucagauucucgaggagaacauggauguagaaaucuggacaaaagagggggaaagaaagaagcugcggcccagguggcuugacgcgcgcacuuauucugauccacuggcccucaaagaguuuaaggacuucgcugccggaagaaaaucgauugcauuggaucuggugaccgaaaucggcaggguuccuagccaucuagcuuaccggacacguaaugcccuggacaaccucgucaugcuucacaccucagagcauggugggcgcgcauaucgacacgccguggaggaacugcccgagacuauggaaacauuauugcugcucggccugaugauacuucugacgggaggcgcuaugcucuuuuugaucuccgggaagggaauugguaaaaccaguaucggccugauuugugugaucgucucuagcgggauguuauggauggcggauguuccacuacaguggauagccuccgcaauuauccuggaguucuuuaugauggugcuccuuauuccugagccggaaaagcaaagaacuccccaggacaaucagcuggcuuacguagugaucggaauauugacacuggccgccaucgucgcagcuaacgagaugggccuccuggaaaccaccaagagggaucuugguaugucaaaagagccaggggugguuucuccuacaagcuaucucgacguggaccugcaccccgccagugcguggacuuuguacgcugucgccacgaccguaauuacaccaaugcugcggcauacuaucgaaaauuccaccgcaaacgugagcuuagccgcuauugcaaaccaagccguugugcuaaugggccuggauaagggauggccuaucucuaaaauggaccucggcgucccccuucuggcguuggggugcuacucacaggugaauccgcugacacucaccgcugccguccugcuuuuagugacucacuaugcaauaauuggaccaggccugcaggccaaggcuacgcgcgaggcccagaaaagaacagcagcugguaucaugaagaacccuaccguugaugggaucaugacuauugaccucgaucccgugaucuacgacuccaaguucgagaaacaauugggacagguaaugcugcuagugcugugugccguccagcuccuucugaugaggaccaguugggcguugugcgaagcccugacacucgcaacuggcccaauaaccacacugugggaggguagccccggcaaguuuuggaauacgaccauugcuguuucgauggccaacaucuuccgggggucuuauuuagcaggagcuggccuugccuuuuccauuaugaaaagcguggggacuggacgaagaggcacagguucacagggggaaacccugggagagaaguggaaaaagaagcucaaucaacuaagucgcaaagaauucgaucuguacaagaaaucuggcaucacugaggucgacaggacagaggccaaggaagguuugaaacggggcgagaccacgcaucacgcggugucccgugggagcgcuaagcugcagugguuuguagaaagaaacauggugauaccugagggaaggguuaucgaucucggcugugggcgcggaggcuggucauauuacugcgcaggucuuaaaaaggugaccgaaguccggggguauacaaagggaggcccgggccaugaggagcccgugccaaugaguacuuacggguggaaucuggucaaauugaugagcggaaaggacguguucuaccugccucccgaaaaaugugauacccucuuaugcgacauuggugaguccucuccuagcccaacaguugaagagucccgaacuaucagaguacugaagaugguggagcccuggcuuaaaaacaaucaguucuguauuaagguccugaacccuuauaugccaaccgugaucgaacaccuagagaggcuccagcgcaaguacggcgggaugcugguucggaaucccuugucaagaaacucuacacacgaaauguauuggauuaguaauggaaccggcaacaucgugucgagcgucaauauggugucccgucugcuccuuaacagguuuacuaugacgcaucggcgcccgacaauagagaaagauguagaccugggugccgggacccgacacgugaacgcugaaccugagacuccaaauauggacguuauuggagagagaaucaagaggaucaaagaagagcauucuucaaccuggcacuacgaugacgaaaaccccuauaagacaugggccuaccacggcagcuaugaggucaaagcaacgggcuccgccaguucuaugauuaaugggguggugaaguuacugaccaagccuugggaugucguuccaauggugacucaaauggcuaugacagacaccacucccuucggacagcagcggguauuuaaagaaaagguggauacacgcaccccgagaccuaugcccgguacaaggaaagucauggagauaacugcggagugguuguggcgaacccucggccggaacaagaaaccacgucugugcacgagagaagaguucaccaagaaggugcgcacaaaugccgcaaugggggcuguuuuuacugaagagaaccaaugggacagcgccagggcagccguggaagaugagggauucuggaaacuagucgaccgggagagagaacuucauaagcugggcaaaugugguucaugcguguacaauaugauggggaagcgcgagaaaaagcucggagaauuuggcaaagcuaagggcuccagggccaucugguacauguggcugggggcgcgauauuuggaguucgaggcacugggauuucucaacgaagaucacugguucagucgggagaauagcuacucugguguagaaggcgaggggcuucauaagcugggauauauuuuaagagacaucuccaaaauuccuggcggugccauguacgcugaugacaccgccgggugggacacaaggaucacugaagaugaccugcacaacgaggagaagauaacccagcagauggaucccgaacaucgccaguuggcaaaugcuaucuuuaaacucacguaucaaaacaagguugugaaaguccagcguccaacacccaagggaaccgugauggacauuaucucacggaaggaucagagaggcagcggccagguggggacuuacggacugaauacauucaccaacauggaggcccaacuagucaggcagauggaaggugagggcguucuuucgaaagcugaccuggaaaauccucaccuccuggagaagaaaauuacucagugguuggagaccaaggggguggaacgcuuaaaacgaauggccaucucuggagaugacugcguagugaagccaauagaugaccgguuugcaaacgcgcugcucgcccuuaacgauaugggcaaggucagaaaagacauuccgcaguggcaacccaguaaggguuggcacgauuggcagcaggugccuuucuguucccaucacuuccaugagcugaucaugaaagacgggaggaagcuaguugugccaugccgcccccaggacgaacugaucggaagagcucggauuagccaaggcgccggcuggucacucaaagagacagcauguuuggggaaggcuuaugcccagauguggucccugauguacuuucacaggcgugaucuucgacuggcaucuaaugccauaugcagcgcggucccugugcacuggaucccaacgagucgcaccacuugguccauucaugcucaccaucaguggaugacaaccgaagacaugcucacuguauggaacagaguuuggaucgaggauaaucccuggauggaggacaagacaccugugaccacgugggaagaugucccguacuuaggaaaacgggaggaccaauggugugguagccugauuggcuugacaucuagggccaccugggcacagaacauccugacugccauacagcaggugcgcucacucaucggggaugaagaguuccuugacuauaugccaaguaugaagagauuucggaaagaggaagaguccgaaggagcuauuugguga

SEQ ID NO: 15593 - RNA, 9873 nt, Artificial Sequence
  derived and/or modified CDS sequence (opt3) from DENV-3__KF955460__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucacccugcuuauguuggucacaccaucgaugaccaugcgcugugugggcguagggaacagagacuuuguugaaggacugucaggugccacguggguggaugucgugcuagagcauggcgggugcgugacuacaauggcgaagaauaaacccacccucgacauagagcugcagaagacugaagcaacacaacuugccacccugaggaaauuguguaucgagggaaagauuacgaacaucaccacagauagccggugcccuacucagggcgaagcuauucucccagaggaacaggaccagaauuaugucuguaaacacaccuacguugaucgcgguugggggaacggaugcggccuguucggcaaggggaguuuagugacaugcgccaaguuucaaugucuggagcccaucgagggaaaaguagugcaguaugaaaaucucaaguacacugucauaauuaccgugcacacaggugaccagcaucagguuggcaacgacacccaaggggugacugucgagaucacgccucaggcauccacaguggaagcuguacuuccagaguauggaacccugggcuuggaaugcucuccgcgaacuggucuagauuucaaugagaugauucugcucaccaugaaaaacaaggccuggaugguucacagacagugguuuuucgaccugccccuuccuuggacaagcggggcgaccacugagacaccaacguggaauaggaaagaacuguuggugaccuuuaagaacgcccaugcaaaaaagcaagaggucgugguccucggcucccaggaaggagcuaugcacacugcccugacaggcgcuaccgagauccagaauucagggggaacaaguaucuucgccggucacuuaaagugucggcugaaaauggauaagcuagaacucaaaggcaugagcuacgcaaugugccugaacacuuuugugcuuaagaaagagguuucugagacccagcaugggacgauuuugauaaagguggaauacaagggagaggacgcccccuguaaaaucccuuucuccaccgaagauggccaagguaaggcucacaacgggcgucugauuacagcgaauccaguagucacuaaaaaggaggagcccgugaacaucgaagcagagccgccuuucggcgaaucaaauauaguuauuggaaucggcaacaaagcccucaagaucaauugguauaagaaagggagcaguauuggaaagauguuugaggcuaccgcccgcggugcaagaaggauggccauccugggcgacacagcuugggauuucgggucugugggaggcguccuuaacucccuggguaaaauggugcaucagauuuuugggagcgccuacacugcauuguucucgggcguaucuuggauaaugaagaucggaauuggcgugcuccugaccuggaucggguuaaauuccaaaaacacgucaaugaguuuuagcugcaucguuauuggaauaaucacacuguaucuaggcgcggucgugcaggcugacauggguugugccauuaauuggaaggggaaggaacucaaaugcggauccggcaucuucgugaccaacgagguccacacuuggacagagcaguacaaguuucaagcagauucucccaaacggcuggccaccgcuauugccggugcaugggaaaauggcguuugugggauccgaagcacuacccgcauggagaaccuuuuguggaagcagauagcuaaugaacugaacuauauccucugggagaauaacauuaaacugacaguggugguaggagacaucauuggcgucuuagaacaggggaagagaacgcugaccccacagccuauggagcuuaaauacucauggaagacuuggggaaaggccaaaaucgugacagcggagacccaaaacaguuccuucauaauugauggccccaauacaccagaaugccccagcgccucuagggcuuggaacguuugggagguggaagacuaugguuuuggggucuucacuaccaauaucugguugaagcuccgggagguguacacgcagucaugugaccaucgccugaugagugcagccauuaaagaugaaagagcuguucacgccgacaugggauacuggaucgagagccagaagaacggcuccuggaaacuagagaaggcaucuuuuauagaagugaagacaugcaccuggccuaaaucgcacacucuguggagcaaugguguacucgaguccgauaugaucauuccaaagucacuggcgggcccgaucagucagcauaaccacaggcccggguaucauacccaaacagccggaccuuggcaccuuggcaaauuggaacuggacuucaauuacugcgaggggacuaccgucgugauuacagagaacuguggaacgcguggcccaucuuuacggaccacuacagugagcgguaagcucauccacgaauggugcugucgauccugcacccugcccccucuuagauauaugggggaggauggauguugguacggcauggaaauaaggccaauuaaugagaaagaagagaacauggucaagucacugguuagcgcugguucuggcaagguggacaauuuuacuauggggguauugugccucgccauccuguucgaggaagugaugcgcggaaaauucggcaagaaacauaugaucgcagggguccuauuuacauucgugcugcuccuguccggacagauuaccuggcgggauauggcucacacgcuuaucaugauuggcaguaacgccagcgacagaauggguauggggguuacuuauuuggcacugauagccaccuuuaagauccagcccuucuuagcucucggauuuuuccugaggaaacuuacaucucgcgagaaucugcuacucggcgugggccuggcgauggccaccacuuugcaacugccggaagauauugagcagauggcaaacgggaucgcuuuaggacucaugacacugaagcuuauuacccaguuugaaacauaccagcuguggacugccuuggucucccucaccuguucaaauacgaucuucacacugaccguggccuggcgaacugcuacccuaauacuggcagguguuagucuucucccucugugccaaagcucguccaugcggaagacagacugguugccaaugacuguggccgcgaugggcguccccccucugcccuuauuuaucuucucucucaaagauaccccaaagcguagaagcuggccucugaacgaggggguaauggcugugggacuuguuucaauucuggccaguuccuugcucaggaacgacgugcccauggcaggcccacuggucgccggugggcuacugaucgcuuguuaugugauuacgggaacaucugcagaucuuaccguagagaaagccgcggacgugacuugggaagaggaagcugagcagacaggcgucagccauaaucucaugaucaccguugacgaugacggcacuaugcgcauaaaggaugacgaaacagagaacauucugaccguguuguuaaaaacggcccugcucaucguguccgggaucuuuccguacucaauuccugcaacucugcuugucuggcacaccuggcagaagcagacacaacggagcggagugcugugggauguucccaguccacccgagacccagaaagccgaauuggaggaagguguauacagaauaaagcagcagggcaucuucgggaagacacaagugggagucggcgugcagaaagaggguguuuuucauacuauguggcacgugaccaggggggcuguccuaacgcacaauggaaagcgacuggagccuaacugggccucugugaaaaaggaccucauuuccuauggcggcggguggcgccugagcgcacaguggcaaaaaggagaagagguacaggucaucgcuguggaaccagguaagaaucccaagaacuuccagacaaugccuggcauuuuccagacuaccacaggggagaucggagccauagcgcuugauuuuaaaccgggcaccucggguucaccaaucauuaaucgggaagggaagguugugggauuauacggcaacggcgucgugacuaaaaaugggggauauguuucugguaucgcccaaaccaacgcagagcccgacggcccuacaccagagcuggaagaggaaauguucaagaaaagaaaucucacgauuauggauuugcaucccgggaguggaaagacuaggaaguaccugccugcuaucgugcgugaggccauaaaacgccggcucagaacccugauucuugcuccgacaagggucguggcagccgaaauggaggaggcccugaagggcuugcccauccgauaucagaccacugcuacaaaauccgaacacaccggucgggagaucguagaccuaaugugccaugcgacguuuacuaugcgccugcucagcccagugagaguuccuaacuacaauuuaauuaucauggaugaagcacacuucacagaccccgccucuauagcugccaggggguauauuagcacccgggucggaaugggcgaggcagccgcuaucuuuaugaccgcgacuccaccuggcacagccgaagcauucccccaguccaacgcuccaauucaggaugaggagaaggacaucccggaacgaucauggaauagugggaacgaguggauaaccgacuuugugggaaaaacagugugguucgucccuagcauuaaggccgguaacgauaucgcaaauugucugagaaagaacggcaaaaagguaauccaacuuucucgcaaaacuuuugacacggaauaccagaagaccaggcugaaugauugggacuucgugguuacaacugauauuuccgagaugggggccaacuuuaaagcugaccgugugaucgauccccggagaugccucaagccagucauuuugaccgacggacccgagagggugauacuggccggcccuaugccaguuacagcggcaucagccgcucagcgccgagguagaguggggcggaauccccagaaggaaaacgaucaauacaucuucaccggccagccucucaauaacgacgaggaucaugcccacuggacugaagcuaaaaugcugcuugacaauauuaacacgccggagggaaucaucccagcacuauucgaacccgagagggagaagagugccgcuauugacggcgaauaucgccugaaaggggagagccguaagaccuuugucgaauugaugagacggggagauuuaccuguguggcuggcccacaaaguagcauccgaggguauaaaguacacagacaggaaauggugcuucgauggcgaacgcaauaaccagauccucgaggagaauauggacguggaaauuuggacuaaggagggggaacgaaagaaacugagaccccgguggcuugaugcgaggaccuauucugacccacuggcccucaaggaguuuaaagauuucgcugccggacgcaagucgaucgcauuggaccugguuacagaaauuggcagagucccuagccaucuagcuuacaggacccggaacgcccuggauaaucucgugaugcuucacacuucagagcauggugggcgugcauaucgccacgccguggaggaacugcccgagacaauggaaacguuauugcugcucggccugaugauccuucugaccggaggcgcuaugcucuuuuugauauccgggaaaggaaucgguaagacuaguauuggccugaucugugucauuguuucuagcgggauguuauggauggcggacgugccacuacaguggaucgccuccgcaauaguacuggaguucuuuaugauggugcuccuuauuccugagccggaaaagcaacgaacaccccaggauaaccagcuggcuuacgucgugaucggaauuuugacccuggccgccaucguugcagcuaaugagaugggccuccuggaaaccacaaaaagagaccuugguaugucaaaggagccagggguggucucuccuacuagcuaucucgauguagaccugcaccccgccagugcguggacguuguacgcuguggccaccacaguuauaacuccaaugcugaggcauaccaucgaaaacuccacagcaaacgugagcuuagccgcuauugcaaaucaagccgucgugcuaaugggccuggacaaaggauggccuaucucuaagauggaucucggcgucccccuucuggcguuggggugcuacucacaggugaacccgcugacccucacugcugccguucugcuuuuagugacgcacuaugcaauuaucggaccaggccugcaggccaaagcuacacgggaggcccagaagcgcaccgcagcugguauaaugaagaauccuacuguagacgggauuaugaccaucgaucucgaccccgugaucuacgauuccaaauucgagaagcaauugggacaggucaugcugcuaguucugugugccgugcagcuccuucugaugagaacaaguugggcguugugcgaagcccugacucucgcaaccggcccaauuacaacgcugugggaggguagccccggcaaauuuuggaacaccacuaucgcugucucgauggccaauauauucagggggucuuauuuagcaggagcuggccuugccuuuuccauuaugaagagcguggggacaggacggcgaggcaccgguucacagggggaaacucugggagagaaauggaagaagaaacucaaccaacuaaguagaaaggaauucgaccuguacaaaaagucuggcaucacagagguagaucgcaccgaggccaaagaagguuugaagaggggcgagacgacccaucacgcggugucccgggggagcgcuaaacugcagugguuuguugaacguaauauggugauuccugagggaagagucaucgaccucggcugugggaggggaggcuggucauauuacugcgcaggucuuaagaaggugacagaaguccgcggguauacuaaaggaggcccgggccaugaggagcccgugccaaugaguaccuacggguggaacauaguuaagcugaugagcggaaaagauguauucuacuugccucccgaaaagugugacacacugcucugcgauaucggugaguccucuccuagcccaacuguggaagagucccggaccauucgagucuuaaaaaugguggagcccuggcugaagaauaaccaguucuguaucaagguucuuaauccuuauaugccaacagugauugaacaccuggagagacuacagaggaaauacggcgggaugcucguccgcaacccccugucacggaauucuacccacgaaauguauuggaucaguaacggaacuggcaauauugugucgagcguaaacaugguguccagauugcugcucaaccguuuuacgaugacacauaggcggccgaccaucgagaaggacguugaucuuggugccgggacucgccacgucaaugcugaaccugagaccccaaacauggacgugauaggagagcgaauuaaaagaaucaaggaagagcauucuucaacauggcacuacgacgaugaaaaucccuauaaaacgugggccuaccacggcagcuaugaggugaaggcaaccggcuccgccaguucuaugaucaacggggucguuaagcuguuaacuaaaccuugggacgugguaccaauggugacacaaauggcuaugaccgauacuacacccuucggacagcagagggucuuuaaggaaaaaguggacacccggacaccgcgcccuaugcccgguacuagaaagguuauggagauuaccgcggaguggcuguggaggacguugggccgaaauaaaaagccacggcucugcacccgugaagaguucacaaagaaagugagaacuaacgccgcaaugggggcugucuuuaccgaagagaaucaaugggauagcgcccgcgcagccguggaagacgaggaguucuggaagcugguagauagggaacgggagcuacauaaacuuggaaaguguggcucaugcguuuacaacaugauggguaaaagagaaaagaaacugggggaguuuggaaaggcuaagggcucccgcgccauaugguacauguggcucggcgcgagguaucuggaguucgaagcauugggguuucugaaugaggaccacugguucagucgagaaaacagcuacucuggaguggagggugaaggccuccauaaacuuggguauauccugcgggauauuuccaagaucccuggaggcgccauguacgcugacgauacagccgguugggacacuagaauuaccgaggacgauuuacacaaugaggaaaaaaucacgcagcagauggaccccgagcauaggcagcuggcaaacgcuauauuuaaguugacauaucaaaauaaagucgugaaggugcagcgcccaacccccaaggggacugucauggauaucauuucacguaaagaccagcggggaagcggccagguuggcacauacgggcucaacaccuucacuaauauggaagcccaacuggugagacagauggagggagaagguguacuaucgaaggcugaucuugagaacccucaccugcucgagaaaaagaucacccaguggcuggaaacaaaaggcguggagagguugaagcgcauggccauuucuggggacgauugcgucgugaagccaaucgacgaucgauuugcaaacgcguuacuggcccucaaugacaugggaaaaguucggaaggauauaccgcaguggcaacccaguaaaggcuggcacgacuggcagcaggugccuuucuguucccaucacuuccaugaacuuauuaugaaggaugguagaaaacuggucgugccaugcaggccccaggacgagcuaaucgggcgcgcuagaaucagccaaggagccggcuggucacugaaggaaacggcaugucucggcaaggcuuaugcccagaugugguccuugauguacuuucaccggagggaccugcgucuugcaucuaacgccauuugcagcgcgguaccuguucacuggauaccaaccagucgaacuacaugguccauccaugcucaccaucaguggaugaccacugaggauaugcugacaguguggaaucgcgucuggauugaggacaaccccuggauggaagauaaaaccccugugacgacaugggaggacaucccguaccucgggaagagagaagaucaaugguguggaagcuuaauuggucugaccucucgggccacuugggcacagaauaucuugaccgccauacagcagguuaggucacugaucggcgacgaggaguuccucgauuauaugccaaguaugaaacgcuuuagaaaggaagaggaauccgagggggcuauuugguga

SEQ ID NO: 15594 - RNA, 9873 nt, Artificial Sequence
  derived and/or modified CDS sequence (opt3) from DENV-3__FJ461334__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcacgcaguggcaaaaaggagaagagguacaggucauugcaguggaaccagguaagaaccccaagaauuuccagacaaugccuggcaucuuccagacuaccacaggggagauaggagcuaucgcccuugacuuuaaaccgggcaccucggguucaccaauuaucaaccgggaagggaagguugugggauuauacggcaauggcgucgugacuaaaaacgggggauauguuucugguauugcgcaaaccaaugccgagcccgauggcccuacaccagagcuggaagaggaaauguucaagaaaagaaaccucacgaucauggacuugcaucccgggaguggaaagacuaggaaguaccugccugcaauagugcgugaggcuauuaaacgccggcucagaacccugauccuugccccgacaagggucguggcugcagaaauggaggaggcccugaagggcuugcccauccgauaucagaccacugccacaaaauccgaacacaccggucgggagauuguagaucuaaugugccaugcuacguuuacuaugcgccugcucagcccagugagaguuccuaauuacaacuuaaucauaauggacgaagcgcacuucacagaucccgcaucuauugccgcuaggggguauaucagcacccgggucggaaugggcgaggccgcagccauuuuuaugaccgcuacuccaccuggcacagcggaagccuucccccaguccaaugcaccaauccaggacgaggagcgagacauaccggaaagaucauggaacagugggaaugaguggauuaccgauuuugugggaaagacagugugguucgucccuagcaucaaagcugguaacgacaucgccaacugucugcgcaagaauggcaagaaaguaauucaacuuucuaggaagacuuuugauacggaauaccagaaaacccgucugaacgacugggauuucgugguuacaacugacaucuccgagaugggggcaaauuuuaaggccgaucgggugauugaccccagaaggugccucaaaccagucauauugaccgauggacccgagcgcgugauccuggcuggcccuaugccaguuacagccgcgucagcagcccagcgaagaggucggguggggaggaacccccagaaggaaaaugaccaauacauuuucaccggccagccucucaacaaugaugaggaccaugcucacuggacugaagccaagaugcugcuugacaacaucaauacgccggagggaaucauuccagcucuauucgaacccgagcgcgagaaaagugcagccauagauggcgaauaucgucugaagggggagagcagaaaaaccuuugucgaauugaugcggaggggagacuuaccuguguggcuggcucacaagguagccuccgaggguaucaaauacacagaucgcaaguggugcuucgacggcgaacgaaacaaucagauucucgaggagaacauggauguggaaaucuggacuaaagagggggaaagaaagaagcugcggcccagguggcuugacgcacgcaccuauucugauccacuggcgcucaaagaguuuaaggacuucgccgcuggaagaaaaucgauugccuuggaucugguuacagaaaucggcagggucccuagccaucuagcauaccggacccguaaugcucuggacaaccucgugaugcuucacacuucagagcauggugggcgcgccuaucgacacgcaguggaggaacugcccgagacaauggaaacguuauugcugcucggccugaugauacuucugaccggaggcgccaugcucuuuuugaucuccgggaagggaauugguaaaacuaguaucggccugauuugugucaucguuucuagcgggauguuauggauggcugaugugccacuacaguggauagcguccgccauuauccuggaguucuuuaugaugguacuccuuauuccugagccggaaaagcaaagaacaccccaggacaaucagcuggcauacguggucaucggaauauugacccuggcugccaucguggccgcaaacgagaugggccuccuggaaaccacaaagagggaucuugguaugucaaaagagccagggguugugucuccuacuagcuaucucgacgucgaccugcaccccgcuagugccuggacguuguacgcgguagcuaccacagugauuacuccaaugcugcggcauaccaucgaaaauuccacagccaacguuagcuuagcagccauugcuaaccaagcagugguccuaaugggccuggauaagggauggccuaucucuaaaauggaccucggcgugccccuucuggccuuggggugcuacucacaggucaauccgcugacccucacugcggcugugcugcuuuuaguuacgcacuaugccauaauuggaccaggccugcaggcaaaggccacacgcgaggcucagaaaagaaccgccgcagguaucaugaagaacccuacuguggaugggaucaugaccauugaccucgaucccguaaucuacgacuccaaguucgagaaacaauugggacaggugaugcugcuaguccugugugcuguucagcuccuucugaugaggacaaguugggccuugugcgaagcgcugacucucgccaccggcccaauaacaacgcugugggaggguagccccggcaaguuuuggaauaccacuauugcagugucgauggcuaacaucuuccgggggucuuauuuagccggagcaggccuugcuuuuuccauuaugaaaagcgucgggacaggacgaagaggcaccgguucacagggggaaacucugggagagaaguggaaaaagaagcucaaucaacuaagucgcaaagaauucgaucuguacaagaaaucuggcaucacagagguggacaggaccgaggccaaggaagguuugaaacggggcgagacgacccaucacgccguaucccgugggagcgcgaagcugcagugguuuguggaaagaaacaugguuauaccugagggaagggugaucgaucucggcugugggcgcggaggcuggucauauuacugcgcuggucuuaaaaaggucacagaagugcggggguauacuaagggaggcccgggccaugaggagcccgucccaaugaguaccuacggguggaaucuggugaaauugaugagcggaaaggacguuuucuaccugccucccgaaaaaugugauacacucuuaugcgacauuggugaguccucuccuagcccaacuguagaagagucccgaaccaucagagugcugaagauggucgagcccuggcuuaaaaacaaucaguucuguauuaaggugcugaacccuuauaugccaacaguuaucgaacaccuagagaggcuccagcgcaaguacggcgggaugcuggugcggaaucccuugucaagaaacucuacccacgaaauguauuggauuaguaauggaacuggcaacaucgucucgagcgugaauaugguaucccgucugcuccuuaacagguuuacgaugacacaucggcgcccgaccauagagaaagauguggaccugggugcagggacucgacacguuaacgccgaaccugagaccccaaauauggacgucauuggagagagaaucaagaggaucaaagaagagcauucuucaacauggcacuacgaugacgaaaaccccuauaagacgugggcuuaccacggcagcuaugaggugaaagccaccggcuccgcaaguucuaugauuaaugggguggucaaguuacugacuaagccuugggauguugugccaaugguaacacaaauggccaugaccgacacuacacccuucggacagcagcggguguuuaaagaaaaggucgauacccgcacaccgagaccuaugcccgguacuaggaaagugauggagauaaccgcugagugguuguggcgaacgcucggccggaacaagaaaccacgucugugcaccagagaagaguucacaaagaagguucgcacuaaugcggccaugggggcaguguuuaccgaagagaaccaaugggacagcgcuagggccgcagucgaagaugaggaguucuggaaacuaguggaccgggaaagagagcuucauaagcugggaaaauguggcucaugcguauacaauaugauggguaagcgcgaaaaaaagcucggggaguuuggaaaagccaagggcuccagggcuaucugguacauguggcugggcgcccgauauuuggaguucgaagcgcugggguuucucaacgaggaucacugguucagucgggaaaauagcuacucuggaguugagggugaaggccuucauaagcugggguauauuuuaagagacaucuccaaaauuccuggaggcgcaauguacgccgaugacacagcugguugggacacuaggaucaccgaggaugaccugcacaacgaggaaaagauaacgcagcagauggaucccgagcaucgccaguuggccaaugcaaucuuuaaacucacauaucaaaacaagguggucaaagugcagcguccaacccccaaggggacugugauggacauuaucucacggaaggaucagagaggaagcggccaggucggcacauacgggcugaauaccuucacuaacauggaagcucaacuaguuaggcagauggagggagaaggugugcuuucgaaagccgaccuggagaauccucaccuccuggagaagaaaauuacccagugguuggaaacaaagggcguagagcgcuuaaaacgaauggcuaucucuggggaugacugcguggucaagccaauagaugaccgguuugccaacgcacugcucgcgcuuaacgauaugggaaaggugagaaaagacauuccgcaguggcaacccaguaagggcuggcacgauuggcagcagguuccuuucuguucccaucacuuccaugaacugaucaugaaagacgguaggaagcuaguggucccaugccgcccccaggacgagcugaucgggagagcccggauuagccaaggagcuggcuggucacucaaagaaacggccuguuugggcaaggcauaugcucagauguggucccugauguacuuucacaggcgugaucuucgacuggccucuaaugcaauaugcagcgccgugccuguacacuggaucccaaccagucgcacuacaugguccauucaugcgcaccaucaguggaugaccacugaggacaugcucacaguuuggaacagaguguggaucgaggauaaucccuggauggaagacaagaccccugucacgacaugggaggaugugccguacuuagggaaacgggaagaccaaugguguggaagccugauugguuugaccucuagggcuacuugggcccagaacauccugaccgcaauacagcagguucgcucacucaucggcgaugaggaguuccuugacuauaugccaaguaugaagagauuucggaaagaagaggaauccgagggggccauuugguga

SEQ ID NO: 15595 - RNA, 9873 nt, Artificial Sequence
  derived and/or modified CDS sequence (opt3) from DENV-3__FJ461337__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucuaugggaggcgugcuuaauucccuggguaaaaugguccaucagauauuugggagcgccuacacagcauuguucucgggcgugucuuggaucaugaagauuggaaucggcguacuccugacuuggaucggguuaaacuccaaaaauaccucaaugaguuuuagcugcauugugauaggaaucauuacgcuguaucuaggcgcgguuguccaggcugauauggguugugccaucaacuggaaggggaaggaacucaaaugcggauccggcauuuucgugacaaaugaggugcacaccuggacugagcaguacaaguuucaagcagacucucccaaacggcuggccacagcuaucgccggugcaugggaaaacggcgucugugggauacgaagcaccacucgcauggagaaucuuuuguggaagcagaucgcuaacgaacugaauuauauucucugggagaacaauaucaaacugaccguuguggugggagauauuaucggcguauuagaacaggggaagagaacacugacgccacagccuauggagcuuaaauacucauggaagaccuggggaaaggccaaaauagucacugcggagacacaaaacaguuccuucauuaucgacggccccaacaccccagaaugccccagcgccucuagggcuuggaaugugugggagguugaagacuaugguuuugggguguucacaacuaacauuugguugaagcuccgggaggucuacacccagucaugugaucaucgccugaugagugcagccaucaaagacgaaagagcugugcacgccgauaugggauacuggauagagagccagaagaauggcuccuggaaacuagagaaggcaucuuuuaucgaaguuaagacgugcacauggccuaaaucgcacacccuguggagcaacggugugcucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacuguagucaucaccgaggacuguggaacacguggcccaucuuuacggacgaccacugugagcgguaagcucauacacgaauggugcugucgauccugcacacugcccccucuuagauauaugggggaggauggauguugguacggcauggaaauuaggccaaucaaugagaaagaagagaacauggugaagucacuggucagcgcugguucuggcaagguugacaauuuuaccauggggguguugugccucgccauccuguucgaggaaguaaugcgcggaaaauucggcaagaaacauaugauugcaggggugcuauuuacuuucguccugcuccuguccggacagaucacauggcgggauauggcucacacccuuauuaugauaggcaguaacgccagcgacagaauggguaugggggugacguauuuggcacugaucgccacuuuuaagauucagcccuucuuagcucucggauuuuuccugaggaaacuuaccucucgcgagaaucugcuacucggcguuggccuggcgauggccacaaccuugcaacugccggaagauaucgagcagauggcaaacgggauugcuuuaggacucaugacucugaagcuuaucacacaguuugaaaccuaccagcuguggacagccuuggugucccucacuuguucaaauaccauauucacgcugacagucgccuggcgaaccgcuacucuaauccuggcaggugugagucuucucccucugugccaaagcucguccaugcggaagaccgacugguugccaaugacaguugccgcgaugggcgugcccccucugcccuuauuuauuuucucucucaaagauacuccaaagcguagaagcuggccucugaacgagggggucauggcuguaggacuugugucaauccuggccaguuccuugcucaggaaugacguucccauggcaggcccacugguggccggugggcuacugauugcuuguuaugucaucaccggaacgucugcagaccuuacaguggagaaagccgcggauguaaccugggaagaggaagcugagcagacuggcgugagccauaaccucaugauaacagucgacgaugacggcaccaugcgcauuaaggaugacgaaacugagaacauccugacaguuuuguuaaaaaccgcccugcucaucguguccgggauuuuuccguacucaauaccugcaacgcugcuuguguggcacacuuggcagaagcagacccaacggagcggaguccugugggaugugcccaguccacccgagacacagaaagccgaauuggaggaagguguuuacagaaucaagcagcagggcauuuucgggaagacccaaguaggagugggcguccagaaagaggguguguuucauacaauguggcacguuacuaggggggcugugcuaacccacaauggaaagcgacuggagccuaacugggccucugucaaaaaggaccucaucuccuauggcggcggguggcgccugagcgcacaguggcaaaaaggagaagaggugcagguaauugcugucgaaccagguaagaaucccaagaacuuccagacgaugccuggcaucuuccagacaacugccggggagauaggagcgaucgcccuugauuuuaaaccgggcaccucggguucaccaauuaucaaucgggaagggaaggugguuggauuauacggcaacggcguggucacaaaaaaugggggauaugugucugguauugcacaaaccaacgcugagcccgacggcccuacuccagagcuggaagaggaaauguucaagaaaagaaaucucaccaucauggauuugcaucccgggaguggaaagacaaggaaguaccugccugccauaguucgugaggcuauuaaacgccggcucagaacgcugauccuugcaccgacuaggguggucgccgccgaaauggaggaggcucugaagggcuugcccauccgauaucagaccacagcgaccaaauccgaacacacuggucgggagauuguggaccuaaugugccaugcaacauuuaccaugcgccugcucagcccaguaagagugccuaacuacaauuuaaucauaauggaugaagcccacuucacggaccccgcuucuauugccgcaaggggguauaucagcacucggguuggaaugggcgaggccgcugcgauuuuuaugacagccaccccaccuggcaccgcagaagcuuucccccaguccaacgccccaauccaggacgaggagcgagauauaccggaaagaucauggaauagugggaacgaguggauuacugacuuugucggaaagacagugugguucgugccuagcaucaaagcagguaaugauaucgccaacugucugcgcaagaacggcaagaaagucauucaacuuucuaggaagaccuuugacacagaauaccagaaaacucgucugaaugauugggacuucguagugacgaccgauaucuccgagaugggggcuaacuuuaaggccgaccggguuauugaucccagaaggugccucaaaccagugauauugacagacggacccgagcgcgucauccuggcgggcccuaugccagugacugcagccucagcugcccagcgaagaggucggguugggaggaauccccagaaggaaaacgaucaauacauuuucaccggccagccucucaauaacgacgaggaccaugcucacuggacagaagcaaagaugcugcuugauaauaucaacaccccggagggaaucauuccagcccuauucgaacccgagcgcgagaaaagugcugccauagacggcgaauaucgucugaagggggagagcagaaaaacuuuuguggaauugaugcggaggggagauuuaccugucuggcuggcacacaagguggcguccgaggguaucaaauacacggaccgcaaguggugcuucgauggcgaacgaaauaaccagauucucgaggagaauauggacguagaaaucuggaccaaagagggggaaagaaagaagcugcggcccagguggcuugaugcccgcacauauucugacccacuggcucucaaagaguuuaaggauuucgccgcaggaagaaaaucgauugcuuuggaccuggugacugaaaucggcaggguuccuagccaucuagccuaccggacccguaacgcacuggauaaucucgucaugcuucacacaucagagcauggugggcgcgccuaucgacacgcuguggaggaacugcccgagaccauggaaacuuuauugcugcucggccugaugauacuucugacaggaggcgcgaugcucuuuuugaucuccgggaagggaauugguaaaacgaguaucggccugauuugugugaucgucucuagcgggauguuauggauggccgacguuccacuacaguggauagcauccgcuauugugcuggaguucuuuaugaugguacuccuuaucccugagccggaaaagcaaagaaccccccaggauaaccagcuggccuacguggucauuggaaucuugacucuggccgcaauaguggcugccaaugagaugggccuccuggaaacaaccaagagggaccuugguaugucaaaagagccagggguugugucuccuaccagcuaucucgacgucgaucugcaccccgcgagugcuuggacauuguacgccguagcaacuacggugaucaccccaaugcugcggcauacaauugaaaacuccacugccaauguuagcuuagcugcaaucgccaaccaagcggugguccuaaugggccuggacaagggauggccuauuucuaaaauggaucucggcgugccccuucuggcuuuggggugcuacucacaggucaacccgcugacccucacagccgcagugcugcuuuuaguuacccacuaugccaucauaggaccaggccugcaggcuaaggccacucgcgaggcacagaaaagaacggcugccgguauuaugaagaauccuacaguggacgggaucaugaccaucgaucucgaccccguaauuuacgauuccaaguucgagaaacaauugggacaggugaugcugcuaguccugugugcgguucagcuccuucugaugaggacuaguugggccuugugcgaagcacugacccucgcuacaggcccaaucacuacccugugggaggguagccccggcaaguuuuggaacacaacgauagccgugucgauggcaaauauuuuccgggggucuuauuuagcuggagccggccuugccuuuuccaucaugaaaagcgucgggaccggacgaagaggcacugguucacagggggaaacacugggagagaaguggaaaaagaagcucaaccaacuaagucgcaaagaauucgaccuguacaagaaaucuggcauuaccgagguggauaggacugaggcgaaggaagguuugaaacggggcgagacaacccaucacgcuguaucccgugggagcgcaaagcugcagugguuuguggaaagaaauaugguuaucccugagggaagggugauagaccucggcugugggcgcggaggcuggucauauuacugcgccggucuuaaaaaggucacggaagugcggggguauaccaagggaggcccgggccaugaggagcccgucccaaugaguacauacggguggaaccuggugaaauugaugagcggaaaggauguuuucuaccugccucccgaaaaaugugacacucucuuaugcgauaucggugaguccucuccuagcccaaccguagaagagucccgaacaauuagagugcugaagauggucgagcccuggcuuaaaaauaaccaguucuguaucaaggugcugaauccuuauaugccaacuguuauugaacaccuagagaggcuccagcgcaaguacggcgggaugcuggugcggaaccccuugucaagaaauucuacccacgaaauguauuggaucaguaacggaacaggcaauauugucucgagcgugaacaugguaucccgucugcuccuuaauagguuuaccaugacucaucggcgcccgacgaucgagaaagacguggaccugggugcugggacacgacacguuaacgccgaaccugagaccccaaacauggaugucauaggagagagaauuaagaggaucaaagaagagcauucuucaacuuggcacuacgacgaugaaaaucccuauaagaccugggcauaccacggcagcuaugaggugaaagccacaggcuccgcuaguucuaugaucaacgggguggucaaguuacugacgaagccuugggacguugugccaaugguaacccaaauggcgaugacugauacaacccccuucggacagcagcggguguuuaaagaaaaggucgacacucgcacaccgagaccuaugcccgguaccaggaaagugauggagauuacagccgagugguuguggcgaacucucggccggaauaagaaaccacgucugugcaccagagaagaguucacgaagaagguucgcaccaacgcagcuaugggggccguguuuacagaagagaaucaaugggauagcgcaagggccgcugucgaagacgaggaguucuggaaacuaguggaucgggaaagagagcuucauaagcugggaaaauguggcucaugcguauacaacaugauggguaagcgcgaaaaaaagcucggggaguuuggaaaagccaagggcuccagggcgauaugguacauguggcugggcgcacgauauuuggaguucgaagcccugggguuucucaaugaggaccacugguucagucgggaaaacagcuacucuggaguugagggugaaggccuucauaagcugggguauaucuuaagagauauuuccaaaaucccuggaggcgcuauguacgccgacgacacugcagguugggauaccaggauuacagaggacgaucugcacaaugaggaaaagaucacucagcagauggaccccgagcaucgccaguuggcuaacgccauauuuaaacucaccuaucaaaauaagguggucaaagugcagcguccaacgcccaaggggacagugauggauaucauuucacggaaggaccagagaggaagcggccaggucggcaccuacgggcugaacacuuucacaaauauggaagcucaacuaguuaggcagauggagggagaaggugugcuuucgaaagccgaucuggagaacccucaccuccuggagaagaaaaucacccagugguuggaaacuaagggcguagagcgcuuaaaacgaauggcaauuucuggggacgauugcguggucaagccaaucgacgaucgguuugcgaaugcccugcucgcucuuaacgacaugggaaaggugagaaaagauauaccgcaguggcaacccaguaagggcuggcacgacuggcagcagguuccuuucuguucccaucacuuccaugaacugauuaugaaagacgguaggaagcuaguggucccaugccgcccccaggaugagcugaucgggagagcccggaucagccaaggagcaggcuggucacucaaagaaaccgcuuguuugggcaaggccuaugcacagauguggucccugauguacuuucacaggcgugaccuucgacuggccucuaacgcgauuugcagcgcugugccuguacacuggauaccaacaagucgcacgaccugguccauccaugcccaccaucaguggaugacuacagaggauaugcucaccguuuggaauagaguguggauugaggacaaccccuggauggaagauaagacuccugucacaaccugggaggacgugccguacuuagggaaacgggaagaucaaugguguggaagccugaucgguuugacgucuagggcaacaugggcccagaauauucugaccgcuauccagcagguucgcucacucauaggcgacgaggaguuccuugauuauaugccaaguaugaagagauuucggaaagaagaggaauccgagggggccaucugguga

SEQ ID NO: 15596 - RNA, 9873 nt, Artificial Sequence
  derived and/or modified CDS sequence (opt3) from DENV-3__FJ461338__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugguugcggaaguggagccggaagacaucgauugcugguguaaccuuaccaguacauggguaaccuaugggacuugcaaucaggcuggagagcaucgccgagacaagcguagcguggcccuggcaccccacgucggcauggguuuggauacaagaacccaaacguggauguccgccgagggggcuuggaggcagguggaaaaaguugagacuugggcacuccggcauccuggauucaccauucuggcccuguuucucgcucacuacaucggcacaucuuuaacucagaagguggucauuuucauccugcuuauguuggugaccccaucgaugacaaugcgcuguguaggcguugggaacagagacuuuguggaaggacugucaggugccaccugggucgauguggugcuagagcauggcgggugcgucacgacuauggcgaagaauaaacccacacucgacauagagcugcagaagaccgaagcaacucaacuugccacacugaggaaauuguguaucgagggaaagauuaccaacaucacgaccgauagccggugcccuacacagggcgaagcuauucucccagaggaacaggaccagaauuauguuuguaaacacacuuacguggaucgcgguugggggaacggaugcggccuguucggcaaggggaguuuaguaaccugcgccaaguuucaaugucuggagcccaucgagggaaaagugguccaguaugaaaaucucaaguacacagugauaauuacuguucacaccggugaccagcaucaggugggcaacgacacacaaggggucaccguggagaucacuccucaggcauccacgguagaagcuguucuuccagaguauggaacacugggcuuggaaugcucuccgcgaaccggucuagauuucaaugagaugauucugcucacuaugaaaaacaaggccuggauggugcacagacagugguuuuucgaccugccccuuccuuggaccagcggggcgacaaccgagacuccaacauggaauaaaaaggaacuguuggucacguuuaaaaacgcccaugcaaagaagcaagagguggucgugcucggcucccaggaaggagcuaugcacaccgcccugacuggcgcuacagagauccagaauucagggggaaccaguaucuucgccggucacuuaaaauguaggcugaagauggauaaacuagaacucaagggcaugagcuacgcaaugugccugaacacauuuguucuuaaaaaggaggugucugagacucagcaugggaccauuuugauaaagguagaauacaaaggagaggacgcccccuguaagaucccuuucuccacggaagauggccaagguaaagcucacaacgggcggcugauuaccgcgaauccagucgugacaaagaaagaggagcccguuaacaucgaagcagagccgccuuucggcgaaucaaauauagugauuggaaucggcgacaaggcccucaagaucaacugguauaaaaaggggagcaguauuggaaaaauguuugaggcuacugcccguggugcacgcagaauggccauccugggcgauaccgcuugggacuucgggucugucggaggcgugcuuaauucccuggguaagaugguacaucagauuuuugggagcgccuacacagcauuguucucgggcgugucuuggauaaugaaaaucggaauuggcguucuccugacuuggaucggguuaaacuccaagaauaccucaaugaguuuuagcugcaucgucauuggaauaaucacgcuguaucuaggcgcgguggugcaggcugauauggguugugccauuaacuggaaggggaaagaacucaagugcggauccggcaucuucgucacaaaugagguucacaccuggacugagcaguacaaauuucaagcagacucucccaagaggcuggccacagcuauugccggugcaugggaaaacggcgugugugggauccggagcaccacucgaauggagaaucuuuuguggaaacagauagcuaacgaacugaauuauauccucugggagaacaauauuaagcugaccgugguagucggagauaucauuggcguguuagaacaggggaaacgcacacugacgccacagccuauggagcuuaaguacucauggaagaccuggggaaaagccaagaucguuacugcggagacacaaaacaguuccuucauaauugacggccccaacaccccagaaugccccagcgccucuagagcuuggaaugugugggaggucgaagacuaugguuuugggguguucacaacuaacaucugguugaaacucagggagguuuacacccagucaugugaucaucggcugaugagugcagccauuaaggacgaacgcgcugugcacgccgauaugggauacuggaucgagagccagaaaaauggcuccuggaagcuagagaaggcaucuuuuauagaaguaaaaacgugcacauggccuaagucgcacacccuguggagcaacgguguccucgaguccgacaugaucauuccaaaaucacuggcgggcccgaucagucagcauaaucacagacccggguaucauacucaaaccgccggaccuuggcaccuuggcaaguuggaacuggauuucaacuacugcgaggggacaacuguggugauuaccgagaauuguggaacaaggggcccaucuuuacguacgaccacugucagcgguaaacucauccacgaauggugcugucgguccugcacacugcccccucuucgauauaugggggaggacggauguugguacggcauggaaauaagaccaauuaacgagaaggaagagaauaugguuaagucacuggugagcgcugguucuggcaaaguagauaacuuuaccauggggguguugugccucgccauccuguucgaggaagucaugaggggaaaguucggcaaaaagcauaugaucgcaggggugcuauuuacuuucguucugcuccuguccggacagauuacauggcgcgacauggcucacacccuuaucaugauuggcaguaaugccagcgaucggauggguaugggggugacguauuuggcacugauagccacuuuuaaaauccagcccuucuuagcucucggauuuuuccugagaaagcuuaccucuagggagaaccugcuacucggcgucggccuggcgauggccacaaccuugcaacugccggaagacauugagcagauggcaaaugggaucgcuuuaggacucaugacucugaagcuuauuacacaguuugaaaccuaccagcuguggacagccuuggugucccucacuuguucaaacaccaucuucacgcugacaguugccuggcgcaccgcuacucuaauacuggcaggugugagucuucucccucugugccaaagcucguccaugcgaaaaaccgauugguugccaaugacagucgccgcgaugggcguacccccucugcccuuauuuaucuucucucucaaggacacuccaaaacggcguagcuggccucugaaugagggggugauggcuguuggacuugugucaauucuggccaguuccuugcucagaaacgauguccccauggcaggcccacugguggccggugggcuacugaucgcuuguuauguaauuaccggaacgucugcagaccuuacaguggagaaggccgcggacgucaccugggaagaggaagcugagcagacuggcguuagccauaaccucaugaucacaguggaugacgauggcaccaugaggauaaaagacgaugaaacugagaauauucugacaguguuguuaaagaccgcccugcucaucgucuccgggaucuuuccguacucaauuccugcaacgcugcuuguguggcacacuuggcagaaacagacccaacgcagcggaguucugugggacguacccaguccacccgagacacagaaggccgaauuggaggaagguguguaccggauaaagcagcagggcaucuucgggaaaacccaagucggagugggcguucagaaggaggguguguuucauacaauguggcacgucacuagaggggcugugcuaacccacaacggaaaaaggcuggagccuaauugggccucuguaaagaaagaucucauuuccuauggcggcggguggcgacugagcgcacaguggcaaaagggagaagagguccaggugaucgcuguugaaccagguaagaaccccaaaaauuuccagacgaugccuggcauuuuccagacaacuaccggggagaucggagccauagcgcuugacuuuaagccgggcacaucggguucaccaaucauuaaccgcgaagggaaaguggucggauuauacggcaauggcgugguuaccaagaacgggggauaugugucugguaucgcccaaacuaaugcagagcccgauggcccuaccccagagcuggaagaggaaauguucaaaaagcggaaccucacaauuauggacuugcaucccgggaguggaaagacgagaaaauaccugccugcuaucgucagggaggccauaaagcgucgccuccggacucugauucuugcuccgaccagagugguagcagccgaaauggaggaggcccugaaaggcuugcccaucagguaucagacaaccgcuacuaaguccgaacacacaggucgagagaucguggaucuaaugugccaugcgaccuuuacgaugcggcugcucagcccaguucgcgucccuaauuacaacuuaauuaucauggacgaagcacacuucacugaucccgccucuauagcugccagaggguauauuagcacaagggugggaaugggcgaggcagccgcuaucuuuaugaccgcgaccccaccuggcacugccgaagcauucccccaguccaaugcuccaauucaggacgaggagcgggacaucccggaacgaucauggaacagugggaaugaguggauaacagauuuugugggaaaaaccgucugguucguaccuagcauuaaggccgguaacgacaucgcaaacugucugagaaagaauggcaaaaaggugauccaacuuucucgcaaaacauuugauacugaauaccagaagacgaggcugaacgacugggauuucguugugaccacagacauuuccgagaugggggccaauuuuaaagcugaucgugucaucgacccccggagaugccucaagccagugauuuugacugauggacccgagaggguuauacuggccggcccuaugccagugaccgcggcaucagccgcucagcgccgagguagagucgggcggaacccccagaaggaaaaugaccaauacaucuucacaggccagccucucaacaaugaugaggaccaugcccacuggaccgaagcuaaaaugcugcuugacaacauuaauacuccggagggaaucaucccagcacuauucgaacccgagagggagaagagugccgcuauugauggcgaauaucgccugaaaggggagagccguaagacguuuguggaauugaugagacggggagacuuaccuguauggcuggcccacaaaguggcauccgaggguauaaaguacaccgauaggaaauggugcuucgacggcgaacgcaacaaucagauccucgaggagaacauggauguugaaauuuggacaaaggagggggaacgaaagaaacugagaccccgguggcuugacgcgaggacuuauucugauccacuggcccucaaggaguuuaaagacuucgcugccggacgcaagucgaucgcauuggaucuggucaccgaaauuggcagagugccuagccaucuagcuuacaggacacggaaugcccuggacaaccucgugaugcuucacaccucagagcauggugggcgugcauaucgccacgccgucgaggaacugcccgagacuauggaaacauuauugcugcucggccugaugauccuucugacgggaggcgcuaugcucuuuuugauauccgggaaaggaaucgguaagaccaguauuggccugaucuguguuauugugucuagcgggauguuauggauggcggauguaccacuacaguggaucgccuccgcaauagugcuggaguucuuuaugaugguccuccuuauuccugagccggaaaagcaacgaacuccccaggacaaucagcuggcuuacgugguuaucggaauuuugacacuggccgccaucguggcagcuaacgagaugggccuccuggaaaccaccaaaagagaucuugguaugucaaaggagccaggggucguaucuccuacaagcuaucucgacguggaccugcaccccgccagugcguggacuuuguacgcuguugccacgaccgugauaacaccaaugcugaggcauacuaucgaaaauuccaccgcaaacgucagcuuagccgcuauugcaaaccaagccgugguccuaaugggccuggauaaaggauggccuaucucuaagauggaccucggcgugccccuucuggcguuggggugcuacucacagguuaauccgcugacacucaccgcugccgugcugcuuuuaguaacucacuaugcaauuaucggaccaggccugcaggccaaagcuacgcgggaggcccagaagcgcacagcagcugguauaaugaagaacccuaccguggaugggauuaugacuaucgaccucgaucccgucaucuacgacuccaaauucgagaagcaauugggacagguuaugcugcuagugcugugugccguccagcuccuucugaugagaaccaguugggcguugugcgaagcccugacacucgcaacuggcccaauuaccacacugugggaggguagccccggcaaauuuuggaauacgaccaucgcugugucgauggccaacauauucagggggucuuauuuagcaggagcuggccuugccuuuuccauuaugaagagcguagggacuggacggcgaggcacagguucacagggggaaacccugggagagaaauggaagaagaaacucaaucaacuaaguagaaaggaauucgaucuguacaaaaagucuggcaucacugagguggaccgcacagaggccaaagaagguuugaagaggggcgagaccacgcaucacgcgguuucccgggggagcgcuaaacugcagugguuuguggaacguaacauggucauuccugagggaagagugaucgaucucggcugugggaggggaggcuggucauauuacugcgcaggucuuaagaaggucaccgaagugcgcggguauacaaaaggaggcccgggccaugaggagcccguuccaaugaguacuuacggguggaauauaguaaagcugaugagcggaaaagacguguucuacuugccucccgaaaagugugauacccugcucugcgacaucggugaguccucuccuagcccaacagucgaagagucccggacuauucgaguguuaaaaaugguugagcccuggcugaagaacaaucaguucuguaucaaggugcuuaacccuuauaugccaaccgucauugaacaccuggagagacuacagaggaaauacggcgggaugcucgugcgcaauccccugucacggaacucuacacacgaaauguauuggaucaguaauggaaccggcaacauuguaucgagcgugaauaugguuuccagauugcugcucaaccguuuuacuaugacgcauaggcggccgacaaucgagaaggaugucgaccuuggugccgggacccgccacgugaacgcugaaccugagacuccaaauauggacgugauaggagagcgaauuaaaagaaucaaggaagagcauucuucaaccuggcacuacgaugacgaaaaccccuauaaaacaugggccuaccacggcagcuaugaggucaaggcaacgggcuccgccaguucuaugaucaaugggguugugaagcuguuaaccaaaccuugggauguagugccaauggucacucaaauggcuaugacagacaccacucccuucggacagcagaggguguuuaaggaaaaaguugauacacggaccccgcgcccuaugcccgguacaagaaaggugauggagauuacugcggaguggcuguggaggaccuugggccgaaacaaaaagccacggcucugcacgcgugaagaguucaccaagaaagucagaacaaaugccgcaaugggggcuguguuuacugaagagaaccaaugggacagcgcccgcgcagccguagaagaugaggaguucuggaagcugguugacagggaacgggagcuacauaaacuuggaaaguguggcucaugcguguacaauaugauggguaaaagagaaaagaaacugggggaguuuggaaaggcuaagggcucccgcgccauaugguacauguggcucggcgcgagguaucuggaguucgaagcauugggguuucugaacgaggaucacugguucagucgagaaaauagcuacucuggagucgagggugaaggccuccauaaacuuggguauauccugcgggacauuuccaagaucccuggaggcgccauguacgcugaugacaccgccgguugggacacaagaauuacugaggaugacuuacacaacgaggaaaaaaucacccagcagauggaucccgagcauaggcagcuggcaaaugcuauauuuaaguugacguaucaaaacaaaguggugaagguccagcgcccaacacccaaggggaccguuauggacaucauuucacguaaagaucagcggggaagcggccaggugggcacuuacgggcucaauacauucaccaacauggaagcccaacugguaagacagauggagggagaaggugugcuaucgaaggcugaccuugagaauccucaccugcucgagaaaaagaucacucaguggcuggaaaccaaaggcgucgagagguugaagcgcauggccauuucuggggaugacugcgugguuaagccaaucgaugaccgauuugcaaacgcguuacuggcccucaacgauaugggaaaagugcggaaggacauaccgcaguggcaacccaguaaaggcuggcacgauuggcagcaggucccuuucuguucccaucacuuccaugaacuuauuaugaaggacgguagaaaacuggugguaccaugcaggccccaggacgagcuaaucgggcgcgcuagaaucagccaaggagccggcuggucacugaaggaaacagcaugucucggcaaggcuuaugcccagaugugguccuugauguacuuucaccggagggaucugcgucuugcaucuaaugccauuugcagcgcgguuccugugcacuggauaccaacgagucgaaccacuugguccauccaugcucaccaucaguggaugacaaccgaggacaugcugacugucuggaaccgcguguggauugaggauaaucccuggauggaagacaaaacaccuguuaccacgugggaggaugugccguaccucgggaagagagaagaccaaugguguggaagcuuaaucggucugacaucucgggccaccugggcacagaacauuuugacugccauccagcaggucaggucacugauaggcgaugaggaguuccucgacuauaugccaaguaugaaacgcuuuagaaaggaagaggaauccgagggggcuaucugguga

SEQ ID NO: 15597 - RNA, 9873 nt, Artificial Sequence
  derived and/or modified CDS sequence (opt3) from DENV-3__FJ562103__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuaccgcuguccacugaucgcggaaguugagccggaagacauugauugcugguguaaccuuaccaguacaugggugaccuaugggacuugcaaucaggcuggagagcaucgacgugacaaaagaagcguagcccuggcaccccacgugggcauggguuuggauacaaggacccaaacguggauguccgccgagggggcuuggcggcaggucgaaaagguggagacuugggcacuccgccauccuggauucaccauccuggcccuguuucucgcucacuacauuggcacaucuuuaacucagaaaguugugaucuucacccugcuuauguuggucacaccaucgaugaccaugagaugugugggcguagggaacagggacuuuguugaaggacugucaggugccacguggguggaugucgugcuagagcauggcgggugcgugacuacaauggcgaagaauaagcccacccucgacauagagcugcagaaaacugaagcaacacaacuugccacccugcggaaguuguguaucgagggaaaaauuacgaacaucaccacagauagccgcugcccuacucagggcgaagcuauucucccagaggaacaggaccagaauuaugucuguaagcacaccuacguugaucgagguugggggaacggaugcggccuguucggcaaagggaguuuagugacaugcgccaaguuucaaugucuggagcccaucgagggaaagguagugcaguaugaaaaucucaaauacacugucauaauuaccgugcacacaggugaccagcaucagguuggcaacgacacccaaggggugacugucgagaucacgccucaggcauccacaguggaagcuguacuuccagaguauggaacccugggcuuggaaugcucuccgagaacuggucuagauuucaaugagaugauucugcucaccaugaagaacaaagccuggaugguucacaggcagugguuuuucgaccugccccuuccuuggacaagcggggcgaccacugagacaccaacguggaaucggaaggaacuguuggugaccuuuaaaaacgcccaugcaaagaaacaagaggucgugguccucggcucccaggaaggagcuaugcacacugcccugacaggcgcuaccgagauccagaauucagggggaacaaguaucuucgccggucacuuaaagugucgucugaagauggauaaacuagaacucaagggcaugagcuacgcaaugugccugaacacuuuugugcuuaaaaaggagguuucugagacccagcaugggacgauuuugauaaaaguggaauacaagggagaggacgcccccuguaagaucccuuucuccaccgaagauggccaagguaaagcucacaacgggcgccugauuacagcgaauccaguagucacuaagaaagaggagcccgugaacaucgaagcagagccgccuuucggcgaaucaaauauaguuauuggaaucggcaacaaggcccucaaaaucaauugguauaagaaggggagcaguauuggaaaaauguuugaggcuaccgccagaggugcaaggcggauggccauccugggcgacacagcuugggauuucgggucugugggaggcguccuuaacucccuggguaagauggugcaucagauuuuugggagcgccuacacugcauuguucucgggcguaucuuggauaaugaaaaucggaauuggcgugcuccugaccuggaucggguuaaauuccaagaacacgucaaugaguuuuagcugcaucguuauuggaauaaucacacuguaucuaggcgcggucgugcaggcugacauggguugugccauuaauuggaaagggaaggaacucaagugcggauccggcaucuucgugaccaacgagguccacacuuggacagagcaguacaaauuucaagcagauucucccaagcgacuggccaccgcuauugccggugcaugggaaaauggcguuugugggauccgcagcacuaccagaauggagaaccuuuuguggaaacagauagcuaaugaacugaacuauauccucugggagaauaacauuaagcugacaguggugguaggagacaucauuggcgucuuagaacaggggaaaaggacgcugaccccacagccuauggagcuuaaguacucauggaaaacuuggggaaaggccaagaucgugacagcggagacccaaaacaguuccuucauaauugauggccccaauacaccagaaugccccagcgccucucgggcuuggaacguuugggagguggaagacuaugguuuuggggucuucacuaccaauaucugguugaaacuccgcgagguguacacgcagucaugugaccauagacugaugagugcagccauuaaggaugaaagggcuguucacgccgacaugggauacuggaucgagagccagaaaaacggcuccuggaagcuagagaaagcaucuuuuauagaagugaagacaugcaccuggccuaagucgcacacucuguggagcaaugguguacucgaguccgauaugaucauuccaaaaucacuggcgggcccgaucagucagcauaaccaccgucccggguaucauacccaaacagccggaccuuggcaccuuggcaaguuggaacuggacuucaauuacugcgaggggacuaccgucgugauuacagagaacuguggaacgcggggcccaucuuuacgaaccacuacagugagcgguaaacucauccacgaauggugcuguagauccugcacccugcccccucuuagguauaugggggaggauggauguugguacggcauggaaauacgcccaauuaaugagaaggaagagaacauggucaaaucacugguuagcgcugguucuggcaagguggacaauuuuacuauggggguauugugccucgccauccuguucgaggaagugaugcggggaaaguucggcaaaaagcauaugaucgcagggguccuauuuacauucgugcugcuccuguccggacagauuaccuggagagauauggcucacacgcuuaucaugauuggcaguaacgccagcgacaggauggguauggggguuacuuauuuggcacugauagccaccuuuaaaauccagcccuucuuagcucucggauuuuuccugcgcaagcuuacaucucgagagaaucugcuacucggcgugggccuggcgauggccaccacuuugcaacugccggaagauauugagcagauggcaaacgggaucgcuuuaggacucaugacacugaaacuuauuacccaguuugaaacauaccagcuguggacugccuuggucucccucaccuguucaaauacgaucuucacacugaccguggccuggcggacugcuacccuaauacuggcagguguuagucuucucccucugugccaaagcucguccaugcguaagacagacugguugccaaugacuguggccgcgaugggcguccccccucugcccuuauuuaucuucucucucaaggauaccccaaaaagaaggagcuggccucugaacgaggggguaauggcugugggacuuguuucaauucuggccaguuccuugcuccgcaacgacgugcccauggcaggcccacuggucgccggugggcuacugaucgcuuguuaugugauuacgggaacaucugcagaucuuaccguagagaaggccgcggacgugacuugggaagaggaagcugagcagacaggcgucagccauaaucucaugaucaccguugacgaugacggcacuaugcggauaaaagaugacgaaacagagaacauucugaccguguuguuaaagacggcccugcucaucguguccgggaucuuuccguacucaauuccugcaacucugcuugucuggcacaccuggcagaaacagacacaaagaagcggagugcugugggauguucccaguccacccgagacccagaaggccgaauuggaggaagguguauacaggauaaaacagcagggcaucuucgggaagacacaagugggagucggcgugcagaaggaggguguuuuucauacuauguggcacgugacccgaggggcuguccuaacgcacaauggaaaacgccuggagccuaacugggccucugugaagaaagaccucauuuccuauggcggcggguggcggcugagcgcacaguggcaaaagggagaagagguacaggucaucgcuguggaaccagguaaaaaucccaagaacuuccagacaaugccuggcauuuuccagacuaccacaggggagaucggagccauagcgcuugauuuuaagccgggcaccucggguucaccaaucauuaauagagaagggaaaguugugggauuauacggcaacggcgucgugacuaagaaugggggauauguuucugguaucgcccaaaccaacgcagagcccgacggcccuacaccagagcuggaagaggaaauguucaaaaagaggaaucucacgauuauggauuugcaucccgggaguggaaaaacucguaaguaccugccugcuaucgugcgcgaggccauaaagcggagacucaggacccugauucuugcuccgacacgagucguggcagccgaaauggaggaggcccugaaaggcuugcccauccgguaucagaccacugcuacaaaguccgaacacaccggucgcgagaucguagaccuaaugugccaugcgacguuuacuaugagacugcucagcccagugaggguuccuaacuacaauuuaauuaucauggaugaagcacacuucacagaccccgccucuauagcugcccggggguauauuagcacccgagucggaaugggcgaggcagccgcuaucuuuaugaccgcgacuccaccuggcacagccgaagcauucccccaguccaacgcuccaauucaggaugaggagaaagacaucccggaaagaucauggaauagugggaacgaguggauaaccgacuuugugggaaagacagugugguucgucccuagcauuaaagccgguaacgauaucgcaaauugucugcgcaagaacggcaagaaaguaauccaacuuucuaggaagacuuuugacacggaauaccagaaaacccgucugaaugauugggacuucgugguuacaacugauauuuccgagaugggggccaacuuuaaggcugaccgggugaucgaucccagaaggugccucaaaccagucauuuugaccgacggacccgagcgcgugauacuggccggcccuaugccaguuacagcggcaucagccgcucagcgaagaggucggguggggaggaauccccagaaggaaaacgaucaauacaucuucaccggccagccucucaauaacgacgaggaucaugcccacuggacugaagcuaagaugcugcuugacaauauuaacacgccggagggaaucaucccagcacuauucgaacccgagcgcgagaaaagugccgcuauugacggcgaauaucgucugaagggggagagcagaaaaaccuuugucgaauugaugcggaggggagauuuaccuguguggcuggcccacaagguagcauccgaggguauaaaauacacagaccgcaaguggugcuucgauggcgaacgaaauaaccagauccucgaggagaauauggacguggaaauuuggacuaaagagggggaaagaaagaagcugcggcccagguggcuugaugcgcgcaccuauucugacccacuggcccucaaagaguuuaaggauuucgcugccggaagaaaaucgaucgcauuggaccugguuacagaaauuggcagggucccuagccaucuagcuuaccggacccguaacgcccuggauaaucucgugaugcuucacacuucagagcauggugggcgcgcauaucgacacgccguggaggaacugcccgagacaauggaaacguuauugcugcucggccugaugauccuucugaccggaggcgcuaugcucuuuuugauauccgggaagggaaucgguaaaacuaguauuggccugaucugugucauuguuucuagcgggauguuauggauggcggacgugccacuacaguggaucgccuccgcaauaguacuggaguucuuuaugauggugcuccuuauuccugagccggaaaagcaaagaacaccccaggauaaccagcuggcuuacgucgugaucggaauuuugacccuggccgccaucguugcagcuaaugagaugggccuccuggaaaccacaaagagggaccuugguaugucaaaagagccagggguggucucuccuacuagcuaucucgauguagaccugcaccccgccagugcguggacguuguacgcuguggccaccacaguuauaacuccaaugcugcggcauaccaucgaaaacuccacagcaaacgugagcuuagccgcuauugcaaaucaagccgucgugcuaaugggccuggacaagggauggccuaucucuaaaauggaucucggcgucccccuucuggcguuggggugcuacucacaggugaacccgcugacccucacugcugccguucugcuuuuagugacgcacuaugcaauuaucggaccaggccugcaggccaaggcuacacgcgaggcccagaaaagaaccgcagcugguauaaugaagaauccuacuguagacgggauuaugaccaucgaucucgaccccgugaucuacgauuccaaguucgagaaacaauugggacaggucaugcugcuaguucugugugccgugcagcuccuucugaugaggacaaguugggcguugugcgaagcccugacucucgcaaccggcccaauuacaacgcugugggaggguagccccggcaaguuuuggaacaccacuaucgcugucucgauggccaauauauuccgggggucuuauuuagcaggagcuggccuugccuuuuccauuaugaaaagcguggggacaggacgaagaggcaccgguucacagggggaaacucugggagagaaguggaaaaagaagcucaaccaacuaagucgcaaagaauucgaccuguacaagaaaucuggcaucacagagguagauaggaccgaggccaaggaagguuugaaacggggcgagacgacccaucacgcggugucccgugggagcgcuaagcugcagugguuuguugaaagaaauauggugauuccugagggaagggucaucgaccucggcugugggcgcggaggcuggucauauuacugcgcaggucuuaaaaaggugacagaaguccggggguauacuaagggaggcccgggccaugaggagcccgugccaaugaguaccuacggguggaacauaguuaaacugaugagcggaaaggauguauucuacuugccucccgaaaaaugugacacacugcucugcgauaucggugaguccucuccuagcccaacuguggaagagucccgaaccauuagagucuuaaagaugguggagcccuggcugaaaaauaaccaguucuguaucaagguucuuaauccuuauaugccaacagugauugaacaccuggagaggcuacagcgcaaguacggcgggaugcucguccggaacccccugucaagaaauucuacccacgaaauguauuggaucaguaacggaacuggcaauauugugucgagcguaaacauggugucccguuugcugcucaacagguuuacgaugacacaucggcgcccgaccaucgagaaagacguugaucuuggugccgggacucgacacgucaaugcugaaccugagaccccaaacauggacgugauaggagagagaauuaagaggaucaaagaagagcauucuucaacauggcacuacgacgaugaaaaucccuauaagacgugggccuaccacggcagcuaugaggugaaagcaaccggcuccgccaguucuaugaucaacggggucguuaagcuguuaacuaagccuugggacgugguaccaauggugacacaaauggcuaugaccgauacuacacccuucggacagcagcgggucuuuaaagaaaagguggacacccgcacaccgagaccuaugcccgguacuaggaaaguuauggagauuaccgcggaguggcuguggcgaacguugggccggaauaagaaaccacgucucugcaccagagaagaguucacaaagaaggugcgcacuaacgccgcaaugggggcugucuuuaccgaagagaaucaaugggauagcgccagggcagccguggaagacgaggaguucuggaaacugguagaucgggaaagagagcuacauaagcuuggaaaauguggcucaugcguuuacaacaugauggguaagcgcgaaaaaaagcugggggaguuuggaaaagcuaagggcuccagggccauaugguacauguggcucggcgcgcgauaucuggaguucgaagcauugggguuucugaaugaggaccacugguucagucgggaaaacagcuacucuggaguggagggugaaggccuccauaagcuuggguauauccugagagauauuuccaaaaucccuggaggcgccauguacgcugacgauacagccgguugggacacuaggauuaccgaggacgauuuacacaaugaggaaaagaucacgcagcagauggaccccgagcaucgccagcuggcaaacgcuauauuuaaauugacauaucaaaauaaggucgugaaagugcagcguccaacccccaaggggacugucauggauaucauuucacggaaggaccagagaggaagcggccagguuggcacauacgggcucaacaccuucacuaauauggaagcccaacuggugaggcagauggagggagaagguguacuaucgaaagcugaucuugagaacccucaccugcucgagaagaaaaucacccaguggcuggaaacaaagggcguggagcgcuugaaacgaauggccauuucuggggacgauugcgucgugaagccaaucgacgaucgguuugcaaacgcguuacuggcccucaaugacaugggaaagguuagaaaagauauaccgcaguggcaacccaguaagggcuggcacgacuggcagcaggugccuuucuguucccaucacuuccaugaacuuauuaugaaagaugguaggaagcuggucgugccaugccgcccccaggacgagcuaaucgggagagcucggaucagccaaggagccggcuggucacugaaagaaacggcaugucucggcaaggcuuaugcccagaugugguccuugauguacuuucacaggcgugaccugcgacuugcaucuaacgccauuugcagcgcgguaccuguucacuggauaccaaccagucgcacuacaugguccauccaugcucaccaucaguggaugaccacugaggauaugcugacaguguggaauagagucuggauugaggacaaccccuggauggaagauaagaccccugugacgacaugggaggacaucccguaccucgggaaacgggaagaucaaugguguggaagcuuaauuggucugaccucuagggccacuugggcacagaauaucuugaccgccauacagcagguucgcucacugaucggcgacgaggaguuccucgauuauaugccaaguaugaagagauuucggaaagaagaggaauccgagggggcuauuugguga

SEQ ID NO: 15598 - RNA, 9873 nt, Artificial Sequence
  derived and/or modified CDS sequence (opt3) from DENV-3__FJ898456__SS-prME
accagccugugccucaugaugaugcuucccgccacccuggcuuuccacuugacuucccgagacggagagccuaggaugaucguggggaagaacgaacggggaaaaucuuuacuguuuaagacggcaucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcauucuggagcaggggaaacgcacguuaacaccccagccaauggagcugaaguauaguuggaagacuuggggaaaagcgaagaucgugacagccgaaacccaaaauuccagcuuuauuaucgauggcccuaacacacccgagugcccaucugcuucaagagcauggaacguaugggaagucgaggacuacgguuucgggguguuuacuaccaauauauggcuuaaauugagggaaauguauacgcagcucugugaccaccggcugaugagugccgcuguuaaggaugagcgcgccgugcacgcagacaugggauacuggaucgagagccagaaaaacggcuccuggaagcuagaaaaggcgucucugauugaggucaaaacaugcaccuggcccaagucgcauacucucuggagcaauggugugcuggaauccgauaugaucauuccuaaaucacuugccggcccaaucagucagcacaacuacagaccgggguaucauacccaaacagcuggacccuggcacuugggcaagcuggaguuagacuucaauuacugcgaggggacuaccguugugauaacagaaaacuguggaacgaggggcccuucucuccguaccacuacaguaagcgguaaacugauucacgaguggugcugucgguccugcacccuuccaccccugcgauauaugggggaagauggauguugguacggcauggagaucagaccuaucaaugaaaaggaggagaacauggucaagucauuggugagcgccgguucuggcaaagcagacaauuuuacuaugggggugcucugccuggcuauuuucuucgaagaggucaugaggggaaaguuuggcaaaaagcauaugaucgccggggcacuauucacauuuguucugcuccuguccggacagauuaccuggcgcgauauggcccacacgcuuauaaugaucggcaguaacgcuagcgaccggauggguaugggggugacuuauuuggcgcugauugccaccuucaaaauccagccauuuuuagcacucggauucuuucugagaaaacuuacaucuagggaaaaucugcuacucggcguaggccuggcuauggccaccacuuugcaacugcccgaggauauugaacagauggccaacgggaucgcuuuaggacucauggcacugaaacuuauaacacaguucgagaccuaccagcuguggacagccuuggugucccucauguguucaaauacuaucuuuacccugacggucgcguggcgcacagcuacccuaauucuggccgugaucagucuucucccgguuugccaaagcucguccaugcgaaaaacugacuggcugccuaugaccguggcagccaugggugucccaucuuugccccuguucauuuuuagcuuaaaggauacacucaaacggcguucauggccucugaacgagggcgugauggcuguugggcuugugaguauccuggcauccucuuucuugagaaaugacguccccauggccggaccacucguagcgggcggucugcuaauagcuuguuaugugauuacugggaccagcgccgaucugacgguugaaaaggcagccgacgugacaugggaggaagaggcugaacagaccggagucucccauaaccuuaugaucacuguggacgaugacggcacaaugaggaucaaagaugacgagaccgagaacauucucacuguacuguugaagacagccuuacugauagugucaggcaucuuuccuuacagcauucccgcaacccuccuggucuggcacacguggcagaaacagacucaacgcagugggguucuuugggaugugccaucuccgccugaaacccagaaggcugagcuggaagagggaguguaccggaucaagcagcaggguauuuucggcaaaacacaagucggggugggaguucagaaggagggcguauuccauaccauguggcacgugacaagaggugccgucuugacucacaaugggaaaaggcuagaacccaacugggcgaaugugaagaaagaccugaucuccuauggaggcggcuggaagcucagcgcccaguggcaaaagggggaggaaguucaggugauagcagucgagccaggcaagaaccccaagucguuucagaccaugccugguaucuuccagacgacaacuggcgaaauuggggcuaucgcccuggauuuuaaaccaggaaccucaggcucucccauuaucaaucgagaggguaaggugguagggcuuuacggaaacggcgucgugacuaagaauggcggguauguuaguggaauagcucaaaccaacgcagagccugacgguccgacuccagaauuagaggaagagauguucaagaagcgcaaucugaccauuauggaucuccaucccggcuccgggaaaacacggaaguacuugccugccaucgugagagaagccaucaaaaggcgucugcgcacgcucauucuggcuccaacucgggucguggcggcagagauggaggaagcccuuaagggacugcccaucagauaucagaccacagcuaccaaaagcgagcacacuggcagggaaauaguugacuugaugugccaugccacauuuaccaugcgacuacugucuccugugcgggucccgaacuacaaucucauugugauggaugaggcacacuucacggaccccgccagcaucgcugcgcgcgguuauauuuccacuagaguagggaugggagaagccgcagcuaucuuuaugacagccaccccaccuggcaccgcagaugccuucccccagucaaacgcuccaauacaggacgaggagagggacauuccugaacggaguuggaauagcggcaacgaguggaucacugauuuugccgggaagacagugugguucguucccucuaucaaggcgggaaaugacauugcaaacuguuuaagaaagaacgguaagaaagucauccaacuguccagaaagaccuuuaauacagaauaccagaaaacuaaacuuaacgauugggacuucguggugacgaccgauauuucagagaugggcgccaauuucaaggcugaccgcgucauagauccaaggcguugccugaaaccgguaauccucacagacgggccugagcgggugauuuuggccggacccaugccaguuacuguggcuagugcagcccagagaaggggccgcgucggucgaaacccccagaaggaaaaugaucaauacaucuuuaccgggcagccucugaacaaugacgaggaucaugcucacuggacagaagccaaaaugcuccuggacaacaucaauaccccagagggcauuauacccgcacuuuucgaaccugagagagagaaaagcgcggccaucgacggagaauaucggcuaaaaggcgaauccaggaagacuuuuguggaacugaugcgccguggggauuugccgguuugguuagcucacaaaguggccucugagggaauuaaguacacggacagaaaguggugcuucgauggugaacggaacaaucagauccuggaggagaacauggacgucgaaauuuggaccaaagagggcgaaaagaaaaagcucaggccacgcuggcuggaugcacgaacauauucggacccccuugcucugaaagaguuuaaggauuucgccgcagggagaaagagcaucgcccucgacuuggugacugaaauaggacggguaccuucacaucuggcucacaggacccgcaaugcgcuagauaaccuggugaugcuccauacauccgagcacggcgguagagccuacaggcacgcaguugaggaacuucccgagaccauggaaacucuguuauugcuggggcucaugauccugcuuacaggcggagcuaugcuguuucucauuaguggcaaagggaucggaaagacgucuauugguuugaucugugucguggccagcuccggcaugcuguggauggccgacgugccauuacaguggauagcaucagcuauuguccuagaguucuuuaugaugguucugcucaucccugagcccgaaaaacaacggaccccacaggauaaucagcuugccuaugugguaauugggauccugacuuuggcggcuauaguggccgcaaacgagaugggacugcucgaaacaaccaagcgugaccugggcaugucuaaagagccuggugucgugagcccgaccaguuaccuugauguugaccuccaucccgccuccgcuuggacacuguaugcaguggccacuacggucaucaccccaauguugcgccacacaauugaaaauagcacugcgaacguaucucuggcugccaucgcaaaccaagccgugguuuuaauggggcuagacaagggcuggccuauuucaaagauggaucugggagugccccuccuugcucugggcugcuacucccaggucaauccauugacccugacagccgcagugcuccugcuugucacccauuacgcuaucauagggccuggauuacaggccaaagcgacucgagaggcccagaagagaacggcagcuggcauuaugaaaaaccccacaguggacgguaucaugaccaucgaucuggacccgguuauuuaugauaguaaguucgagaaacaacucggacaggugauguugcugguacuaugugccgugcagcugcuccuuaugaggacuagcugggcauuuugcgaagcucugaccuuggccacaggaccaaucacuacccugugggagggcucgccugguaaguucuggaauacaacgauagccgucucuauggcgaacauuuuucggggcuccuaccucgcuggggcaggacuggccuucagcaucaugaagucaguuggcaccgggaaacgcggaacuggcagucagggugaaacauuaggggagaaguggaaaaagaaacuuaaucaacugucuagaaaggaguucgaccucuauaaaaaguccggaauuaccgagguggagaggacugaagcuaaggagggccuaaaacggggugaaaucacacaccaugccgucagccgaggcucagcaaagcugcagugguuuguggagagaaacaugguaauacccgaagggcgcgugaucgauuugggauguggcagaggcggguggaguuacuauugcgccgggcugaaaaagguuaccgaggugcgggguuacacgaaagggggaccaggccacgaggaacccgucccuaugagcaccuauggcuggaauauugugaagcucauguccgggaaggacgucuucuaccuuccgcccgagaaaugugauacacuguugugcgacaucggagaaucuagcccauccccuacuguggaggagucacguaccauuagaguucugaagaugguagaacccuggcucaaaaacaaucaguuuuguaucaagguguuaaacccuuacaugccaacagucauugagcaccuggaaaggcuucagcgcaaacaugguggcaugcuggugcggaauccccuaucucgaaacaguacucacgagauguauuggaucucgaaugggaccggaaacauaguuagcuccgugaauauggucucuagacuccuguugaacagguucacaaugacccaucgccggccuacuauugaaaaggauguggaccugggcgcugguacgagacacguaaacgcggagccagagacacccaauauggaugugaucggggaacguaucaggcggauuaaggaggaacacucaagcaccuggcauuacgacgacgagaacccguauaaaacuugggccuaccacggauccuaugaaguuaaggcaaccggcagugcuucuagcaugauaaauggcgucgugaaacuccuuacaaagccuugggauguggucccaaugguuacgcaaauggccaugaccgacacuacacccuuugggcagcagcgcguguucaaagagaagguagauacccgaacuccuagaccaaugcccggaacaaggaaggugauggagaucaccgcagaauggcuguggcggacauuaggucgcaacaaaagaccgaggcugugcacucgagaggaauuuauuaagaaaguccggaccaaugccgcuaugggcgccguguucacggaggaaaaccaaugggacucagcgcgugcagccguugaggaugaggaauuuuggaaguugguggacagagagcgcgaacuccauaaacuggggaaguguggauccugcgucuacaauaugaugggcaaaagggagaagaagcuaggugaguucgggaaagcuaagggaagucgggccaucugguauauguggcuuggcgcaagauaccuggaauuugaggcucucggcuuccugaacgaagaucacugguuuagccgcgaaaauucuuacuccgggguggaaggagaggguuugcauaaacugggcuauauucucagggacaucucaaagauaccugggggagccauguacgcugaugacaccgccggcugggauacacgaaucacugaggacgaccuucacaacgaagagaaaauuacccagcagauggaucccgaacaccggagacuggcaaaugcgaucuucaaguuaacauaucagaacaagguaguuaaagugcaaaggccaacuccuaaggguaccgucauggacauuaucagccgcaaagaucagcgugggucgggacaggugggcacguacggccugaauacauucaccaacauggaggcccaguugauacggcaaauggaaggggagggagugcucucuaaggcugaccuggagaauccccaucuacuugagaaaaaggucacucaguggcuggagacaaaggguguugaaagacucaaaaggauggccauuaguggcgaugacugcgugguaaagccaaucgaugaccgcuuugcaaacgcucuguuggccuuaaacgauauggggaaagugcgaaaggacaucccccaguggcagccuuccaaaggauggcacgauuggcaacaggucccauucuguagccaucacuuucacgagcugauuaugaaggacggccggaagcucgugguuccgugcagaccccaggaugaacuuauagguagggcacgcaucucacagggggccggauggucccugagagagaccgcgugucuaggcaaggcuuaugcccaaaugugggcacugauguacuuccaucggagggaccuccguuuggccucuaaugcuauuugcagcgccgugccuguccacugggugccaacaagucgaaccacaugguccauccaugcacaccaucaguggaugacgaccgaggacaugcugacuguauggaaccgcguuuggauugaagauaaucccuggauggaggacaagacaccugugaccacuugggaagaugucccauaucuuggcaaaagagaggaccaguggugugggagccugaucggacucgcuucucgggccacaugggcgcaaaacauauuaaccgcuauccaacaggugaggucacugauugguaaugaggaauuuuuggauuacaugcccaguaugaagcgcuucagaaaagaggaagaguccgaaggcgccaucugguga

SEQ ID NO: 15599 - RNA, 9873 nt, Artificial Sequence
  derived and/or modified CDS sequence (opt3) from DENV-3__JN697379__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacauaucaccgaaguugagccggaagacauugauugcugguguaaccugacaaguaccugggugacuuaugggacaugcaaucaagcgggagagcaccgccgagacaagcguagcgucgcucuugcaccccaugugggcaugggucuggauaccagaacgcaaacuuggauguccgcagagggggccuggaggcaggucgaaaaaguggagaccugggcuuugcggcacccuggauucacaauccucgcacuguuucuggcccauuacauuggcacuucucucacccagaagguugugaucuucauauuacugaugcuugucacaccaucgaugaccaugcgcugugugggcguagggaacagagacuuuguugaaggauugucaggugcuacguggguggaugucgugcuggagcacggcgggugcgugacuacaauggccaagaauaaacccacccuagacaucgagcuccagaagacugaagcgacacaacuggcaacccuuaggaaacuguguauugagggaaagaucacgaacauuaccacagauagccggugcccuacucagggcgaagccaucuugccagaggaacaggaccagaauuaugucuguaaacacaccuacguugaucgcgguugggggaacggaugcggccucuucggcaaggggagucuggugacaugcgcuaaguuucaauguuuagaguccauagagggaaaaguagugcagcaugaaaaucugaaguauacugucauuaucaccgugcacacaggugaccagcaucagguuggcaacgagacccaaggggugacugccgaaauuacgucucaggcaagcacagcugaggucauccuccccgaauacggaacccuuggccuggagugcuccccucgaacugguuuggacuucaaugagaugauccuacugaccaugaaaaacaaggccuggauggugcacagacagugguuuuucgaucucccacugccguggacaucaggggcgaccacugaaacacccacguggaauaggaaagagcuucugguaaccuuuaagaacgcccacgccaagaaacaagaaguuguggucuugggcagucaggagggagcuaugcauacugcccucacaggcgcuaccgaaauucagacaagcgggggaacuucuauauucgccggucaccugaagugucgguuaaaaauggacaagcugaaacuaaagggcauguccuaugcaaugugccucaauaccuuugugcugaaaaaggaggucucagagacgcagcaugggaccauccuuauuaagguggaauacaaaggagaggaugccccuuguaagaucccauucagcacagaagacggccaagguaaagcucacaacgggcguuugauaacugcgaaccccguugugaccaagaaagaggagccuguaaauauugaagcagagccacccuucggcgaaaguaacaucgucaucggaauuggcgauaaggcccugaagaucaauugguaccgcaaagggucuuccauuggaaagauguuugaggcuacagccagaggugcaaggcggauggccauacucggcgacacugcuugggauuucgggagcgugggaggcguucugaacucgcuugguaaaauggugcaucagaucuuugggucugccuauaccgcacuguucuccggcgucucauggauuaugaagaucggaaucggcguguugcucacguggauugggcugaauaguaaaaacacaagcauguccuuuucuugcauagcgaucggaauuaucaccuuauaccugggcguagugguucaggcugacauggguugugucauuaauuggaaggggaaggaacuaaaaugcggaagcggcaucuucgugacuaacgaggugcacacauggaccgagcaguauaaguuucaagccgauucaccgaaacgacucgcaacugccauagcuggugccugggaaaauggcgucugugggauccgcaguaccacaagaauggagaaccugcuuuggaagcagauugcaaaugaauugaacuacauccugugggagaauaacauuaaacucacgguuguggugggagacaucaccggcguacuggaacaggggaagaggacuuuaacaccucagcccauggagcugaaauauuccuggaagaccuggggaaaggcuaaaauagucacagccgagacucaaaauagcucuuucauuaucgauggcccaucaaccccugaaugccccagugcgagccgggccuggaacgugugggagguugaagacuacgguuuugggguguucacgacaaacauuuggcuuaaguugcgcgaggucuauacccagcucugugaccacagacugauguccgcugcagugaaagaugaaagggccguucaugcugacaugggauacuggaucgagucucagaagaauggcucguggaaacuagagaaggccagccugauagaagugaagacuugcaccuggccaaaaucccacacacucuggucaaacgguguacuggagagugauaugaucauucccaagucucuugcaggcccuaucagccagcauaaucaccguccaggguaccacacucaaaccgcgggaccguggcauuugggcaaacuggaauuagacuuuaacuauugcgaggggacaacggucgugauuuccgagaauuguggaacccggggccccucacuccgaacuacaaccgugagcgguaagcugauccacgaauggugcuguagaucuugcacucuuccuccacugagguacaugggggaggauggauguugguauggcauggaaauacgccccauuaacgagaaagaagagaauauggucaaguccuuggccagugcugguagcggcaagguugacaacuucacaaugggggugcucugccuggccauccuauuugaggaaguaaugcggggaaaauucggcaagaaacauaugaucgcaggggugcuguucaccuuuguccuccugcuuucuggacagauuacguggagagauauggcucacacuuugaucaugauuggcuccaaugugucagacaggauggguauggggguuaccuaccuggccuuaauagcaacauucaagauccagccuuuucucgcccugggauucuuucuucgcaaacugaccagucgagagaaccuacuccugggcgugggcuuggcuauggcggccacucugcgguuaccagaagauauugagcaaauggcaaaugggaucgcucucggacugauggcccuuaagcugauuacacaguucgaaaccuaucaguuguggacagcccucgucagccugacuuguucgaacaccaucuuuacgcuaacaguggcuuggcguaccgcaacucugauacuugccgguaucucccuccugcccguuugccagucuagcucaaugagaaagaccgacugguugccgaugacaguggcggcuaugggcgucccuccacugcccuuauucauuuuuagucucaaagauacucugaagaggcgcuccuggccucuuaaugaggggguaauggccgugggacugguuucuaucuuggcaagcucccuccugcggaacgacgugcccauggccggcccucuaguagcuggugggcugcuuauugcauguuacgugaucaccggaacgucagccgaucucacaguagagaaagcggcugacgugaccugggaagaggaagccgagcaaacuggcgucagccauaaucugaugauaacaguugacgaugacggcaccaugagaauuaaggaugacgaaacugagaacaucuugacaguguuacugaaaaccgcacuccugaucgugagugggauuuucccauauucuauacccgccacgcuucuggucuggcacacuuggcagaagcagacccagagguccggaguguugugggauguuccaagcccgccugagacacaaaaagcugaacuagaggaagguguauaccgaaucaagcagcagggcauuuuugggaagacccaggugggagucggcgugcaaaaagaggguguuuuccacacaauguggcaugugacucgcggggccguccugacccacaacggaaagcggcucgagcccaauugggcaucggugaaaaaggaccugaucucauacggcggcggguggagacuuucugcucaguggcagaaaggagaagagguacaagucauugccguggaaccagguaagaaccccaagaauuuucagacgaugccuggcaucuuccagacaacuaccggggagauaggagcgaucgccuuagauuucaaaccaggcacaagugguucccccauuaucaacagggaagggaagguugugggacuguauggcaauggcgucgugaccaaaaacgggggauacguuagcgguauugcacagacuaaugcugagccugacggcccgaccccagagcucgaagaggaaauguuuaagaaacguaacuugacaaucauggaucugcaucccgggucuggaaagacgcgcaaguaucucccugccauagugcgggaggcuauuaaaagaaggcugcgaacucuuauccuggcaccaacccgggucguggccgccgaaauggaggaggcuuugaagggccuacccauccgcuaccaaacaaccgcgacuaaaagcgaacacacagguagagagauuguagaccugaugugccaugcaaccuucacgaugaggcucuuauccccugugcggguuccgaauuauaaccugaucauaauggaugaagcccacuuuacugaccccgcuucaauugccgcacgaggguacaucaguacaagagucggaaugggcgaggccgcugcgauuuucaugaccgccaccccaccuggcacugcagaugcuuuuccccagagcaaugccccaauccaggacgaggaacgcgacauaccugagaggucuuggaacuccgggaaugaauggauuacagauuucgugggaaagaccgugugguuuguccccucaaucaaagcagguaacgacaucgccaauugucuucguaagaacggcaagaaaguaauucagcugagucggaagacauucgauacugaguaucagaaaacgaagcucaacgacugggauuuugugguuaccacagacaucagcgaaaugggggcuaauuucaaagccgauagagugauugacccaaggcgcugcuugaagccggucauacugacugauggaccugagcgagugauccucgcgggccccaugccaguuaccguggcauccgccgcucagagacgggguagggucgggcgcaacccccagaaggagaaugaccaguacauuuuuaugggccaaccucugaacaaugaugaagaccacgcccauuggacagaggcuaaaaugcuucuagacaacaucaauaccccagaaggaaucauucccgcacuguucgagccugaacgugagaagucugccgcuauagauggcgaguacagauugaaaggggaaucgcggaagacuuucguggaguuaaugaggcgcggagaccugccgguauggcucgcccacaaaguggcaagcgaagguaucaaguauacggaucgaaaauggugcuuugacggcgagagaaacaaucagauucuggaagagaacauggauguugagaucuggaccaaggaaggggagaagaagaaacuucggccaagguggcuggacgcgcgcacauacucagauccccucgccuugaaagaguucaaagacuuugcugccggaagaaaauccauugcacuggaucuagucacugagaucggcagggugccuagucaucuggcucaccggacccguaaugcccucgacaaccuugugaugcugcacacaucugaacauggugggcgcgcauaucgacacgccgucgaggaguuacccgaaaccauggagacuuugcugcuccugggccuuaugauacugcucacaggaggcgcuauguuguuccugaucagcgggaagggaauugguaagacguccaucggcuuaauuuguguuaucgcgucaucugggaugcuauggauggccgaugugccacugcaguggauagcaagcgcuauuguacucgaauuuuucaugauggugcuucugaucccugagcccgagaaacagagaaccccacaagacaaucaguuggccuacgucgugauuggaauccugacucucgccgcaauaguugcugccaacgaaaugggccugcuugagacaaccaagagggaucucgguaugaguaaagaaccugggguggucuccccgaccagcuaucuggacguagacuugcaucccgcgucugcuuggacacuguacgccguggcaacuacgguuaucaccccaauguuacggcacacaauugaaaauucaacugccaacgugucccuagcugcaaucgccaaucaggcggucgugcugaugggccucgauaagggauggccuauuaguaaaauggaccuuggcgucccccuguuggcucuggggugcuauagccaagugaacccacucacccuggccgcagccguucuuuuacuggugacacauuacgcuaucauaggaccuggccuccaggccaaggcaacccgcgaagcucagaagagaacugccgcggguauuaugaaaaaccccacgguagaugggaucaugacaaucgacuuggauccggugauuuacgacucgaaguuugagaaacagcugggacaagucaugcuacugguucucugugccgugcagcuucuguugaugaggaccucuugggcacugugcgagguccucacucuggcuaccggcccaaucacaacuuuaugggaagguuccccuggcaaguucuggaauaccacaauagccgugagcauggcaaacauuuuucgggggucauaucuugcuggagccggccuggccuucaguaucaugaaaucuguagggacgggaaagcgaggcaccgguucccagggggagacucucggagaaaaguggaaaaagaaacuaaaucagcugagcagaaaggaguuugauuuguacaaaaagucaggcauuacagaaguggaccgcaccgaggcgaaagagggucugaagaggggcgaaaucacucaccacgcuguuagucgggggagcgcaaagcuccaaugguucguggagcguaacauggucauacccgaaggaagagugaucgaucuuggcugugggaggggaggcugguccuauuacugcgccggucugaaaaaggucacagaggugcgcggguauaccaaaggaggcccaggccaugaggaacccguuccuaugucuacguacggguggaauauuguaaaguugaugagcggaaaagacguguuuuaucugccgcccgagaagugugauacccucuuaugcgacaucggugaauccucaccaucuccuacagucgaggaaagucggacuauucgagugcugaagaugguugagcccuggcuuaaaaacaaucaguucuguaucaaggugcugaacccuuacaugccaaccgucauugagcaccuagaaagacuccagaggaaacauggcgggaugcuggugcgcaaucccuugucgcggaacagcacacacgagauguacuggaucuccaauggaacuggcaacauaguaucuucagugaauaugguuagcagacugcuccuuaaccguuucaccaugacacacaggcggccuaccauugaaaaggaugucgaccugggugcugggacucgccaugugaaugccgagccagaaacgcccaacauggacgugaucggagagcgaaucaaaagaauuaaggaggaacacuccaguacauggcauuaugaugacgagaacccguacaagaccugggcauaucacggcucuuacgaagucaaagccacuggcagcgcuucauccaugauaaaugggguugugaaguuacugaccaaaccuugggauguagugccaauggucacacagauggcgaugacggacaccacucccuuuggacaacagaggguguucaaggagaaaguugauacacggaccccucgcccaaugcccgguacuagaaaggugauggaaaucacagccgagugguuguggaggacccucggccgaaacaagcggccgcgucugugcacaagagaggaauuuacuaaaaagguccgcaccaaugcagcuaugggggccguguucacggaggaaaaccagugggacagugcaagggccgcuguagaggaugaagaguuuuggaagcuaguugaccgggagagagaacuucauaagcugggaaaauguggcagcugcguguauaauaugauggguaagcgcgagaaaaagcucggggaguucggaaaggccaaaggcucuagggcgauuugguacauguggcugggcgcacgauauuuggaguuugaggcccugggguuccucaacgaagaucacugguuuucccgggaaaauucauacagcggagucgaaggugagggccuucacaagcugggguacaucuuaagagacauuucgaaaaucccuggaggcgcuauguaugccgaugacaccgcagguugggacacaaggauaacugaagaugaccugcauaacgaggagaagaucacccaacagauggaucccgaacaccgccaguuggcuaaugccauuuucaaacucacauaccagaacaagguggugaagguccaacguccaacuccuaaagggaccguuauggacaucauuucucggaaggaucagagaggaaguggccaggugggcacguaugggcugaauacauuuaccaacauggaggcucagcuaaucaggcaaauggaaggagaggguguacuuuccaaagccgaccuggaaaauccccauccacucgagaagaaaauaacucaguggcuggagacaaagggcguggaacgcuugaagcgaauggcaauuagcggggaugacugcgucgugaaacccaucgaugaccgguucgcgaacgccuuacuggcucucaaugauaugggaaagguuagaaaagacaucccucaguggcagccaucaaagggcuggcacgauuggcaacaggugccguuuuguucccaccauuuccacgagcuuauuaugaaagacgguaggaagcuggucgugcccugccgcccucaggacgaacuaauagggagagcccggaucucucagggagcaggcuggagccugagggagaccgcuugucucggcaaggccuacgcacaaauguggacuuugauguauuuccaucgucgagaucugcgccuugccaguaacgcgauuugcuccgcuguaccaguucacugggugcccaccagcagaacaacguggucuauccaugcccaccaccaguggaugaccacugaagacaugcugacagucuggaaccggguguggauugaggauaauccuuggauggaggacaaaaccccaguuacuacaugggaagaugugcccuaccucgggaagagggaggaccagugguguggaucauuaaucggucugaccagucgcgcaacgugggcccaaaacauauugacagcuauccagcaggucagaucccugauuggcaaugaagaguuucucgauuauaugccuagcaugaaacgguucaggaaggaggaagagucugaaggggccaucugguga

SEQ ID NO: 15600 - RNA, 9873 nt, Artificial Sequence
  derived and/or modified CDS sequence (opt3) from DENV-3__JQ045687__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugguugcggaaguggagccggaagacaucgauugcugguguaaccuuaccaguacauggguaaccuaugggacuugcaaucaggcuggagagcaucgccgagacaagcguagcguggcccuggcaccccacgucggcauggguuuggauacaagaacccaaacguggauguccgccgagggggcuuggaggcagguggaaaaaguugagacuugggcacuccggcauccuggauucaccauucuggcccuguuucucgcucacuacaucggcacaucuuuaacucagaagguggucauuuucauccugcuuauguuggugaccccaucgaugacaaugcgcuguguaggcguugggaacagagacuuuguggaaggacugucaggugccaccugggucgauguggugcuagagcauggcgggugcgucacgacuauggcgaagaauaaacccacacucgacauagagcugcagaagaccgaagcaacucaacuugccacacugaggaaauuguguaucgagggaaagauuaccaacaucacgaccgauagccggugcccuacacagggcgaagcuauucucccagaggaacaggaccagaauuauguuuguaaacacacuuacguggaucgcgguugggggaacggaugcggccuguucggcaaggggaguuuaguaaccugcgccaaguuucaaugucuggagcccaucgagggaaaagugguccaguaugaaaaucucaaguacacagugauaauuacuguucacaccggugaccagcaucaggugggcaacgacacacaaggggucaccguggagaucacuccucaggcauccacgguagaagcuguucuuccagaguauggaacacugggcuuggaaugcucuccgcgaaccggucuagauuucaaugagaugauucugcucacuaugaaaaacaaggccuggauggugcacagacagugguuuuucgaccugccccuuccuuggaccagcggggcgacaaccgagacuccaacauggaauaaaaaggaacuguuggucacguuuaaaaacgcccaugcaaagaagcaagagguggucgugcucggcucccaggaaggagcuaugcacaccgcccugacuggcgcuacagagauccagaauucagggggaaccaguaucuucgccggucacuuaaaauguaggcugaagauggauaaacuagaacucaagggcaugagcuacgcaaugugccugaacacauuuguucuuaaaaaggaggugucugagacucagcaugggaccauuuugauaaagguagaauacaaaggagaggacgcccccuguaagaucccuuucuccacggaagauggccaagguaaagcucacaacgggcggcugauuaccgcgaauccagucgugacaaagaaagaggagcccguuaacaucgaagcagagccgccuuucggcgaaucaaauauagugauuggaaucggcgacaaggcccucaagaucaacugguauaaaaaggggagcaguauuggaaaaauguuugaggcuacugcccguggugcacgcagaauggccauccugggcgauaccgcuugggacuucgggucugucggaggcgugcuuaauucccuggguaagaugguacaucagauuuuugggagcgccuacacagcauuguucucgggcgugucuuggauaaugaaaaucggaauuggcguucuccugacuuggaucggguuaaacuccaagaauaccucaaugaguuuuagcugcaucgucauuggaauaaucacgcuguaucuaggcgcgguggugcaggcugauauggguugugccauuaacuggaaggggaaagaacucaagugcggauccggcaucuucgucacaaaugagguucacaccuggacugagcaguacaaauuucaagcagacucucccaagaggcuggccacagcuauugccggugcaugggaaaacggcgugugugggauccggagcaccacucgaauggagaaucuuuuguggaaacagauagcuaacgaacugaauuauauccucugggagaacaauauuaagcugaccgugguagucggagauaucauuggcguguuagaacaggggaaacgcacacugacgccacagccuauggagcuuaaguacucauggaagaccuggggaaaagccaagaucguuacugcggagacacaaaacaguuccuucauaauugacggccccaacaccccagaaugccccagcgccucuagagcuuggaaugugugggaggucgaagacuaugguuuugggguguucacaacuaacaucugguugaaacucagggagguuuacacccagucaugugaucaucggcugaugagugcagccauuaaggacgaacgcgcugugcacgccgauaugggauacuggaucgagagccagaaaaauggcuccuggaagcuagagaaggcaucuuuuauagaaguaaaaacgugcacauggccuaagucgcacacccuguggagcaacgguguccucgaguccgacaugaucauuccaaaaucacuggcgggcccgaucagucagcauaaucacagacccggguaucauacucaaaccgccggaccuuggcaccuuggcaaguuggaacuggauuucaacuacugcgaggggacaacuguggugauuaccgagaauuguggaacaaggggcccaucuuuacguacgaccacugucagcgguaaacucauccacgaauggugcugucgguccugcacacugcccccucuucgauauaugggggaggacggauguugguacggcauggaaauaagaccaauuaacgagaaggaagagaauaugguuaagucacuggugagcgcugguucuggcaaaguagauaacuuuaccauggggguguugugccucgccauccuguucgaggaagucaugaggggaaaguucggcaaaaagcauaugaucgcaggggugcuauuuacuuucguucugcuccuguccggacagauuacauggcgcgacauggcucacacccuuaucaugauuggcaguaaugccagcgaucggauggguaugggggugacguauuuggcacugauagccacuuuuaaaauccagcccuucuuagcucucggauuuuuccugagaaagcuuaccucuagggagaaccugcuacucggcgucggccuggcgauggccacaaccuugcaacugccggaagacauugagcagauggcaaaugggaucgcuuuaggacucaugacucugaagcuuauuacacaguuugaaaccuaccagcuguggacagccuuggugucccucacuuguucaaacaccaucuucacgcugacaguugccuggcgcaccgcuacucuaauacuggcaggugugagucuucucccucugugccaaagcucguccaugcgaaaaaccgauugguugccaaugacagucgccgcgaugggcguacccccucugcccuuauuuaucuucucucucaaggacacuccaaaacggcguagcuggccucugaaugagggggugauggcuguuggacuugugucaauucuggccaguuccuugcucagaaacgauguccccauggcaggcccacugguggccggugggcuacugaucgcuuguuauguaauuaccggaacgucugcagaccuuacaguggagaaggccgcggacgucaccugggaagaggaagcugagcagacuggcguuagccauaaccucaugaucacaguggaugacgauggcaccaugaggauaaaagacgaugaaacugagaauauucugacaguguuguuaaagaccgcccugcucaucgucuccgggaucuuuccguacucaauuccugcaacgcugcuuguguggcacacuuggcagaaacagacccaacgcagcggaguucugugggacguacccaguccacccgagacacagaaggccgaauuggaggaagguguguaccggauaaagcagcagggcaucuucgggaaaacccaagucggagugggcguucagaaggaggguguguuucauacaauguggcacgucacuagaggggcugugcuaacccacaacggaaaaaggcuggagccuaauugggccucuguaaagaaagaucucauuuccuauggcggcggguggcgacugagcgcacaguggcaaaagggagaagagguccaggugaucgcuguugaaccagguaagaaccccaaaaauuuccagacgaugccuggcauuuuccagacaacuaccggggagaucggagccauagcgcuugacuuuaagccgggcacaucggguucaccaaucauuaaccgcgaagggaaaguggucggauuauacggcaauggcgugguuaccaagaacgggggauaugugucugguaucgcccaaacuaaugcagagcccgauggcccuaccccagagcuggaagaggaaauguucaaaaagcggaaccucacaacgauggacuugcaucccgggaguggaaagacuagaaaauaccugccugcuauugucagggaggccaucaagcgucgccuccggacccugauacuugcuccgacaagagugguagcagccgaaauggaggaggcccugaaaggcuugcccauuagguaucagaccacugcuacaaaguccgaacacaccggucgagagaucguggaucuaaugugccaugcgacguuuacuaugcggcugcucagcccaguucgcgucccuaauuacaacuuaaucauuauggacgaagcacacuucacagaucccgccucuaucgcugccagaggguauauaagcaccagggugggaaugggcgaggcagccgcuauuuuuaugaccgcgacuccaccuggcacagccgaagcauucccccaguccaaugcuccaauccaggacgaggagcgggacauuccggaacgaucauggaacagugggaaugaguggaucaccgauuuugugggaaaaacagucugguucguaccuagcauaaaggccgguaacgacauugcaaacugucugagaaagaauggcaaaaaggugauccaacuuucucgcaaaacuuuugauacggaauaccagaagaccaggcugaacgacugggauuucguugugacaacugacaucuccgagaugggggccaauuuuaaagcugaucgugucauugacccccggagaugccucaagccagugaucuugaccgauggacccgagaggguuauucuggccggcccuaugccagugacagcggcaucagccgcucagcgccgagguagagucgggcggaacccccagaaggaaaaugaccaauacauauucaccggccagccucucaacaaugaugaggaccaugcccacuggacugaagcuaaaaugcugcuugacaacaucaauacgccggagggaauuaucccagcacuauucgaacccgagagggagaagagugccgcuaucgauggcgaauaucgccugaaaggggagagccguaagaccuuuguggaauugaugagacggggagacuuaccuguauggcuggcccacaaaguggcauccgaggguauuaaguacacagauaggaaauggugcuucgacggcgaacgcaacaaucagauacucgaggagaacauggauguugaaaucuggacuaaggagggggaacgaaagaaacugagaccccgguggcuugacgcgaggaccuauucugauccacuggcccucaaggaguuuaaagacuucgcugccggacgcaagucgauugcauuggaucuggucacagaaaucggcagagugccuagccaucuagcuuacaggacccggaaugcccuggacaaccucgugaugcuucacacuucagagcauggugggcgugcauaucgccacgccgucgaggaacugcccgagacaauggaaacguuauugcugcucggccugaugauucuucugaccggaggcgcuaugcucuuuuugaucuccgggaaaggaauagguaagacuaguaucggccugauuuguguuaucgugucuagcgggauguuauggauggcggauguaccacuacaguggauugccuccgcaaucgugcuggaguucuuuaugaugguccuccuuauaccugagccggaaaagcaacgaacaccccaggacaaucagcuggcuuacgugguuauuggaaucuugacccuggccgccauuguggcagcuaacgagaugggccuccuggaaaccacaaaaagagaucuugguaugucaaaggagccaggggucguaucuccuacuagcuaucucgacguggaccugcaccccgccagugcguggacguuguacgcuguugccaccacagugaucacuccaaugcugaggcauaccauagaaaauuccacagcaaacgucagcuuagccgcuaucgcaaaccaagccgugguccuaaugggccuggauaaaggauggccuauuucuaagauggaccucggcgugccccuucuggcguuggggugcuacucacagguuaauccgcugacccucacugcugccgugcugcuuuuaguaacgcacuaugcaaucauuggaccaggccugcaggccaaagcuacacgggaggcccagaagcgcaccgcagcugguaucaugaagaacccuacuguggaugggauaaugaccauugaccucgaucccgucaucuacgacuccaaauucgagaagcaauugggacagguuaugcugcuagugcugugugccguccagcuccuucugaugagaacaaguugggcguugugcgaagcccugacucucgcaaccggcccaaucacaacgcugugggaggguagccccggcaaauuuuggaauaccacuauugcugugucgauggccaacaucuucagggggucuuauuuagcaggagcuggccuugccuuuuccauaaugaagagcguagggacaggacggcgaggcaccgguucacagggggaaacucugggagagaaauggaagaagaaacucaaucaacuaaguagaaaggaauucgaucuguacaaaaagucuggcauuacagagguggaccgcaccgaggccaaagaagguuugaagaggggcgagacgacccaucacgcgguuucccgggggagcgcuaaacugcagugguuuguggaacguaacauggucaucccugagggaagagugauugaucucggcugugggaggggaggcuggucauauuacugcgcaggucuuaagaaggucacagaagugcgcggguauacuaaaggaggcccgggccaugaggagcccguuccaaugaguaccuacggguggaauaucguaaagcugaugagcggaaaagacguguucuacuugccucccgaaaagugugauacacugcucugcgacauaggugaguccucuccuagcccaacugucgaagagucccggaccauccgaguguuaaaaaugguugagcccuggcugaagaacaaucaguucuguauuaaggugcuuaacccuuauaugccaacagucaucgaacaccuggagagacuacagaggaaauacggcgggaugcucgugcgcaauccccugucacggaacucuacccacgaaauguauuggauuaguaauggaacuggcaacaucguaucgagcgugaauaugguuuccagauugcugcucaaccguuuuacgaugacacauaggcggccgaccauugagaaggaugucgaccuuggugccgggacucgccacgugaacgcugaaccugagaccccaaauauggacgugaucggagagcgaauaaaaagaauuaaggaagagcauucuucaacauggcacuacgaugacgaaaaccccuauaaaacgugggccuaccacggcagcuaugaggucaaggcaaccggcuccgccaguucuaugaucaaugggguugugaagcuguuaacuaaaccuugggauguagugccaauggucacacaaauggcuaugaccgacacuacacccuucggacagcagaggguguuuaaggaaaaaguugauacccggacaccgcgcccuaugcccgguacuagaaaggugauggagaucaccgcggaguggcuguggaggacguugggccgaaacaaaaagccacggcucugcacccgugaagaguucacaaagaaagucagaacuaaugccgcaaugggggcuguguuuaccgaagagaaccaaugggacagcgcccgcgcagccguagaagaugaggaguucuggaagcugguugacagggaacgggagcuacauaaacuuggaaaguguggcucaugcguguacaauaugauggguaaaagagaaaagaaacugggggaguuuggaaaggcuaagggcucccgcgccauuugguacauguggcucggcgcgagguaucuggaguucgaagcauugggguuucugaacgaggaucacugguucagucgagaaaauagcuacucuggagucgagggugaaggccuccauaaacuuggguauauacugcgggacaucuccaagauuccuggaggcgccauguacgcugaugacacagccgguugggacacuagaaucaccgaggaugacuuacacaacgaggaaaaaauuacgcagcagauggaucccgagcauaggcagcuggcaaaugcuaucuuuaaguugacauaucaaaacaaaguggugaagguccagcgcccaacccccaaggggacuguuauggacauaaucucacguaaagaucagcggggaagcggccaggugggcacauacgggcucaauaccuucacuaacauggaagcccaacugguaagacagauggagggagaaggugugcuaucgaaggcugaccuugagaauccucaccugcucgagaaaaagauuacccaguggcuggaaacaaaaggcgucgagagguugaagcgcauggccaucucuggggaugacugcgugguuaagccaauugaugaccgauuugcaaacgcguuacuggcccucaacgauaugggaaaagugcggaaggacaucccgcaguggcaacccaguaaaggcuggcacgauuggcagcaggucccuuucuguucccaucacuuccaugaacuuauaaugaaggacgguagaaaacuggugguaccaugcaggccccaggacgagcuaauugggcgcgcuagaaucagccaaggagccggcuggucacugaaggaaacggcaugucucggcaaggcuuaugcccagaugugguccuugauguacuuucaccggagggaucugcgucuugcaucuaaugccaucugcagcgcgguuccugugcacuggauuccaaccagucgaacuacaugguccauacaugcucaccaucaguggaugaccacugaggacaugcugacagucuggaaccgcguguggaucgaggauaaucccuggauggaagacaaaaccccuguuacgacaugggaggaugugccguaccucgggaagagagaagaccaaugguguggaagcuuaauuggucugaccucucgggccacuugggcacagaacaucuugaccgccauucagcaggucaggucacugaucggcgaugaggaguuccucgacuauaugccaaguaugaaacgcuuuagaaaggaagaggaauccgagggggcuauaugguga

SEQ ID NO: 15601 - RNA, 9873 nt, Artificial Sequence
  derived and/or modified CDS sequence (opt3) from DENV-3__JQ045689__SS-prME
acaagccugugccucaugaugaugcuucccgcaacacuggcuuuccacuugacuuccagggacggagaaccuaggaugaucguggggaagaacgaacggggaaaaucuuuacuguuuaagacggcaucagguauuaauauguguacccucauugcaauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaguucgaaaaagucgagacuugggcacuccggcauccuggauuuaccauccuggcccuguuccucgcucacuacauuggcacaucuuuaacucagaaggugguuaucuuuauacugcuuauguuggugaccccaucgaugacaaugcgcugugucggcguggggaacagagacuucguagaaggacugucaggugccaccuggguugaugugguccuagagcauggcgggugcgugacgacuauggcgaagaauaaacccacacucgacaucgagcugcagaagaccgaagcaacucagcuugccacacugaggaaauuguguauugagggaaagaucaccaacauuacgaccgauagccggugcccuacacagggcgaagcuauccucccagaggaacaggaccagaauuauguguguaaacacacuuacgucgaucgcgguugggggaacggaugcggccuguuuggcaaggggaguuuaguuaccugcgccaaguuccaaugucuggagcccauagagggaaaagugguacaguaugaaaaucucaaguacacagugauuaucacuguccacaccggugaccagcaucaggugggcaacgacacacaagggguuaccguggagauuacuccucaggcauccacggucgaagcugugcuuccagaguauggaacacugggcuuggaaugcucuccgcgaaccggucuagauuuuaaugagaugauccugcucacuaugaaaaacaaggccuggaugguacacagacagugguucuuugaccugccccuuccuuggaccagcggggcgacaaccgagacuccaacauggaauaggaaagaacuguugguuacguucaagaacgcccaugccaagaagcaagagguggucgugcucggcucccaggaaggagcuaugcacaccgcccugacuggcgcuacagagauccaaaauucagggggaaccaguauuuuugccggucacuuaaagugucggcugaaaauggauaagcuagaacucaaaggcaugagcuacgcaaugugccugaacacauucguccuuaagaaagaggugucugagacucagcaugggaccauauugaucaagguugaauacaagggagaggacgcccccuguaaaauuccuuucuccacggaagauggccaagguaaggcucacaacgggcgucugaucaccgcgaauccagugguaaccaagaaggaggagcccgucaacauagaagcagagccgccuuuuggcgaaucaaauauugugaucggaaucggcgacaaagcccucaagauuaacugguauaagaaagggagcaguaucggaaagauguucgaggcuacugcccgcggugcaagaaggauggccauucugggcgauaccgcuugggacuuugggucuguuggaggcgugcuuaauucccuggguaaaaugguccaucagauauucgggagcgccuacacagcauuguuuucgggcgugucuuggaucaugaagauuggaaucggcguacuccugacuuggaucggguuaaacuccaaaaauaccucaaugaguuucagcugcauugugauaggaaucauuacgcuguaucuaggcgcgguuguccaggcugauauggguugugccaucaacuggaaggggaaggaacucaaaugcggauccggcauuuuugugacaaaugaggugcacaccuggacugagcaguacaaguuccaagcagacucucccaaacggcuggccacagcuaucgccggugcaugggaaaacggcgucugugggauacgaagcaccacucgcauggagaaucuuuuguggaagcagaucgcuaacgaacugaauuauauucucugggagaacaauaucaaacugaccguuguggugggagauauuaucggcguauuagaacaggggaagagaacacugacgccacagccuauggagcuuaaauacucauggaagaccuggggaaaggccaaaauagucacugcggagacacaaaacaguuccuuuauuaucgacggccccaacaccccagaaugccccagcgccucuagggcuuggaaugugugggagguugaagacuaugguuucgggguguuuacaacuaacauuugguugaagcuccgggaggucuacacccagucaugugaucaucgccugaugagugcagccaucaaagacgaaagagcugugcacgccgauaugggauacuggauagagagccagaagaauggcuccuggaaacuagagaaggcaucuuucaucgaaguuaagacgugcacauggccuaaaucgcacacccuguggagcaacggugugcucgaguccgacaugauuaucccaaagucacuggcgggcccgauuagucagcauaaucacaggcccggguaucauacucaaaccgccggaccuuggcaccuuggcaaauuggaacuggauuuuaacuacugcgaggggacaacuguagucaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggugaagucacuggucagcgcugguucuggcaagguugauaacuucaccauggggguguugugccucgccauccuguucgaggaaguaaugcgcggaaaauuuggcaagaaacauaugauugcaggggugcuauucacuuuuguccugcuccuguccggacagaucacauggcgggacauggcucacacccuuauuaugauaggcaguaaugccagcgauagaauggguaugggggugacguauuuggcacugaucgccacuuucaagauucagcccuuuuuagcucucggauucuuucugaggaaacuuaccucucgcgagaaccugcuacucggcguuggccuggcgauggccacaaccuugcaacugccggaagacaucgagcagauggcaaaugggauugcuuuaggacucaugacucugaaacuuaucacacaguucgaaaccuaccagcuguggacagccuuggugucccucacuuguucaaacaccauauuuacgcugacagucgccuggcgaaccgcuacucuaauccuggccggugugagucuucucccucugugccaaagcucguccaugcggaagaccgauugguugccaaugacaguugccgcgaugggcgugcccccucugcccuuauucauauuuucucucaaagacacuccaaagcguagaagcuggccucugaaugagggggucauggcuguaggacuugugucaauccuggccaguuccuugcucaggaacgauguucccauggcaggcccacugguggccggugggcuacugauugcuuguuaugucaucaccggaacgucugcagaccuuacaguggagaaagccgcggacguaaccugggaagaggaagcugagcagacuggcgugagccauaaccucaugauaacagucgaugacgauggcaccaugcgcauuaaggacgaugaaacugagaauauccugacaguuuuguuaaaaaccgcccugcucaucguguccgggauuuucccguacucaauaccugcaacgcugcuuguguggcacacuuggcagaagcagacccaacggagcggaguccugugggacgugcccaguccacccgagacacagaaagccgaauuggaggaagguguuuacagaaucaagcagcagggcauuuuugggaagacccaaguaggagugggcguccagaaagaggguguguuccauacaauguggcacguuacuagaggggcugugcuaacccacaacggaaagcgacuggagccuaauugggccucugucaaaaaggaucucaucuccuauggcggcggguggcgccugagcgcacaguggcaaaaaggagaagaggugcagguaauugcugucgaaccagguaagaaccccaagaauuuccagacgaugccuggcaucuuucagacaacuaccggggagauaggagccaucgcgcuugacuucaaaccgggcacaucggguucaccaauuaucaaccgggaagggaaggugguuggauuauacggcaauggcguggucaccaaaaacgggggauaugugucugguauugcccaaacuaaugcagagcccgauggcccuaccccagagcuggaagaggaaauguuuaagaaaagaaaccucacaaucauggacuugcaucccgggaguggaaagacgaggaaguaccugccugcuauaguucgugaggccauuaaacgccggcucagaacucugauccuugcuccgaccaggguggucgcagccgaaauggaggaggcccugaagggcuugcccauccgauaucagacaaccgcuacuaaauccgaacacacaggucgggagauuguggaucuaaugugccaugcgaccuucacgaugcgccugcucagcccaguaagagugccuaauuacaacuuaaucauaauggacgaagcacacuuuacugaucccgccucuauugcugccaggggguauaucagcacacggguuggaaugggcgaggcagccgcuauuuucaugaccgcgaccccaccuggcacugccgaagcauuuccccaguccaaugcuccaauccaggacgaggagcgagacauaccggaaagaucauggaacagugggaaugaguggauuacagauuucgucggaaagaccgugugguuugugccuagcaucaaagccgguaacgacaucgcaaacugucugcgcaagaauggcaagaaagucauucaacuuucuaggaagacauucgauacugaauaccagaaaacgcgucugaacgacugggauuuuguagugaccacagacaucuccgagaugggggccaauuucaaggcugaucggguuauugaccccagaaggugccucaaaccagugauauugacugauggacccgagcgcgucauccuggccggcccuaugccagugaccgcggcaucagccgcucagcgaagaggucggguugggaggaacccccagaaggaaaaugaccaauacauuuucacaggccagccucucaacaaugaugaggaccaugcccacuggaccgaagcuaagaugcugcuugacaacaucaauacuccggagggaaucauuccagcacuauuugaacccgagcgcgagaaaagugccgcuauagauggcgaauaucgucugaagggggagagcagaaaaacguucguggaauugaugcggaggggagacuuaccugucuggcuggcccacaagguggcauccgaggguaucaaauacaccgaucgcaaguggugcuuugacggcgaacgaaacaaucagauucucgaggagaacauggauguagaaaucuggacaaaagagggggaaagaaagaagcugcggcccagguggcuugacgcgcgcacuuauucugauccacuggcccucaaagaguucaaggacuuugcugccggaagaaaaucgauugcauuggaucuggugaccgaaaucggcaggguuccuagccaucuagcucaccggacacguaaugcccuggacaaccucgucaugcuucauaccucagagcacggugggcgcgcauaccgacacgccguggaggaacugcccgagacuauggaaacauuauugcugcucggccugaugauacuucugacgggaggcgcuaugcuauucuugaucuccgggaagggaauugguaaaaccaguaucggccugauuugugugaucgucucuagcgggauguuauggauggcggauguuccacuacaguggauagccuccgcaauugugcuggaguuuuucaugaugguacuccuuaucccugagccggaaaagcaaagaacuccccaggacaaucagcuggcuuauguggucauuggaaucuugacacuggccgccauaguggcagcuaacgagaugggccuccuggaaaccaccaagagggaucuugguaugucaaaagagccagggguugugucuccuacaagcuaccucgacgucgaccugcaucccgccagugcguggacuuuguaugcuguagccacgaccgugaucacaccaaugcugcggcacacuauugaaaauuccaccgcaaacguuagcuuagccgcuaucgcaaaccaagccgugguccuaaugggccuggauaagggauggccuauuucuaaaauggaccucggcgugccccuucuggcguuggggugcuacucacaggucaauccgcugacacucaccgcugccgugcugcuuuuaguuacucauuacgcaaucauaggaccaggccugcaggccaaggcuacgcgcgaggcccagaaaagaacagcagcugguauuaugaagaacccuaccguggaugggaucaugacuaucgaccucgaucccguaauuuaugacuccaaguuugagaaacaauugggacaggugaugcugcuaguccugugugccguucagcuccuucugaugaggaccaguugggcguugugcgaagcccugacacucgcaacuggcccaaucaccacacugugggaggguagccccggcaaguucuggaauacgaccauagcugugucgauggccaacauuuuucgggggucuuacuuagcaggagcuggccuugccuucuccaucaugaaaagcgucgggacuggacgaagaggcacagguucacagggggaaacccugggagagaaguggaaaaagaagcucaaucaacuaagucgcaaagaauuugaucuguauaagaaaucuggcauuacugagguggacaggacagaggccaaggaagguuugaaacggggcgagaccacgcaccaugcgguaucccgugggagcgcuaagcugcagugguucguggaaagaaacaugguuaccccugagggaagggugaucgaucucggcugugggcgcggaggcuggucauacuauugcgcaggucuuaaaaaggucacagaagugcggggguacacuaagggaggcccgggccacgaggagcccgucccaaugaguaccuauggguggaauauagugaaacugaugagcggaaaggacguuuucuacuugccucccgaaaaaugugauacacugcucugcgacaucggugaguccucuccuagcccaacuguagaagagucccgaaccauuagaguguuaaagauggucgagcccuggcugaaaaacaaucaguuuuguaucaaggugcuuaacccuuacaugccaacaguuauugaacaccuggagaggcuacagcgcaaguauggcgggaugcucgugcggaauccccugucaagaaacucuacccaugaaauguacuggaucaguaauggaacuggcaacauugucucgagcgugaauaugguaucccguuugcugcucaacagguucacgaugacacaccggcgcccgaccaucgagaaagauguggaccuuggugccgggacucgacauguuaacgcugaaccugagaccccaaauauggacgucauaggagagagaauuaagaggaucaaagaggaacacucuucaacauggcacuaugaugacgaaaaccccuacaagacgugggccuaucauggcagcuacgaggugaaagcaaccggcuccgccaguucuaugaucaaugggguggucaagcuguuaacuaagccuugggauguugugccaaugguaacacaaauggcuaugaccgacacuacacccuuuggacagcagcggguguucaaagaaaaggucgauacccgcacaccgagaccuaugcccgguacuaggaaagugauggagauuaccgcggaguggcuguggcgaacguugggccggaacaagaaaccacgucucugcaccagagaagaguuuacaaagaagguucgcacuaaugccgcaaugggggcuguguucaccgaagagaaccaaugggacagcgccagggcagccgucgaagaugaggaguuuuggaaacugguggaccgggaaagagagcuacacaaacuuggaaaauguggcucaugcguauauaauaugauggguaagcgcgagaagaagcugggggaguucggaaaagcuaagggcuccagggccauaugguacauguggcucggcgcgcgauaccuggaguuugaagcauugggguuccugaacgaggaucauugguuuagucgggaaaauagcuauucuggaguugagggugaaggccuccacaaacuuggguacauccugagagacauuuccaaaaucccuggaggcgccauguaugcugaugacacagccgguugggacacuaggauuaccgaggaugacuuacauaacgaggaaaagaucacgcagcagauggaucccgagcaccgccagcuggcaaaugcuauauucaaauugacauaccaaaacaagguggucaaagugcagcguccaacccccaaggggacugugauggacaucauuucacggaaggaucagagaggaagcggccaggucggcacauaugggcucaauaccuuuacuaacauggaagcccaacugguuaggcagauggagggagaaggugugcuaucgaaagcugaccuugagaauccucaucugcucgagaagaaaaucacccaguggcuggaaacaaagggcguagagcgcuugaaacgaauggccauuucuggggaugacugcguggucaagccaaucgaugaccgguucgcaaacgcguuacuggcccucaacgauaugggaaaggugagaaaagacauaccgcaguggcaacccaguaagggcuggcaugauuggcagcagguuccuuucuguucccaccauuuucacgaacuuauuaugaaagacgguaggaagcugguggucccaugccgcccccaggacgagcuaaucgggagagcucggaucagccaaggagccggcuggucacugaaagaaacggcaugucucggcaaggcuuacgcccagaugugguccuugauguauuuccacaggcgugaucugcgacuugcaucuaaugccauuugcagcgcggugccuguacauuggauaccaaccagucgcacuacaugguccauccacgcucaucaccaguggaugaccacugaggacaugcugacaguuuggaacagaguguggauugaggauaaucccuggauggaagacaagaccccugucacgacaugggaggauaucccguaccucgggaaacgggaagaccaaugguguggcagcuuaauuggucugaccucuagggccacuugggcacagaacaucuugaccgccauacaacaggugcgcucacugaucggcgaugaggaguuucucgacuacaugccaaguaugaagagauuccggaaagaagaggaauccgagggggcuauuugguga

SEQ ID NO: 15602 - RNA, 9873 nt, Artificial Sequence
  derived and/or modified CDS sequence (opt3) from DENV-3__JQ045691__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacaucggcauggguuuggauacaagaacccaaacguggauguccgccgagggggcuuggaggcagguggaaaaagucgagacuugggcacuccggcauccuggauucaccauucuggcccuguuucucgcucacuacaucggcacaucuuuaacucagaaggugguuauauucauccugcuuauguuggugaccccaucgaugacaaugcgcugugucggcguggggaacagagacuuuguagaaggacugucaggugccaccuggguugaugugguccuagagcauggcgggugcgugacgacuauggcgaagaauaaacccacacucgacauugagcugcagaagaccgaagcaacucaacuugccacacugaggaaauuguguaucgagggaaagauuaccaacaucacgaccgauagccggugcccuacacagggcgaagcuauacucccagaggaacaggaccagaauuauguguguaaacacacuuacgucgaucgcgguugggggaacggaugcggccuguucggcaaggggaguuuaguuaccugcgccaaguuucaaugucuggagcccauugagggaaaagugguacaguaugaaaaucucaaguacacagugaucauuacuguccacaccggugaccagcaucaggugggcaacgacacacaagggguuaccguggagaucacuccucaggcauccacggucgaagcuauccuuccagaguauggaacacugggcuuggaaugcucuccgcgaaccggucuagauuucaaugagaugauucugcucacuaugaaaaacaaggccuggauggugcacagacagugguuuuucgaccugccccuuccuuggaccagcggggcgacaaccgagacuccaacauggaauaggaaagaacuguugguaacguuuaagaacgcccaugcaaaaaagcaagagguugugguccucggcucccaggaaggagcuaugcacaccgcccugacuggcgcuacagagauacagaucucagggggaaccaguauuuucgccggucacuuaaagugucggcugaaaauggauaagcuagaacucaaaggcaugagcuacgcaaugugccugaauacauuugugcuuaagaaagaggucucugagacucagcaugggaccaucuugauaaagguggaauacaagggagaggacgcccccuguaaaauuccuuucuccacggaagauggccaagguaaggcucacaacgggcgucugaucaccgcgaacccaguugugacaaaaaaggaggagcccguaaauaucgaagcagagccgccuuucggcgaaucaaacauugucaucggaauuggcgacaaagcccucaagauaaauugguauaagaaagggagcaguaucggaaagauguuugaggcuacugcccgcggugcaagaaggauggccauucugggcgauaccgcuugggacuucgggucugugggaggcguucuuaacucccuggguaaaauggugcaucagaucuuugggagcgccuacacagcauuguucucgggcgucucuuggaucaugaagauuggaauaggcgugcuccugacuuggaucggguuaaauuccaaaaacaccucaaugaguuuuagcugcauuguaaucggaauuaucacgcuguaucuaggcgcggugguucaggcugauauggguugugccauaaauuggaaggggaaggaacucaaaugcggauccggcaucuucgucacaaacgaggugcacaccuggacugagcaguacaaguuucaagcagacucucccaaacggcuggccacagcuauugccggugcaugggaaaauggcgugugugggauccgaagcaccacucgcauggagaaccuuuuguggaagcagauugcuaaugaacugaacuauauccucugggagaauaacauaaaacugaccgucguugugggagauauuaucggcguguuagaacaggggaagagaacacugacgccacagccuauggagcuuaaauacucauggaagaccuggggaaaggccaaaauuguaacugcggagacacaaaauaguuccuucaucauagacggccccaacaccccagaaugccccagcgccucuagggcuuggaacgucugggagguggaagacuaugguuuugggguuuucacaacuaauaucugguugaagcuccgggagguguacacccagucaugugaucaucgccugaugagugcagccauuaaagacgaaagagcuguccacgccgauaugggauacuggaucgagagccagaagaacggcuccuggaaacuagagaaggcaucuuuuauugaagugaagacgugcacauggccuaaaucgcacacccuguggagcaaugguguucucgaguccgacaugaucauaccaaagucacuggcgggcccgauuagucagcauaaccacaggcccggguaucauacucaaaccgccggaccuuggcaccuuggcaaauuggaacuggauuucaauuacugcgaggggacaacugugguaaucaccgagaacuguggaacacguggcccaucuuuacggacgaccacugucagcgguaagcucauccacgaauggugcugucgauccugcacacugcccccucuuagauauaugggggaggacggauguugguacggcauggaaauuaggccaaucaaugagaaagaagagaacauggugaagucacuggugagcgcugguucuggcaaggucgauaauuuuaccauggggguuuugugccucgccauucuguucgaggaagugaugcgcggaaaauucggcaagaaacauaugauagcagggguacuauuuacuuucgugcugcuccuguccggacagaucacauggcgggacauggcucacacccuuauuaugaucggcaguaacgccagcgauagaauggguaugggggucacguauuuggcacugauugccacuuuuaagauccagcccuucuuagcucucggauuuuuccugaggaaacuuaccucucgcgagaaucugcuacucggcgugggccuggcgauggccacaaccuugcaacugccggaagacauagagcagauggcaaacgggaucgcuuuaggacucaugacucugaagcuuauuacacaguuugaaaccuaccagcuguggacagccuugguuucccucacuuguucaaauaccaucuucacgcugacaguggccuggcgaaccgcuacucuaauucuggcaggugucagucuucucccucugugccaaagcucguccaugcggaagaccgauugguugccaaugacaguggccgcgaugggcguucccccucugcccuuauuuaucuucucucucaaagacacuccaaagaaacguagcuggccucugaacgagggggugauggcugucggacuuguaucaauacuggccaguuccuugcucagaaaugaugugcccauggcaggcccacugguugccggugggcuacugauugcuuguuaugugaucaccggaacgucugcagaccuuacagucgagaaggccgcggacgugaccugggaagaggaagcugagcagacuggcguaagccauaaccucaugaucacaguggaugacgauggcaccaugaggauuaaagacgaugaaacugagaacauacugacagucuuguuaaagaccgcccugcucaucguuuccgggauuuuuccguacucaaucccugcaacgcugcuuguguggcacacuuggcagaaacagacccaacgcagcggagugcugugggacguccccaguccacccgagacacagaaggccgaauuggaggaagguguguaccggauuaagcagcagggcaucuucgggaaaacccaaguuggaguaggcgugcagaaggagggugucuuucauacaauguggcacgugacuagaggggcuguucuaacccacaauggaaaaaggcuggagccuaacugggccucugugaagaaagaucucauauccuauggcggcggguggcgacugagcgcacaguggcaaaagggagaagagguccaggugaucgcuguagaaccagguaagaaucccaaaaacuuccagacgaugccuggcauuuuccagacaacuaccggggagaucggagccauugcgcuugacuuuaagccgggcacaucggguucaccaaucauaaaucgcgaagggaaagucgugggauuauacggcaacggcguugugaccaagaaugggggauaugucucugguauugcccaaacuaacgcagagcccgauggcccuaccccagagcuggaagaggaaauguucaaaaagcggaaucucacaaucauggacuugcaucccgggaguggaaagacgagaaaauaccugccugcuaucgugagggaggccauuaagcgucgccuccggacucugauccuugcuccgaccagaguuguggcagccgaaauggaggaggcccugaaaggcuugcccauaagguaucagacaaccgcuacuaaguccgaacacacaggucgagagauugucgaucuaaugugccaugcgaccuuuacgaugcggcugcucagcccagugcgcguaccuaacuacaauuuaaucauuauggacgaagcacacuucacugaucccgccucuaucgcugccagaggguauauaagcacaagggugggaaugggcgaggcagccgcuauuuuuaugaccgcgaccccaccuggcacugccgaagcauucccccaguccaacgcuccaauccaggacgaggagcgggacaucccggaacgaucauggaauagugggaacgaguggauuacagauuuuguuggaaaaaccgucugguucgugccuagcaucaaggccgguaaugacauugcaaacugucugagaaagaacggcaaaaaggugauacaacuuucucgcaaaacauuugauacugaauaccagaagacgaggcugaaugacugggauuucgucguaaccacagacaucuccgagaugggggccaacuuuaaagcugaucgugugauugacccccggagaugccucaagccaguuaucuugacugauggacccgagagggugauccuggccggcccuaugccagucaccgcggcaucagccgcucagcgccgagguagaguggggcggaauccccagaaggaaaacgaccaauacauuuucacaggccagccucucaauaacgaugaggaccaugcccacuggaccgaagcuaaaaugcugcuugacaauauaaacacuccggagggaaucauuccagcacuauucgaacccgagagggagaagagugccgcuaucgauggcgaauaucgccugaaaggggagagccguaagacguuuguugaauugaugagacggggagacuuaccuguguggcuggcccacaaagucgcauccgaggguauuaaguacaccgauaggaaauggugcuucgacggcgaacgcaauaaccagauccucgaggagaauauggauguggaaauauggacaaaggagggggaacgaaagaaacugagaccccgguggcuugacgcgaggacuuauucugauccacuggcccucaaggaguuuaaagacuucgcugccggacgcaagucgaucgcauuggaucugguaaccgaaauuggcagagugccuagccaucuagcucacaggacacggaacgcccuggacaaucucguuaugcuucauaccucagagcacggugggcgugcauaccgccacgccgucgaggaacugcccgagacuauggaaacauuauugcugcucggccugaugauccuucugacgggaggcgcuaugcucuuuuugcuguccgggaaaggaauugguaagaccaguaucggcuuaauaugugugauugugucuagcgggaugcuauggauggcggaugucccacugcaguggaucgccuccgcaauuguucucgaguucuuuaugauggugcuucugaucccugagccggaaaagcaacgaacuccccaggacaaccaguuggcuuauguagugauaggaauccugacacucgccgccauugucgcagcuaaugagaugggccugcuugaaaccaccaaaagagaucucgguaugucaaaggagccaggggugguuucuccuacaagcuaccuggacguggacuugcaucccgccagugcguggacucuguaugcugucgccacgaccguaaucacaccaauguuaaggcacacuauugaaaacuccaccgcaaaugugagccuagccgcuaucgcaaaccaagccguugugcugaugggccucgauaaaggauggccuauaucuaagauggaccuuggcgucccccuguuggcgcuggggugcuacucacaggugaacccgcucacacugaccgcugccguccuuuuacuggugacucauuacgcaauuaucggaccaggccuccaggccaaagcuacgcgggaggcccagaagcgcacagcagcugguaucaugaagaauccuaccguugaugggauuaugacuaucgacuuggaucccgugauauaugacuccaaauucgagaagcaacugggacagguaaugcuacuggugcucugugccguccagcuucuguugaugagaaccaguugggcgcugugcgaagcccucacacuggcaacuggcccaauuaccacauuaugggaggguagccccggcaaauuuuggaacacgaccaucgcuguuucgauggccaauauuuucagggggucuuaccuugcaggagcuggccuggccuuuuccaucaugaagagcguggggacuggacggcgaggcacagguucacagggggaaacccucggagagaaauggaagaagaaacuaaaccaacugaguagaaaggaauucgauuuguauaaaaagucuggcauaacugaggucgaccgcacagaggccaaagaaggucugaagaggggcgagaccacgcaccaugcggugucccgggggagcgcuaaacuccagugguuuguagaacguaauauggugaucccugagggaagaguuauugaucuuggcugugggaggggaggcuggucauacuauugcgcaggucugaagaaggugaccgaaguccgcggguacacaaaaggaggcccgggccacgaggagcccgugccaaugaguacuuauggguggaacuuggucaagcugaugagcggaaaagacguguucuaccucccucccgaaaagugugauaccuuacugugcgacaucggugaguccucuccuagcuccacaguugaagagucacggacuauucgaguacuuaaaaugguggagccauggcugaagaauaaccaguucuguaucaagguccuaaaucccuacaugccuaccgugauugaacaccucgagagacugcagaggaaauauggcgggauguugguucgcaacccacugucucggaauaguacacaugaaauguacuggaucucgaacggaaccggcaauauagugagcuccgucaacauggugucuagacuccuucugaaucguuuuacuaugacgcacaggcggcccacaauugagaaggauguagacuuaggugccgggacccgccaugugaacgcugaaccggagacuccuaacauggacguuaucggagagcgaaucaaaagaauuaaggaagagcacucaagcaccuggcacuaugaugacgaaaauccauacaaaacaugggccuaucauggcuccuacgaggucaaggcaacgggcagugccucuagcaugauaaacgggguggugaagcuguugaccaaacccugggaugucguuccuauggugacucaaauggcuaugacagacaccacuccauucggacagcagaggguauuuaaggaaaaaguggauacacggaccccccgcgcgaugccggguacaagaaaggucauggagaucacugccgaguggcucuggaggacccugggccgaaauaaaaagccucggcuaugcacgcgugaagaguucaccaagaaagugagaacaaacgcagcuaugggggccguuuuuacugaagagaaucaaugggacucagcacgcgccgcuguggaagaugaggaguucuggaagcuugucgacagggaacgggagcugcacaaacucggaaaguguggcuccugcguguauaacaugauggguaaaagagaaaagaaacugggggaguuuggaaaggccaagggcagucgcgcgauuugguacaugugguugggcgcaagguaccuggaguucgaagcccucggguuucuuaaugaggaucauugguucagccgagaaaacucuuauuccggaguagagggugaaggccugcacaaauuaggguacauccugcgggacauuucaaagauccccggaggcgcuauguaugccgaugacaccgcagguugggacacaagaauaacugaggaugacuugcauaaugaggaaaaaaucacccagcagauggauccagagcacaggcagcucgcuaacgccauuuuuaagcugacguaccaaaauaaaguugugaagguccagcgcccuacacccaaggggaccgugauggacaucauuagccguaaagaucagcggggaucgggccaggugggcacuuaugggcuaaacacauucaccaauauggaagcucaacuugucagacagauggagggagaagguguucugucuaaggccgaccucgagaacagucaccuguuggagaaaaagaucacucagugguuagaaaccaaaggcguggagaggcugaagcgcauggcaauauccggggaugacugcguagugaagccaauugaugaccgauuugcgaaugcccuccuugcucugaacgauaugggaaaaguccggaaggacaucccccaguggcaaccuagcaaaggcuggcaugauuggcagcaggugccauucuguucacaccauuuccacgaacuaaucaugaaggacgguagaaaacugguugugccgugcaggccccaggacgagcucauugggcgcgccagaauaucccaaggagcaggcuggucuuugaaggaaacagcuugucugggcaaggccuacgcacagauguggagccuuauguauuuucaccggagggaucugcgucucgccaguaacgcgaucugcuccgcugucccugugcauuggauuccaacgagccgaaccacuuggucuauccacgcccaucaccaguggaugacaaccgaggacauguuaacuguauggaaucgcguuuggauugaggauaaccccuggauggaagacaaaacaccugugaccacgugggaggaugucccauaccuggggaagagagaagaccaaugguguggaucauugaucggucugacaagucgggcaaccugggcccagaauauacucacugcuauccagcaggugaggucccuuauuggcgaugaggaguuccuggacuacaugcccagcaugaaacgcuuuagaaaggaagaggaaucugagggggccaucugguga

SEQ ID NO: 15603 - RNA, 9873 nt, Artificial Sequence
  derived and/or modified CDS sequence (opt3) from DENV-3__JQ045692__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuauccuuccagaguauggaacacugggcuuggaaugcucuccgcgaaccggucuagauuucaaugagaugauccugcucacuaugaaaaacaaggccuggaugguacacagacagugguuuuucgaccugccccuuccuuggaccagcggggcgacaaccgagacuccaacauggaauaggaaagaacuguugguuacguuuaagaacgcccaugcaaaaaagcaagagguggucgugcucggcucccaggaaggagcuaugcacaccgcccugacuggcgcuacagagauucagauaucagggggaaccaguaucuucgccggucacuuaaagugucggcugaaaauggauaagcuagaacucaaaggcaugagcuacgcaaugugccugaauacauuuguccuuaagaaagaggugucugagacucagcaugggaccauuuugaucaagguugaauacaagggagaggacgcccccuguaaaauaccuuucuccacggaagauggccaagguaaggcucacaacgggcgucugauuaccgcgaacccagugguaacaaaaaaggaggagcccgucaauaucgaagcagagccgccuuucggcgaaucaaacaucgugauuggaaucggcgacaaagcccucaagauuaauugguauaagaaagggagcaguauaggaaagauguuugaggcuacugcccgcggugcaagaaggauggccauccugggcgauaccgcuugggacuucgggucuguuggaggcgugcuuaacucccuggguaaaaugguccaucagauuuuugggagcgccuacacagcauuguucucgggcgugucuuggaucaugaagaucggaauuggcguacuccugacuuggauaggguuaaauuccaaaaacaccucaaugaguuuuagcugcaucgugauuggaaucauuacgcuguaucuaggcgcgguuguccaggcugauauggguugugccaucaauuggaaggggaaggaacucaaaugcggauccggcauauucgugacaaacgaggugcacaccuggacugagcaguacaaguuucaagcagacucucccaaacggcuggccacagcuaucgccggugcaugggaaaauggcgucugugggauucgaagcaccacucgcauggagaaccuuuuguggaagcagaucgcuaaugaacugaacuauauucucugggagaauaacaucaaacugaccguuguggugggagauauaauuggcguauuagaacaggggaagagaacacugacgccacagccuauggagcuuaaauacucauggaagaccuggggaaaggccaaaaucgucacugcggagacacaaaauaguuccuucauuaucgacggccccaacaccccagaaugccccagcgccucuagggcuuggaacgugugggagguugaagacuaugguuuugggguguucacaacuaauauaugguugaagcuccgggaggucuacacccagucaugugaucaucgccugaugagugcagccaucaaagacgaaagagcugugcacgccgauaugggauacuggauugagagccagaagaacggcuccuggaaacuagagaaggcaucuuuuaucgaaguuaagacgugcacauggccuaaaucgcacacccuguggagcaauggugugcucgaguccgacaugauuaucccaaagucacuggcgggcccgauaagucagcauaaccacaggcccggguaucauacucaaaccgccggaccuuggcaccuuggcaaauuggaacuggauuucaauuacugcgaggggacaacuguagucauuaccgagaacuguggaacacguggcccaucuuuacggacgaccacugugagcgguaagcucauccacgaauggugcugucgauccugcacacugcccccucuuagauauaugggggaggacggauguugguacggcauggaaaucaggccaauuaaugagaaagaagagaacauggugaagucacuggucagcgcugguucuggcaagguugauaauuuuaccauggggguguugugccucgccauccuguucgaggaaguaaugcgcggaaaauucggcaagaaacauaugauugcaggggugcuauuuacuuucguccugcuccuguccggacagauaacauggcgggacauggcucacacccuuaucaugauuggcaguaacgccagcgauagaauggguaugggggugacguauuuggcacugaucgccacuuuuaagauucagcccuucuuagcucucggauuuuuccugaggaaacuuaccucucgcgagaaucugcuacucggcguuggccuggcgauggccacaaccuugcaacugccggaagacaucgagcagauggcaaacgggauagcuuuaggacucaugacucugaagcuuaucacacaguuugaaaccuaccagcuguggacagccuuggugucccucacuuguucaaauaccauuuucacgcugacagucgccuggcgaaccgcuacucuaauccuggcaggugugagucuucucccucugugccaaagcucguccaugcggaagaccgauugguugccaaugacaguugccgcgaugggcgugcccccucugcccuuauuuauuuucucucucaaagacacuccaaagcguagaagcuggccucugaacgagggggucauggcuguaggacuugugucaauccuggccaguuccuugcucaggaaugauguucccauggcaggcccacugguggccggugggcuacugauagcuuguuaugucauuaccggaacgucugcagaccuuacaguggagaaagccgcggacguaaccugggaagaggaagcugagcagacuggcgugagccauaaccucaugaucacagucgaugacgauggcaccaugcgcaucaaggacgaugaaacugagaacauucugacaguuuuguuaaaaaccgcccugcucauaguguccgggaucuuuccguacucaauuccugcaacgcugcuuguguggcacacuuggcagaagcagacccaacggagcggaguccugugggacgugcccaguccacccgaggcccagaaagcugaauuggaggaagguguuuacagaaucaagcagcagggcauuuucgggaagacacaaguaggagugggcguccagaaagaggguguguuucauaccauguggcacguuacaaggggggccgugcuaacucacaauggaaagcgacuggagccuaacugggcaucugucaaaaaggaucucaucuccuauggcggcggguggcgccugagcgcucaguggcaaaaaggagaagaggugcagguaauagccgucgaaccagguaagaaucccaagaacuuccagaccaugccuggcaucuuccagacgacaacuggggagauuggagcgaucgcccuugacuuuaaaccgggcaccucggguucaccaauuaucaaucgggaagggaaggugguuggauuauacggcaacggcguggucacaaaaaaugggggauaugugucugguauagcacaaaccaacgcugagcccgauggcccuacuccagagcuggaagaggaaauguucaagaaaagaaaucucaccauuauggacuugcaucccgggaguggaaagacaaggaaguaccugccugccaucguucgugaggcuaucaaacgccggcucagaacgcugauucuugcaccgacuaggguggucgccgccgaaauggaggaggcucugaagggcuugcccauccgauaucagaccacagcgaccaaauccgaacacacuggucgggagauaguggaucuaaugugccaugcaacauuuaccaugcgccugcucagcccaguaagagugccuaacuacaauuuaauuaucauggacgaagcccacuucacggaucccgcuucuauugccgcaaggggguauaucagcacucggguuggaaugggcgaggccgcugcgauauuuaugacagccaccccaccuggcaccgcagaagcuuucccccaguccaacgccccaauucaggacgaggagcgagacaucccggaaagaucauggaauagugggaacgaguggaucacugauuuugucggaaagacagugugguucgugccuagcauuaaagcagguaaugacaucgccaacugucugcgcaagaacggcaagaaagucauucaacuuucuaggaagaccuuugauacagaauaccagaaaacucgucugaaugacugggauuucguagugacgaccgacauauccgagaugggggcuaacuuuaaggccgaucggguuaucgaccccagaaggugccucaaaccagugauuuugacagauggacccgagcgcgucauccuggcgggcccuaugccagugacugcagccucagcugcccagcgaagaggucggguugggaggaauccccagaaggaaaacgaccaauacaucuucaccggccagccucucaauaacgaugaggaccaugcucacuggacagaagcaaagaugcugcuugacaauauuaacaccccggagggaauaaucccagcccuauucgaacccgagcgcgagaaaagugcugccauugauggcgaauaucgucugaagggggagagcagaaaaacuuuuguggaauugaugcggaggggagacuuaccugucuggcuggcacacaagguggcguccgaggguaucaaauacacggaucgcaaguggugcuucgacggcgaacgaaauaaccagauucucgaggagaauauggauguagaaaucuggaccaaagagggggaaagaaagaagcugcggcccagguggcuugacgcccgcacauauucugauccacuggcucucaaagaguuuaaggacuucgccgcaggaagaaaaucgauagcuuuggaucuggugacugaaaucggcaggguuccuagccaucuagcccaccggacccguaacgcacuggacaaucucgucaugcuucauacaucagagcacggugggcgcgccuaccgacacgcuguggaggaacugcccgagaccauggaaacuuuuuuauugcugggccucaugauucugcuuacaggaggcgcgaugcuguuccucuuguccgggaagggaaucgguaaaacgaguauuggccugaucugugugauagucucuagcgggauguuauggauggccgauguuccacuacaguggauugcauccgcuaucgugcuggaguuuuucaugaugguacuccuuauuccugagccggaaaagcaaagaaccccccaggacaaccagcuggccuauguggucaucggaauauugacucuggccgcaaucguggcugccaaugagaugggccuccuggaaacaaccaagagggaucuugguaugucaaaagagccagggguugugucuccuaccagcuaccucgacgucgaccugcaucccgcgagugcuuggacauuguaugccguagcaacuacggugauuaccccaaugcugcggcacacaaucgaaaacuccacugccaauguuagcuuagcugcaauugccaaccaagcggugguccuaaugggccuggauaagggauggccuaucucuaaaauggaccucggcgugccccuucuggcuuuggggugcuacucacaggucaacccgcugacccucacagccgcagugcugcuuuuaguuacccauuacgccauaauuggaccaggccugcaggcuaaggccacucgcgaggcacagaaaagaacggcugccgguaucaugaagaauccuacaguggaugggaucaugaccauugaccucgaucccguaaucuaugacuccaaguuugagaaacaauugggacaggugaugcugcuaguccugugugcgguucagcuccuucugaugaggacuaguugggccuugugcgaagcacugacccucgcuacaggcccaauaacuacccugugggaggguagccccggcaaguucuggaacacaacgauugccgugucgauggcaaauaucuuucgggggucuuacuuagcuggagccggccuugccuucuccauuaugaaaagcgucgggaccggacgaagaggcacugguucacagggggaaacacugggagagaaguggaaaaagaagcucaaccaacuaagucgcaaagaauuugaucuguauaagaaaucuggcaucaccgagguggacaggacugaggcgaaggaagguuugaaacggggcgagacaacccaccaugcuguaucccgugggagcgcaaagcugcagugguucguggaaagaaauaugguuauaccugagggaagggugaucgaucucggcugugggcgcggaggcuggucauacuauugcgccggucuuaaaaaggucacggaagugcggggguacaccaagggaggcccgggccacgaggagcccgucccaaugaguacauauggguggaaccuggugaaauugaugagcggaaaggacguuuucuaccugccucccgaaaaaugugauacucucuuaugcgacauuggugaguccucuccuagcuccaccguagaagagucacgaacaaucagagugcugaagauggucgagccauggcuuaaaaauaaccaguuuuguauuaaggugcugaaucccuacaugccuacuguuaucgaacaccuagagaggcuccagcgcaaguauggcgggaugcuggugcggaacccauugucuagaaauaguacccaugaaauguacuggauuucgaacggaacaggcaauaucgucagcuccgugaacaugguaucucgucugcuccuuaauagguucaccaugacucaccggcgccccacgauagagaaagauguggaccugggugcugggacacgacauguuaacgccgaaccggagaccccuaacauggacgucauuggagagagaaucaagaggaucaaagaagagcacucaagcacuuggcacuaugaugacgaaaauccauacaagaccugggcauaucauggcuccuacgaggugaaagccacaggcagugcuucuagcaugauuaacgggguggucaaguuacugacgaagcccugggauguugugccuaugguaacccaaauggcgaugacugacacaaccccauuuggacagcagcggguguucaaagaaaaggucgauacucgcacacccagagccaugccggguaccaggaaagugauggagauaacagcagagugguuguggcgaacucucggccggaauaagaaaccucgucugugcaccagagaagaguuuacgaagaagguucgcaccaacgcugccaugggggcaguguucacagaagagaaucaaugggacucagccagggcugccgucgaagaugaggaguuuuggaaacuaguggaccgggaaagagagcuucacaagcugggaaaauguggcuccugcguauauaacaugauggguaagcgcgaaaaaaagcucggggaguucggaaaagcgaagggcaguagggcaaucugguacauguggcugggcgcccgauacuuggaguuugaagcucugggguuccucaaugaggaucauugguuuagccgggaaaacucuuauuccggaguugagggugaaggccuucacaagcugggguacauuuuaagagacaucucaaaaauucccggaggcgccauguaugcagaugacacugcugguugggacaccaggaucacagaggaugaccugcauaaugaggaaaagauaacucagcagauggauccagagcaccgccaguuggccaacgcuaucuucaaacucaccuaccaaaauaagguggucaaagugcagcguccuacgcccaaggggacagugauggacauuaucagccggaaggaucagagaggaucgggccaggucggcaccuaugggcugaacacuuuuacaaauauggaagcccaacuaguuaggcagauggagggagaaggugugcuuucuaaagcagaccuggagaacccacaccuccuggagaagaaaauuacccagugguuggaaacuaagggcguagagcgcuuaaaacgaauggcgaucaguggggaugacugcguggucaagcccauagaugaccgguucgccaaugcucugcucgcccuuaacgauaugggaaaggugagaaaagacauuccucaguggcaaccauccaagggcuggcaugauuggcagcagguuccguucuguagccaccauuuucacgaacugaucaugaaagacgguaggaagcuagugguccccugccgcccucaggacgagcugaucgggagagcacggauuucacaaggagcuggcuggucccucaaagaaaccgccuguuugggcaaggcauacgcccagauguggucucugauguauuuccacaggcgugaucuucgacuggcgagcaacgcuauaugcagugccgugccaguacauuggauccccacaucccgcacgaccuggagcauucacgcacaucaccaguggaugacuacagaggacaugcucaccguuuggaauagaguguggaucgaggauaacccuuggauggaagacaagacuccagucacaaccugggaggaugugcccuacuuagggaaacgggaagaccaaugguguggaucucugauugguuugacgucaagggccacaugggcucagaauauccugaccgccauacagcagguucgcagucucaucggcgaugaggaguuucuugacuacaugccuuccaugaagagauuccggaaagaagaggaaagcgagggggcaauuugguga

SEQ ID NO: 15604 - RNA, 9873 nt, Artificial Sequence
  derived and/or modified CDS sequence (opt3) from DENV-3__JQ045694__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugcaaaaaagcaagaggucgugguccucggcucccaggaaggagcuaugcacaccgcccugacuggcgcuacagagauccagaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucacaaaaaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugccaucaacuggaaggggaaggaacucaaaugcggauccggcauuuucgugacaaaugagguccacaccuggacugagcaguacaaguuucaagcagacucucccaaacggcuggccacagcuaucgccggugcaugggaaaacggcguuugugggauacgaagcaccacucgcauggagaaucuuuuguggaagcagaucgcuaacgaacugaauuauauucucugggagaacaauaucaaacugaccguggugguaggagauauuaucggcgucuuagaacaggggaagagaacacugacgccacagccuauggagcuuaaauacucauggaagaccuggggaaaggccaaaauagugacugcggagacacaaaacaguuccuucauuaucgacggccccaacaccccagaaugccccagcgccucuagggcuuggaauguuugggagguggaagacuaugguuuuggggucuucacaacuaacauuugguugaagcuccgggagguguacacccagucaugugaucaucgccugaugagugcagccaucaaagacgaaagagcuguucacgccgauaugggauacuggauagagagccagaagaauggcuccuggaaacuagagaaggcaucuuuuaucgaagugaagacgugcacauggccuaaaucgcacacccuguggagcaacgguguacucgaguccgacaugauuaucccaaagucacuggcgggcccgauuagucagcauaaucacaggcccggguaucauacucaaaccgccggaccuuggcaccuuggcaaauuggaacuggauuucaacuacugcgaggggacaacugucgugaucaccgagaauuguggaacacguggcccaucuuuacggacgaccacugugagcgguaagcucauacacgaauggugcugucgauccugcacacugcccccucuuagauauaugggggaggacggauguugguacggcauggaaauuaggccaaucaacgagaaagaagagaauauggucaagucacugguuagcgcugguucuggcaagguggauaacuuuaccauggggguauugugccucgccauccuguucgaggaagugaugcgcggaaaauucggcaagaaacauaugauugcagggguccuauuuacuuucgugcugcuccuguccggacagaucacauggcgggacauggcucacacccuuauuaugauaggcaguaaugccagcgauagaauggguauggggguuacguauuuggcacugaucgccacuuuuaagauucagcccuucuuagcucucggauuuuuccugaggaaacuuaccucucgcgagaaccugcuacucggcgugggccuggcgauggccacaaccuugcaacugccggaagacaucgagcagauggcaaaugggauugcuuuaggacucaugacucugaagcuuaucacacaguuugaaaccuaccagcuguggacagccuuggucucccucacuuguucaaacaccauauucacgcugacaguggccuggcgaaccgcuacucuaauccuggcagguguuagucuucucccucugugccaaagcucguccaugcggaagaccgauugguugccaaugacaguggccgcgaugggcguccccccucugcccuuauuuauuuucucucucaaagacacuccaaagcguagaagcuggccucugaaugaggggguaauggcugugggacuuguuucaauccuggccaguuccuugcucaggaacgaugugcccauggcaggcccacuggucgccggugggcuacugauugcuuguuaugugaucaccggaacgucugcagaccuuacaguagagaaagccgcggacgugaccugggaagaggaagcugagcagacuggcgucagccauaaccucaugauaacaguugaugacgauggcaccaugcgcauuaaggacgaugaaacugagaauauccugacaguguuguuaaaaaccgcccugcucaucguguccgggauuuuuccguacucaauaccugcaacgcugcuugucuggcacacuuggcagaagcagacccaacggagcggagugcugugggacguucccaguccacccgagacacagaaagccgaauuggaggaagguguauacagaaucaagcagcagggcauuuucgggaagacccaagugggagucggcgugcagaaagaggguguuuuucauacaauguggcacgugacuaggggggcuguccuaacccacaacggaaagcgacuggagccuaauugggccucugugaaaaaggaucucaucuccuauggcggcggguggcgccugagcgcacaguggcaaaaaggagaagagguacaggucauugcuguggaaccagguaagaaccccaagaauuuccagacgaugccuggcaucuuccagacaacuaccggggagauaggagccaucgcgcuugacuuuaaaccgggcacaucggguucaccaauuaucaaccgggaagggaagguugugggauuauacggcaauggcgucgugaccaaaaacgggggauauguuucugguauugcccaaacuaaugcagagcccgauggcccuaccccagagcuggaagaggaaauguucaagaaaagaaaccucacaaucauggacuugcaucccgggaguggaaagacgaggaaguaccugccugcuauagugcgugaggccauuaaacgccggcucagaacucugauccuugcuccgaccagggucguggcagccgaaauggaggaggcccugaagggcuugcccauccgauaucagacaaccgcuacuaaauccgaacacacaggucgggagauuguagaucuaaugugccaugcgaccuuuacgaugcgccugcucagcccaaucagagugccuaauuacaacuuaauaauuauggacgaagcacacuucacugaucccgccucuaucgcugccaggggguauauuagcacacggguuggaaugggcgaggcagccgcuaucuuuaugaccgcgaccccaccuggcacugccgaagcauucccccaguccaaugcuccaauacaggacgaggagcgagacauuccggaaagaucauggaacagugggaaugaguggaucacagauuuugucggaaagaccgugugguucgugccuagcaucaaagccgguaacgacauugcaaacugucugcgcaagaauggcaagaaagucauccaacuuucuaggaagacauuugauacugaauaccagaaaacgcgucugaacgacugggauuucguagugaccacagacauuuccgagaugggggccaauuuuaaggcugaucggguuauagaccccagaaggugccucaaaccagugaucuugacugauggacccgagcgcgucauucuggccggcccuaugccagugaccgcggcaucagccgcucagcgaagaggucggguugggaggaacccccagaaggaaaaugaccaauacaucuucacaggccagccucucaacaaugaugaggaccaugcccacuggaccgaagcuaagaugcugcuugacaacaucaauacuccggagggaauuauaccagcacuauucgaacccgagcgcgagaaaagugccgcuaucgauggcgaauaucgucugaagggggagagcagaaaaacguuuguggaauugaugcggaggggagacuuaccugucuggcuggcccacaagguggcauccgaggguauuaaauacaccgaucgcaaguggugcuucgacggcgaacgaaacaaucagauccucgaggagaacauggauguagaaauuuggacaaaagagggggaaagaaagaagcugcggcccagguggcuugacgcgcgcacuuauucugauccacuggcccucaaagaguuuaaggacuucgcugccggaagaaaaucgaucgcauuggaucuggugaccgaaauaggcaggguuccuagccaucuagcuuaccggacacguaaugcccuggacaaccucgucaugcuucacaccucagagcauggugggcgcgcauaucgacacgccguggaggaacugcccgagacuauggaaacauuauugcugcucggccugaugauccuucugacgggaggcgcuaugcucuuuuugauguccgggaagggaauugguaaaaccaguaucggccugauuugugugaucgucucuagcgggauguuauggauggcggauguuccacuacaguggauagccuccgcaauugugcuggaguucuuuaugaugguacuccuuaucccugagccggaaaagcaaagaacuccccaggacaaucagcuggcuuacguggucauuggaaucuugacacuggccgccauaguggcagcuaacgagaugggccuccuggaaaccaccaagagggaucuugguaugucaaaagagccagggguugugucuccuacaagcuaucucgacgucgaccugcaccccgccagugcguggacuuuguacgcuguagccacgaccgugaucacaccaaugcugcggcauacuauugaaaauuccaccgcaaacguuagcuuagccgcuaucgcaaaccaagccgugguccuaaugggccuggauaagggauggccuauuucuaaaauggaccucggcgugccccuucuggcguuggggugcuacucacaggucaauccgcugacacucaccgcugccgugcugcuuuuaguuacucacuaugcaaucauaggaccaggccugcaggccaaggcuacgcgcgaggcccagaaaagaacagcagcugguauuaugaagaacccuaccguggaugggaucaugacuaucgaccucgaucccguaauuuacgacuccaaguucgagaaacaauugggacaggugaugcugcuaguccugugugccguucagcuccuucugaugaggaccaguugggcguugugcgaagcccugacacucgcaacuggcccaaucaccacacugugggaggguagccccggcaaguuuuggaauacgaccauagcugugucgauggccaacauuuuccgggggucuuauuuagcaggagcuggccuugccuuuuccaucaugaaaagcgucgggacuggacgaagaggcacagguccucagggggaaacccugggagagaaguggaaaaagaagcucaaucaacuaucacgcaaagaauucgaucuguacaagaaaaguggcauuacugagguggacaggacagaggccaaggaagguuugaaacggggcgagaccacgcaucacgcgguaucucguggguccgcuaagcugcagugguuuguggaaagaaacaugguuaucccggagggaagggugauagaucucggcugugggcgcggaggcuggagcuauuacugcgcaggucuuaaaaaggucaccgaagugcggggguauacaaagggaggccccggccaugaggagccagucccuaugucaacuuacggguggaaucuggugaaauugaugaguggacgagacguuuucuaccugcccccugaaaagugugauacccucuuaugcgacaucggugagagcuccccaucucccacaguagaagagagcagaacuauuagggugcugaaaauggucgagccuuggcuuaagaacaaucaguucuguaucaaagugcugaacccauauaugcccaccguuauugaacaccuagagcgccuccagcggaaguacggcgggaugcuggugagaaauccguugucccguaacucaacacacgaaauguauuggaucucuaauggaaccggcaacauugucaguucggugaauaugguaagcaggcugcuccuuaaccgguuuacuaugacgcaucgccgaccuacaaucgagaaggauguggaccugggugccgggaccagacacguuaacgcugaaccagagacucccaauauggacgucauaggagagaggauuaaacggaucaaggaagagcauuccucuaccuggcacuacgaugacgaaaacccuuauaaaacaugggccuaccacggcucauaugaggugaaggcaacgggcagcgccuccaguaugaucaaugggguggucaaauuacugaccaagccaugggauguugugcccaugguaacucaaauggcuaugacagacaccacuccguucggacagcagcgcguguuuaaggaaaaagucgauacaagaaccccuaggcccaugccagguacacgaaaggugauggagauuacugcggagugguuguggcggacccucggccguaacaaaaagccuagacugugcacgcgcgaagaguucaccaaaaagguuaggacaaaugccgcaaugggggcuguguuuacugaagagaaccaaugggacucugcccgggcagccgucgaagaugaggaguucuggaagcuaguggacagagaacgcgagcuucauaaacugggaaaguguggcagcugcguauacaauaugauggguaaaagggaaaagaaacucggggaguuuggaaaggcuaaaggcucacgagccauaugguacauguggcugggcgcgcgguauuuggaguucgaagcacugggguuucucaacgaggaucacugguucuccagagaaaauaguuacagcggaguugagggugaaggccuucauaagcugggguauaucuuaagggacauuucuaagauccccggaggcgccauguacgcugaugacaccgccgguugggacacacgcauuacugaggaugaccugcacaacgaggaaaaaaucacccagcagauggauccagagcaucgucaguuggcaaaugcuauauuuaagcucacguaucaaaacaaaguggucaaggugcagcggcccacaccuaaagggaccgugauggacaucauuuccagaaaggaucagaggggaucaggccaggucggcacuuacgggcugaauacauucaccaacauggaagcccaacuaguucgccagauggagggagaaggugugcuuagcaaggcugaccuggagaauccacaccuccuggagaaaaagaucacucagugguuggaaaccgagggcguagaacgauuaaaacggauggccauuucgggggaugacugcguggucaagccgaucgaugacagauuugcaaacgcgcugcucgcccuuaacgauaugggaaaagugaggaaggacauaccccaguggcaaccuucuaagggcuggcacgauuggcagcagguuccauucuguagucaucacuuccaugagcugauuaugaaagacggucgcaagcuagugguccccugcagaccucaggacgaacugaucgggcgggcuaggaucucccaaggagccggcuggagccucaaagagacagcauguuugggcaaggcuuaugcccagauguggucacugauguacuuucaccgucgagaucuucgccuggcauccaaugccauuugcucugcggugccaguacacuggauacccacgagcagaaccacuuggaguauccaugcucaccaucaguggaugacaaccgaggacaugcucacuguuuggaaccggguguggauugaagauaauccuuggauggaggacaaaacaccggucaccacgugggaagaugugccauacuuagggaagagggaggaccaaugguguggaucccugaucgguuugacaagccgcgccaccugggcacagaacauucugacugccauccagcagguuagaucucucauaggcgaugaggaauuccuugacuauaugcccucaaugaagcgguuuaggaaagaggaagagagugaaggggcuaucugguga

SEQ ID NO: 15605 - RNA, 9873 nt, Artificial Sequence
  derived and/or modified CDS sequence (opt3) from DENV-3__GU363549__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacgagcaaggcaaggcgcauaacggucgucuuauaacugcaaauccaguugugaccaaaaaggaagagcccguaaacauugaagccgagccgccuuucggggaaucaaauaucgucaucggcauuggagauaacgcuuugaaaaucaauugguauaagaagggcagcaguauugggaaaauguuugaggccacagcacgcggagccagaaggauggcuauacugggugacacugccugggauuucggcucuguggggggaguucucaacucccugggcaagauggugcaccagaucuuugguagcgcauacaccgcgcuuuucucgggggucucuugggugaugaaaauuggcaucggaguacuguugacguggaucggccucaauuccaagaacacaucaaugaguuuuagcugcauugcuauagggaucauuacccuguauuuaggagccgugguucaggcagacaugggcugugucaucaauuggaaagguaaggagcugaagugcggguccggaauuuucgugacuaacgaagugcauacauggaccgagcaguacaaauuucaagccgauucucccaagcggcuagcuacugccaucgcaggcgcuugggaaaauggugucuguggcauacgaagcaccacacgcauggagaaccuccuguggaaacagaucgccaaugaacuuaacuauauuuugugggagaauaacaucaagcugacgguuguggugggggacaccauuggaguacucgagcagggcaaaagaacucugacaccacagccuauggaauuaaaguacucauggaaaaccugggggaaggcgaagaucgucacagccgagacucaaaacaguuccuucauaauugauggacccaauaccccagaaugccccagcgcuucuagggcauggaacgugugggagguugaagacuauggcuuugguguguucacgacaaauaucuggcugaaacuucgggaggucuacacccagaugugugaccaccgcuugaugucagccgcugugaaggaugagagagccguucacgcagacaugggguacuggauugaaagucagaaaaacggaagcuggaagcucgagaaagcgucccugaucgaagugaagacuugcaccuggccuaagucucauacacuauggucgaauggcguacuggagagcgauaugauaaucccaaaaucccucgccgguccgauuucacagcacaacuauaggcccggcuaccauacucaaaccgcugggccuuggcaccugggaaagcuugaguuggacuuuaauuauugcgaaggcacaacggucgugaucaccgagaacugugggacucguggaccaagucugcggacaaccacugugucuggcaaauuaauucacgaauggugcugucgaagcugcacacuccccccucugagauacaugggugaggauggguguugguauggaauggaaaucaggccaauauccgagaaggaggaaaauauggucaaaucacuuguuagcgccggcucugguaagguggacaacuucaccaugggcguacugugcuuggcaauucucuuugaggaagugaugcgcgggaaguucggaaaaaagcauaugaucgcuggcgucuuccugacguuuaugcuacugcucuccgggcagaucacuuggcgggauauggcccacacccugauuaugaucggaaguaaugcaagcgacagaaugggcaugggugugacauaccuugccuugauugcuaccuucaaaauacagcccuuucuggcguuaggguucuuucucaggaagcugacuucucgcgagaaccuucugcuaggaguuggccucgccauggcaacaaccauccaacugccggaagauauugagcagauggcuaauggcaucgccuuggggcugauggccuuaaaacucauuacacaguucgagacuuaucagcuguggaccgcucuuaucucccugacguguucaaacacaauauuuaccuugacuguggcauggcgaaccgccacacucauccuggcgggagucagucuacugccugugugccaaagcucguccaugcggaagacugacuggcuuccaaugaccguugcugccaugggugugcccccucucccccuguucauuuuuucuuugaaggauacgcugaaacguagaagcuggccauuaaaugaaggcgucauggcaguagggcucgugucaauccuggccaguucccuucugaggaacgacguuccuauggcuggacccuugguggcaggcggucuccugauugccuguuacgucaucacagggaccucugcggaucuaacuguggagaaggcugccgacguaacaugggaagaggaagcagagcagaccggagugagccauaaccugaugauaacugucgacgaugacggcacaaugcgcauuaaagaugacgagaccgaaaauauccuuacgguucuccugaagacugccuuguuaaucguguccggcauuuucccauacucaauaccggcuacccugcucguguggcacacauggcagaaacagacccaacggagcgggguccugugggaugugccuagucccccagagacacagaaggccgaacuugaggagggaguuuauagaaucaaacagcaggguauucugggcaagacucaaguaggggugggaguccagaaggaaggcguguuucauaccauguggcacguuacgaggggugcaguguugacacacaacgggaaacgacuagagcccaauugggcuucugucaagaaagaccugaucuccuacggaggcggcuggcgccucagcgcccaguggcaaaagggggaagaggugcagguaauugcggucgaaccuggaaaaaacccaaagaauuuccagacuaugcccgguaccuuucagacaaccacuggcgagaucggggccauagcacuggauuucaagccuggaaccucgggcucaccgaucauuaaccgggaggguaaagugguugggcuuuauggaaauggcguggucacaaagaacggcggguacgugucuggaaucgcucaaacgaaugccgaaccagacggucccacuccugaguuagaagaggaaauguucaaaaagagaaaccugaccauuauggaucuccauccaggcagugggaaaacaaggaaguauuugcccgcuaucguucgugaggcaauaaagcgccggcugagaacccucauucuggccccuacuaggguggucgccgcugagauggaagaggcgcuuaaaggacugccgauccgauaccagacaaccgcaacgaaguccgaacacacuggccgggagaucguggacuugaugcgccaugccacauuuaccaugagacuacugagccccguaagggugccaaauuauaaccucauuaucauggaugaagcucacuucaccgacccugccucuauagcagcccgggguuacauuagcacucgaguugggaugggagaggcugcggccaucuuuaugacagcaacccccccaggcacagcugaugccuucccucaguccaaugcacccauucaggacgaggaaagagacaucccagagcgcucauggaacaguggcaaugaauggauaacugauuuugccgggaaaacggucugguucgugccgagcauuaaggcuggaaacgacaucgccaacugcuuaaggaaaaaugguaagaaggugauccaacugucucguaaaaccuuugauacagaguaccagaagacuaaacuuaacgacugggauuucgucguaaccacagacauuuccgagaugggcgcgaauuuuaaggcagaucgggugaucgacccuagaaggugucugaaacccguuauucucaccgaugggccagaacgcgugauauuggccggacccaugccugucacuguggcuucagccgcucagcgaagaggccggguugguaggaacccacagaaggagaaugaccaauauaucuucacggggcagccccugaacaaugaugaagaccaugcacacuggaccgaggccaagaugcuccuggacaacauuaauacaccugaaggcaucaucccggcucuuuuugagccagagcgcgaaaaaagugccgcaauugauggagaguaccgucuaaagggcgaaagcagaaaaacuuucguggagcugaugcggaggggggacuugcccgucugguuagcgcacaagguggccuccgaaggaauaaaauauaccgaucgcaaguggugcuucgacggucagcgaaacaaucagauccuggaggagaacauggauguagaaauuuggacaaaagagggcgaaaagaagaaacucagaccucgguggcuggacgcuaggaccuacucugauccccuugcccugaaggaguuuaaagacuucgcagcugggcgcaagucgaucgcccucgauuuggugacugaaauuggaagaguuccaagccaucuggcacacaggacacggaaugcccuagacaaccuggucaugcuccauacgucagagcacggcggucgugcuuaucgccacgcgguggaggaacuuccugagaccauggaaacucuguuauugcuggggcucaugauccugcuuacaggcggagccaugcuguuucucauauccggcaaagggaucggaaagaccaguauugguuugaucugcgugauugcaucuagcggcaugcuguggauggcugagauccccuuacaauggauagccuccgccauuguccuagaguucuuuaugaugguucugcucaucccagaaccugagaagcagcgaaccccgcaggauaaucaacuugcauacgugguaauugggauccugacauuggcugccauaaucgcggcuaacgaaaugggacugcucgagacuacgaaaagagaccugggcaugucaaaggaacccgguguggucucuccaaccagcuaucuugauguggaccuccauccugccagugcauggacacuguacgccguugcuacuaccgugauuacacccauguugaggcacaccaucgagaauuccacugcaaacgucagccuggccgcgauugcuaaccaggccguaguguuaauggggcuagacaaaggcuggccaaucucuaagauggaucugggaguuccucuccuugcacugggcuguuacucacaggugaaucccuugacgcugacagccgcuguccuccugcuugugacccauuaugccauaauugggccgggauuacaggcaaaagcuacucgggaggcccaaaagcgcaccgcggccggcaucaugaagaacccaacagucgacgguaucauuacuaucgaucuggacccugugauauacgauuccaaauucgaaaagcagcucgggcagguuauguugcuggugcuaugcgcaguacagcugcuccuuaugagaaccaguugggcucugugugaggccuugacacuggcaacgggacccauuaccacucucugggaaggcagcccagguaaauuuuggaauacaaccaucgcugugucgauggccaacauuuucaggggcucuuaucuggccggggcgggauuagcuuuuuccaucaugaagagcgucggcacugggaaacggggaacaggcucacaaggugagacccuuggggaaaaguggaagaaaaagcugaaucagcucagucgaaaagaguucgaccuauacaagaaaucuggaauaacggagguugauagaaccgaagcaaaggagggccugaaacgcggugaaacaacucaccaugccguguccaggggcagcgcuaaguugcagugguuugucgagcggaacauggugauccccgaagggcguguaauugaccugggaugcggcagagggggauggucauauuacugugccggccucaagaaagugaccgagguuagggguuauacaaaggggggaccuggccacgaggaaccggugcccaugaguacucacggcuggaauaucgucaaacuuaugagcgggaaggauguguucuaccugccaccugagaaaugcgacaccuugcugugugauauuggagaauccucucccagcccuacagucgaggagucccgcaccauccgggugcucaagaugguugaaccaugguuaaagaacaaucaguuuugcauuaaaguacugaaccccuacaugccugcagugaucgagcaucuugaacgacugcaaagaaagcacgguggcaugcuagucaggaauccacucucacgcaacucuacucaugagauguauuggauaaguaaugggacgggaaacauugugucgagcguuaauauggugucccggcuguugcugaacagauucacaaugacccaccguaggcccacuaucgaaaaagacgucgaucucggcgccgguacccggcacgugaacgcugagccggagacaccuaauauggacguaaucggggaacgcauucgaagaauaaaggaggaacauaacucuacguggcacuacgacgaugagaauccauauaaaaccugggcguaccauggaucauaugaagugaaggccacuggcagcgcauccaguaugaucaacggcguugucaagcuucugacaaaacccugggacguggugccuauggucacccagauggcuaugacugauacaaccccauucgggcagcaaaggguuuuuaaggagaaaguggacacacggacuccccgcccgaugccuggaaccagaaagguaauggagauuacggccgaaugguuauggaggacccugggucgaaauaaacggccccguuuguguacaagagaggaauucacuaagaaggugcgcaccaacgcagccaugggcgcugucuuuacagaggaaaaucagugggauucugccaaagcggcaguggaggacgaggaauucuggaagcucguugauagggagcgggaacugcacaaacuagggaagugcggaagcuguguguacaacaugaugggcaaaagagagaagaaacuuggugaguuugggaaggccaagggaucacgcgcuaucugguauauguggcugggcgccagguaccucgaauucgaggcacugggcuuuuugaaugaagaccauugguucucccgagagaacaguuacagcggggucgaaggagagggucugcacaaacucggcuauauucuucgggauaucucuaagauaccagggggagcuauguacgccgacgauacugcuggcugggacaccagaaucacggaggacgaucugcacaaugaagagaaaauuacacagcagaugaacccugaacauagguuacuggccaaugcaaucuuuaaguugaccuaucaaaacaaagugguaaagguucagcgccccacuccaacagguaccgugauggacauuaucucccguaaggaucagcgggggucaggacaggucggcacuuacggccucaauaccuucacaaacauggaggcgcaacuggugagacagauggaaggggagggagugcuaagcaaagccgaccuugagaacccccaccugccugaaaagaaaauaacgcaguggcucgagaccaagggugucgaaaggcugaaacgcauggcuauuucgggcgaugacugcguugugaagccaaucgaugaccgauuugccaaugcauuguuagcucugaacgauauggggaagguacggaaagacaucccgcaguggcaacccucuaagggauggcaugauuggcagcaggugccuuucugcagucaccacuuucaugagcucauuaugaaagacggcagaaagcuugucgugccauguaggccccaggaugaacugauaggucgcgccagaaucucccaaggggcaggauggagccuacgggagacugccugccugggcaaagcguaugcucagauguggucacucauguacuuccacaggcgugacuugcgacuggccuccaaugcaauuuguucugccguuccugugcauugggucccaacaagccgcaccacuuggaguauccacgcucaucaccaguggaugacaaccgaggacaugcuuacgguguggaacagaguauggauugaagauaaucccuggauggaggacaagacaccuguuaccacuugggaaaacgugccguaucugggcaagcgggaggaucaauggugcgggucccucaucggauuaaccagcagggccacaugggcacagaauauaucuacugcuauccagcagguccgcucacugauugguaacgaggaauucuuggacuacaugccaaguaugaaaagauuucggaaggaggaagaguccgaaggcgccaucugguga

SEQ ID NO: 15606 - RNA, 9873 nt, Artificial Sequence
  derived and/or modified CDS sequence (opt3) from DENV-3__KJ622197__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaacggcaagcgacucgagccaaauugggcuagugugaaaaaggaucugaucucuuacggcgggggauggcgccuuuccgcccaguggcaaaaaggugaagagguacaggucauagcgguggaacccggccggaacccuaagaauuuucagacuaugccagggaucuuccagaccacgacaggagagauuggcgccaucgcauuagacuucaagcccgguacuagcgggucgccuauuaucaacagagaaggaaaaguugugggccuguauggcaauggggucgugaccaagaacggagguuacguuucaggcauagcucaagccaaugcugagccggaugggccaacacccgagcucgaagaggaaauguuuaaaaagaggaacuugaccauuauggaccugcacccuggaucuggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaagagugaacauacagggcgcgagauaguagaucugaugugccacgcuaccuucacuaugagacucuuauccccggugaggguucccaauuauaaccugauuaucauggacgaagcccauuuuacagauccagcaagcauugccgcucggggauacaucucuacccgagucggcaugggcgaggcggccgcaauauucaugacggcuacuccucccgggacagccgaagcauuuccacagagcaaugccccuauucaggacgaggagagagacauccccgaacgcuccuggaacucaggaaaugaguggaucaccgauuucguggguaaaaccgugugguuugucccaaguauuaaggcuggcaacgacaucgccaacugucuuaggaaaaaugggaagaagguaauucaacugagccguaaaacuuucgauacagaauaucagaagaccaaacucaacgacugggauuuugugguuacaacugacauaucugagaugggagcgaauuucaaggcagaucgggugaucgacccgagaaggugcuugaaaccugucauucugacggauggccccgagcgcgugauccucgccgguccaaugcccguuaccgcugccuccgcugcacagcgaagagggcgggugggcaggaacccucagaaggaaaaugaccaauacaucuuuacaggacagccacugaacaaugaugaggaccacgcccacuggacugaagcuaagaugcuucuagacaacauuaauacccccgagggcauaaucccugcccuguucgaaccggagcgcgagaaaucagcagcgauugauggggaauaccguuugaagggagagaguagaaaaacauucgucgaauuaaugcggaggggugaccugccaguguggcucgcccauaagguagcuagcgagggcaucaaauauaccgaucgcaaguggugcuuugacggggaacgaaacaaucagauucuggaggagaacauggauguggaaaucuggacuaaagagggagaaagaaagaagcuucggcccagguggcuggacgcccgcacguacuccaauccucucgcauugaaagaguucaaggauuuugcugccggcagaaaaucuauagcacuggaccuaguuaccgaaaucgguaggguccccucgcaccuggcccaucggacacguaacgcucucgauaaucuugugaugcugcacacuagcgagcacgggggccgcgcguaucgacaugccguggaggaauuaccagagaccauggaaacauugcugcuccugggacuuaugauucugcucaccggcggggcaauguuguuccugaucucaggaaaggguauuggcaaaacuuccaucggguuaauaugugucauuguuaguucuggaaugcuauggauggcugacgugccucugcaguggaucgccagcgccauuguacucgaguuuuucaugauggugcuucugauccccgagccagaaaagcaaagaacaccucaggauaaccaguuggcauacgucgugauaggcauccugacgcucgcugccauuguugcggcuaaugagaugggucugcuugaaaccacuaagagggaccucgggauguccaaagagccgggcguggucucacccacaucuuaucuggauguagacuugcacccagccagcgcauggacccuguacgccguggcuaccacaguuaucacuccuauguuacggcauacgauugaaaacaguaccgcaaacgugucccuagccgcgaucgcuaaucaagccgucgugcugaugggacucgacaagggcuggcccauaagcaaaauggaucuuggggucccacuguuggcacugggaugcuauucucaggugaacccucucacacugacugccgcuguucuuuuacuggugacccacuacgccauuaucggccccggucuccaggcaaaggcuacacgcgaggcccagaaaagaaccgcggccgggaucaugaagaauccgacuguagacggaauuaugacgaucgauuuggacccagugauauacgauucaaaguuugagaaacaacugggccaggucaugcuacugguucucugugcagugcagcuucuguugaugaggacauccugggcucugugcgaagcccucacccuggcaacugguccuauuaccacauuaugggagggcagucccgggaaguucuggaacacuaccaucgcugucagcauggccaauauuuuucggggaucguaucuugccggcgcggggcuggcuuucucuaucaugaaauccgugggaacaggcaagcgagguacggggagccagggagaaacccucggcgagaaauggaagaagaaacuaaaccaacugucaagacgcgaauuugaguuguacaagaaaagugguauaacugagguagacaggacagaagcaaaggagggccugaaacggggggaaaccacucaucacgccgugucucguggauccgcuaagcuccagugguucguugagagaaauauggugaucccagaaggcagggucauugaucuuggguguggacgcggcgguuggagcuauuacugcgccgggcugaaaaaggugacagagguccggggauauaccaagggcggccccgggcacgaggaaccugugccgaugucaacguacggauggaacaccguuaaauugaugagugguaaggacguauuuuaucugcccccagagaaaugugauacacucuuaugcgacaucggcgaaagcuccccuucucccacuguggaggagagccgaaccauuagaguccugaagaugguggaaccuuggcuuaaaaauaaccaguucuguaucaagguucugaauccauacaugcccacagugauugagcaucuagaaaggcuccagcgcaagcacgggggaaugcugguccggaacccuuuguccagaaauucaacucaugagauguacuggaucucuaacggcaccgguaauauagugaguucgguaaacauggugagccgucugcuccuuaacagguucacaaugacccaccggcgcccaacuauugaaaaagauguugaccugggggcaggaacgcgacacgucaaugccgagcccgagacaccgaacauggaugugaucggcgaaagaaucaagaggauuaaagaggaacauuccucuaccuggcacuaugacgacgagaauccuuacaagacuugggcuuaucauggcucauacgaagugaaagcgaccgggagcgccuccaguaugauaaacggagucguuaaguuacugacaaagccaugggaugugguacccauggugacgcaaauggcaaugaccgacacuacaccuuuuggucagcagcgggucuucaaagagaagguggauacccgcacuccaagacccaugccgggcacaaggaaaguuauggagaucaccgcugaaugguuguggcgaacacucgggcggaauaagcguccuagacugugcacucgcgaggaauuuaccaaaaaggugaggacgaacgccgcaaugggagccgucuucaccgaggaaaaucaaugggagucugcucgggccgcgguggaggacgaagaguuuuggaagcuaguaggcagagaacgcgagcuucacaaacuggguaagugugggagcugcguuuauaacaugaugggaaaaagggagaagaaacucggcgaauucggcaaggcaaaagggucacgagccauuugguacauguggcugggagcucgguauuuggaguuugaagcccuggguuuccucaaugaggaucauugguuuuccagagaaaacaguuacagcggcguggagggggagggacuucacaagcugggcuacaucuuaagggacauuucuaagauccccgguggggcaauguaugcugaugacacagccggaugggauacucgcauaaccgaagacgaucugcacaaugaggaaaaaaucacacagcagauggacccagagcaucgucaguuggcuaacgccauuuucaagcucacuuaccaaaauaaagucgugaaggugcagcggccuacccccaaaggcacggucauggacaucauuuccagaaaggaucagaggggcucagggcagguuggaacauauggucugaacaccuuuacuaauauggaagcacaacuaauccgccagauggagggcgagggggugcuuagcaaggcggaccuggaaaacccacaccuccuggagaaaaagauaacacagugguuggaaaccaaaggaguagagcgauuaaagcggauggccauuucgggcgaugacugcguggucaaacccaucgaugacagauucgcuaacgcccugcucgcacuuaaugauauggguaaggugaggaaggacaucccucaguggcaaccaucuaaaggguggcaugauuggcagcagguuccguuuuguagucaccacuuccaugaacugauuaugaaggacggacgcaaacuagugguccccugcagaccucaggaugagcugauaggccgggcuaggaucucccaaggcgccggguggagccucaaggagacugcauguuugggaaaagccuacgcgcagauguggucacugauguauuuccaccgucgagaccuucgccuggcuuccaacgccauuugcucugcagugccaguacauuggguucccaccagcagaacaacguggaguauccacgcccaucaccaguggaugaccacugaagauaugcucacaguguggaaucgggucuggauugaggacaacccuuggauggaagacaagaccccagugacuacaugggaggauguucccuacuuagguaagagggaggaccaaugguguggcucccugaucggguugaccagccgcgcuacgugggcccagaauauacugacagcaauccagcaggugagaucucucauuggagaugaagaguuucuugacuauaugccuucaaugaaacgguucaggaaggaagaggaaagugagggcgcuaucugguga

SEQ ID NO: 15607 - RNA, 9873 nt, Artificial Sequence
  derived and/or modified CDS sequence (opt3) from DENV-3__KJ622198__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaacggcaagcgacucgagccaaauugggcuagugugaaaaaggaucugaucucuuacggcgggggauggcgccuuuccgcccaguggcaaaaaggugaagagguacaggucauagcgguggaacccggccggaacccuaagaauuuucagacuaugccagggaucuuccagaccacgacaggagagauuggcgccaucgcauuagacuucaagcccgguacuagcgggucgccuauuaucaacagagaaggaaaaguugugggccuguauggcaauggggucgugaccaagaacggagguuacguuucaggcauagcucaagccaaugcugagccggaugggccaacacccgagcucgaagaggaaauguuuaaaaagaggaacuugaccauuauggaccugcacccuggaucuggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaagagugaacauacagggcgcgagauaguagaucugaugugccacgcuaccuucacuaugagacucuuauccccggugaggguucccaauuauaaccugauuaucauggacgaagcccauuuuacagauccagcaagcauugccgcucggggauacaucucuacccgagucggcaugggcgaggcggccgcaauauucaugacggcuacuccucccgggacagccgaagcauuuccacagagcaaugccccuauucaggacgaggagagagacauccccgaacgcuccuggaacucaggaaaugaguggaucaccgauuucguggguaaaaccgugugguuugucccaaguauuaaggcuggcaacgacaucgccaacugucuuaggaaaaaugggaagaagguaauucaacugagccguaaaacuuucgauacagaauaucagaagaccaaacucaacgacugggauuuugugguuacaacugacauaucugagaugggagcgaauuucaaggcagaucgggugaucgacccgagaaggugcuugaaaccugucauucugacggauggccccgagcgcgugauccucgccgguccaaugcccguuaccgcugccuccgcugcacagcgaagagggcgggugggcaggaacccucagaaggaaaaugaccaauacaucuuuacaggacagccacugaacaaugaugaggaccacgcccacuggacugaagcuaagaugcuucuagacaacauuaauacccccgagggcauaaucccugcccuguucgaaccggagcgcgagaaaucagcagcgauugauggggaauaccguuugaagggagagaguagaaaaacauucgucgaauuaaugcggaggggugaccugccaguguggcucgcccauaagguagcuagcgagggcaucaaauauaccgaucgcaaguggugcuuugacggggaacgaaacaaucagauucuggaggagaacauggauguggaaaucuggacuaaagagggagaaagaaagaagcuucggcccagguggcuggacgcccgcacguacuccaauccucucgcauugaaagaguucaaggauuuugcugccggcagaaaaucuauagcacuggaccuaguuaccgaaaucgguaggguccccucgcaccuggcccaucggacacguaacgcucucgauaaucuugugaugcugcacacuagcgagcacgggggccgcgcguaucgacaugccguggaggaauuaccagagaccauggaaacauugcugcuccugggacuuaugauucugcucaccggcggggcaauguuguuccugaucucaggaaaggguauuggcaaaacuuccaucggguuaauaugugucauuguuaguucuggaaugcuauggauggcugacgugccucugcaguggaucgccagcgccauuguacucgaguuuuucaugauggugcuucugauccccgagccagaaaagcaaagaacaccucaggauaaccaguuggcauacgucgugauaggcauccugacgcucgcugccauuguugcggcuaaugagaugggucugcuugaaaccacuaagagggaccucgggauguccaaagagccgggcguggucucacccacaucuuaucuggauguagacuugcacccagccagcgcauggacccuguacgccguggcuaccacaguuaucacuccuauguuacggcauacgauugaaaacaguaccgcaaacgugucccuagccgcgaucgcuaaucaagccgucgugcugaugggacucgacaagggcuggcccauaagcaaaauggaucuuggggucccacuguuggcacugggaugcuauucucaggugaacccucucacacugacugccgcuguucuuuuacuggugacccacuacgccauuaucggccccggucuccaggcaaaggcuacacgcgaggcccagaaaagaaccgcggccgggaucaugaagaauccgacuguagacggaauuaugacgaucgauuuggacccagugauauacgauucaaaguuugagaaacaacugggccaggucaugcuacugguucucugugcagugcagcuucuguugaugaggacauccugggcucugugcgaagcccucacccuggcaacugguccuauuaccacauuaugggagggcagucccgggaaguucuggaacacuaccaucgcugucagcauggccaauauuuuucggggaucguaucuugccggcgcggggcuggcuuucucuaucaugaaauccgugggaacaggcaagcgagguacggggagccagggagaaacccucggcgagaaauggaagaagaaacuaaaccaacugucaagacgcgaauuugaguuguacaagaaaagugguauaacugagguagacaggacagaagcaaaggagggccugaaacggggggaaaccacucaucacgccgugucucguggauccgcuaagcuccagugguucguugagagaaauauggugaucccagaaggcagggucauugaucuuggguguggacgcggcgguuggagcuauuacugcgccgggcugaaaaaggugacagagguccggggauauaccaagggcggccccgggcacgaggaaccugugccgaugucaacguacggauggaacaccguuaaauugaugagugguaaggacguauuuuaucugcccccagagaaaugugauacacucuuaugcgacaucggcgaaagccugccuucccccacuguggaggagucucgaaccauuagaguccuuaagaugguggaaccuuggcugaaaaauaaccaguucuguaucaagguucuaaauccauacaugcccacagugauugagcaucucgaaaggcugcagcgcaagcacgggggaauguugguccggaacccucugagcagaaauuccacucaugagauguacuggaucucaaacggcaccgguaauauagugucuaguguaaacauggugucgcgucuccuucugaacagguucacaaugacccaccggcgcccaacuauugaaaaagauguugacuuaggggcaggaacgcgacacgucaaugccgagcccgagacaccgaacauggaugugaucggcgaaagaaucaagaggauuaaagaggaacauagcuccaccuggcacuaugacgacgagaauccuuacaagacuugggcuuaucauggcucuuacgaagugaaagcgaccgggucagccagcuccaugauaaacggagucguuaagcuguugacaaagccaugggaugugguacccauggugacgcaaauggcaaugaccgacacuacaccuuuuggucagcagcgggucuucaaagagaagguggauacccgcacuccaagacccaugccgggcacaaggaaaguuauggagaucaccgcugaauggcucuggcgaacacuggggcggaauaagcguccuagacuaugcacucgcgaggaauuuaccaaaaaggugaggacgaacgccgcaaugggagccgucuucaccgaggaaaaucaaugggagagugcucgggccgcgguggaggacgaagaguuuuggaagcuuguaggcagagaacgcgagcugcacaaacucgguaagugugggucuugcguuuauaacaugaugggaaaaagggagaagaaacugggcgaauucggcaaggcaaaagggagccgagccauuugguacaugugguugggagcucgguaucuggaguuugaagcccucgguuuccuuaaugaggaucauugguuuucaagagaaaacuccuacaguggcguggagggggagggacugcacaaguuaggcuacauccugagggacauuagcaagauccccgguggggcaauguaugcugaugacacagccggaugggauacucgcauaaccgaagacgauuugcacaaugaggaaaaaaucacacagcagauggacccagagcaucgucagcucgcuaacgccauuuucaagcugacuuaccaaaauaaagucgugaaggugcagcggccuacccccaaaggcacggucauggacaucauuucuagaaaggaucagaggggcuccgggcagguuggaacauauggucuaaacaccuuuacuaauauggaagcacaacuuauccgccagauggagggcgagggggugcugucaaaggcggaccucgaaaacccacaccuguuggagaaaaagauaacacagugguuagaaaccaaaggaguagagcgacugaagcggauggccauuagcggcgaugacugcguggucaaacccaucgaugacagauucgcuaacgcccuccuugcacugaaugauauggguaaggugaggaaggacaucccucaguggcaaccaucgaaaggguggcaugauuggcagcagguuccguuuuguucucaccacuuccaugaacuaauuaugaaggacggacgcaaacuggugguccccugcagaccucaggaugagcucauaggccgggcuaggaucagucaaggcgccgggugguccuugaaggagacugcaugucugggaaaagccuacgcgcagauguggagccuuauguauuuccaccgucgagaccugcgccucgcuucaaacgccauuugcuccgcagugccaguacauuggguucccaccucuagaacaacguggagcauccacgcccaucaccaguggaugaccacugaagauauguuaacaguguggaaucgggucuggauugaggacaacccuuggauggaagacaagaccccagugacuacaugggaggauguucccuaccuggguaagagggaggaccaaugguguggcaguuugaucgggcugaccucccgcgcuacgugggcccagaauauacucacagcaauccagcaggugagaagccuuauuggagaugaagaguuucuggacuauaugccuucuaugaaacgguucaggaaggaagaggaaucagagggcgcuaucugguga

SEQ ID NO: 15608 - RNA, 9873 nt, Artificial Sequence
  derived and/or modified CDS sequence (opt3) from DENV-3__KJ622191__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugaggugauccugcucacuaugaaaaacaaggccuggaugguacauagacagugguuuuucgaccugccgcuucccuggaccuccggggcaaucacagagaccccuacuuggaauaggaaagaacuguugguuacauuuaagaacgcucacgccaaaaagcaagagguggucgugcucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuuguccuuaagaaagagguguccgagacacagcacgggacuaucuugauuaagguugaauacaagggagaggacgcgccauguaaaauccccuucucaaccgaagauggccaagguaaggcacauaacgggcgucugauaacggccaauccugugguaaccaaaaaggaggagccagucaacauugaagcugagcccccguucggcgaaagcaauaucgugaucggaauuggcgacaaagcccucaagaucaacugguacaagaaagggaguucuauuggaaagauguuugaggcaacagcccgcggugcuagaaggauggccauacugggcgauacugcaugggacuucggguccguuggaggcgugcuuaauagccuggguaaaaugguccaccagaucuuugggucggcguauaccgcuuuguucggcggagugucuuggauuaugaagaucggcaucgggguacuccugacauggauuggauuaaacuccaaaaauacuucaaugaguuuuagcugcauagugaucggcauuaucacccuguaccuagguacgguuguccaggccgauauggggugugugauuaacuggaagggaaaggaacucaaaugcggcuccgguaucuucgugacaaaugagguccauaccuggacugagcaguauaaguuucaagcagacucuccuaaacggcuggccacagcuauagccggcgcaugggaaaacgggguuuguggaauccgaagcaccacucgcauggagaaucuuuuguggaagcagauugcuaacgaacugaauuacauccucugggagaacaauauuaaacugaccguggugguaggcgauaucauaggggucuuagaacagggaaagagaacacugacgccccagccaauggagcuuaaauauucauggaagaccuggggcaaggccaaaauugugacugcggagauccaaaacaguuccuucauuaucgacgguccuaacacacccgaaugcccaagcgccucuagggcuuggaauguuugggagguggaagacuacggguuuggagucuucaccacaaacauaugguugaagcuccgggagguguauacucagaccugugaucaccgccugaugucagcagccaucaaagacgaaagagcuguucacgccgauaugggcuacuggauugagagucagaagaaugguagcuggaaacuagagaaggcauccuuuaucgaagugaagacgugcacauggcccaaaucucauacccuguggucgaacggcguacucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacugucgugauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggucaagucccugguuucagcuggcagcgggaagguggauaacuuuaccaugggaguauugugccucgccauccuguucgaggaagugaugcgcggcaaauucgggaagaaacacaugauugcaggaguccuacugacuuuuaugcuccugcuuucuggccagauaacauggcgggacauggcucauaccuugaucaugauugguuccaaugccagugauagaauggggaugggagugacguaccuggcauuaaucgccacuuucaagauucagccauuucucgcucugggcuucuuucuuaggaaacugaccagccgcgagaaccuacuccugggcguuggguuggcgauggccacaacccugcaauuacccgaagacaucgagcagauggcaaauggaauagcucucggucugauggcccuuaagcugaucacucaguucgaaacauaucaguuguggaccgcccucgugucucugacauguuccaacacuauuuuuacccuaacggucgcuuggcgaacagcaacccugauccuugccggcgugucacuccugccgguuugccaaaguagcucgaugcggaagacugauugguugccuguggcggucgcugccauggggguaccaccccugccuuuauucauuuuuucccucaaagacacccugaagcguagaucuuggccccuuaaugagggagugauggcaguuggccuggugagcaucuuggccucaagucuccugaggaacgaugucccaauggcugguccucuaguggcagggggacugcuuauagccuguuacguaauuacaggcacuuccgcggaccucaccguggagaaagcugccgacgucacgugggaagaggaagcagagcagacaggcguuucucacaaccugaugaucaccguggaugacgaugggacuaugcgcaucaaggacgaugaaacagagaauauuuugaccguguuacugaaaacugcccuccugauagucagcggaaucuuccccuauuccauuccagcuacacuucugguguggcauaccuggcagaagcagacgcaacggucagguguuuugugggacguaccgagcccucccgagacucagaaagccgaacuagaggaaggcguguacagaaucaagcagcaggggauuuuuggaaagacccaagucggcguggguguucagaaagaggggguguuccacacaauguggcacgucaccaggggagcagugcugacacauaacggcaagcgacucgagccaaauugggcuaguguaaaaaaggaucugaucucuuacggcgggggauggcgccuuuccgcccaguggcaaaaaggugaagagguccaggugauagcgguugaacccggccggaacccuaagaauuuucagacuaugccagggaucuuccagaccacgaugggagagauuggcgccaucgcauuagacuucaagcccgguacaagcgggucgccuauuaucaacagagaaggaaaaguggucggccuguauggcaauggggugguuacuaagaacggagguuacgugucaggcauagcucaagccaaugcugagccggaugggccaacccccgagcucgaagaggaaauguuuaaaaagaggaacuugacaauuauggaccugcacccuggaucuggcaaaacccguaaguaucucccagcaaucguccgcgaggccaucaagcggagacugaggacucuuauucuggcccccacccgagugguagcugcggaaauggaggaggcauugaaaggucuaccuauccgguaccagacaacggccacuaagagugaacauaccgggcgcgagauaguggaucugaugugccacgcuacauucaccaugagacucuuauccccgguuaggguccccaauuauaaccugauuaucauggacgaagcccauuuuacugauccagcaagcauugccgcucggggauacaucucuacacgagugggcaugggcgaggcggccgcaauauucaugaccgcuacgccucccgggacugccgaagcauuuccacagagcaaugccccuauucaggacgaggagagagacauccccgaacgcuccuggaacucaggaaaugaguggaucacagauuucguggguaaaaccgucugguuuguaccaaguauuaaggcuggcaacgacaucgccaacugucuuaggaaaaaugggaagaaggugauucaacugagccguaaaaccuucgauacugaauaucagaagacaaaacucaacgacugggauuuuguugugaccacagacauaucugagaugggagcgaauuucaaggcagaucgggucaucgacccgagaaggugcuugaaaccugugauucugacugauggccccgagcgcguuauccucgccgguccaaugcccgugacggcugccuccgcugcacagcgaagagggcgggucggcaggaacccucagaaggaaaaugaccaauacaucuuuaccggacagccacugaacaaugaugaggaccacgcccacuggacagaagcuaagaugcuucuagacaacauuaauacucccgagggcauaaucccugcccuguucgaaccggagcgcgagaaaucagcagcgauugauggggaauaccguuugaagggagagaguagaaaaaccuucguggaauuaaugcggaggggugaccugccaguauggcucgcccauaagguggcuagcgagggcaucaaauauacagaucgcaaguggugcuuugacggggaacgaaacaaucagauucuggaggagaacauggauguugaaaucuggaccaaagagggagaaagaaagaagcuucggcccagguggcuggacgcccgcacuuacuccgauccucucgcauugaaagaguucaaggacuuugcugccggcagaaaaucuauagcacuggaucuagucacggaaaucgguagggugcccucgcaccuggcccaucggacccguaaugcucucgacaaccuugugaugcugcacacaagcgagcacgggggccgcgcguaucgacaugccgucgaggaauuaccagagacuauggaaaccuugcugcuccugggacuuaugauucugcucacaggcggggcaauguuguuccugaucucaggaaaggguauuggcaaaaccuccaucggguuaauauguguuauugugaguucuggaaugcuauggauggcugauguaccucugcaguggaucgccagcgccauugugcucgaguuuuucaugaugguccuucugauccccgagccagaaaagcaaagaacuccucaggacaaucaguuggcauacgugguuauaggcauccugacacucgcugccauuguggcggcuaacgagaugggucugcuugaaacgaccaagagggaucucgggauguccaaagagccgggcgucguaucacccacuucuuaucuggacguggacuugcacccagccagcgcauggacacuguacgccguugcuaccaccgugaucacaccuauguuacggcauacuauugaaaauaguacggcaaacgucucccuagccgcgaucgcuaaccaagccgugguccugaugggacucgauaagggcuggcccauaagcaaaauggaccuuggggugccacuguuggcacugggaugcuauucucagguuaauccucucacccugacagccgcugugcuuuuacugguaacucacuacgccauuaucggccccggucuccaggcaaaggcuacccgcgaggcccagaaaagaacagcggccgggaucaugaagaacccgaccguggauggaauuaugacuaucgacuuggauccagucauauacgacucaaaguuugagaaacaacugggccagguuaugcuacuggugcucugugcaguccagcuucuguugaugaggacguccugggcucugugcgaagcccucacacuggcaaccgguccuauuacuaccuuaugggagggcagucccgggaaguucuggaauacaacuaucgcugugagcauggccaacauuuuucggggaucguaucuugccggcgcggggcuggcuuucucuaucaugaaauccguaggaaccggcaagcgagguacagggagccagggagaaacgcucggcgagaaauggaagaagaaacuaaaucaacugucaagacgcgaauuugaguuguacaagaaaagugguauaaccgagguggauaggacugaagcaaaggagggccugaaacggggggaaacaacccaucacgccguuucucguggauccgcuaagcuccagugguucguggagagaaacauggucaucccagaaggcagggugauugaccuuggguguggacgcggcgguuggagcuauuacugcgccgggcugaaaaaggucacugaggugcggggauauacaaagggcggccccgggcacgaggaaccuguuccgaugucaaccuacggauggaauacgguaaaauugaugagugguaaggauguguuuuaucugcccccagagaaaugugacacccucuuaugcgauaucggcgaaagcuccccuucucccacagucgaggagagccgaacuauuagagugcugaagaugguugaaccuuggcuuaaaaacaaucaguucuguaucaaggugcugaacccauacaugcccaccgucauugagcaucuagaaaggcuccagcgcaagcacgggggaaugcuggugcggaauccuuuguccagaaacucaacacaugagauguacuggaucucuaauggcacugguaacauaguaaguucggugaauaugguuagccgucugcuccuuaacagguucaccaugacacaccggcgcccaaccauugaaaaagacgucgaucugggggcaggaacucgacacgugaacgccgagcccgagacgccgaauauggacgugaucggcgaaagaaucaagaggauuaaagaggaacauuccucuacauggcacuaugacgaugagaacccuuacaagaccugggcuuaucauggcucauacgaagucaaagcgacugggagcgccuccaguaugauaaauggaguugugaaguuacugaccaagccaugggacguagugcccauggucacacaaauggcaaugacggauaccacuccuuuuggucagcagcggguguucaaagagaagguugacacacgcaccccaagacccaugccgggcacuaggaaagugauggagaucacagcugaaugguuguggcgaacccucgggcggaacaagcguccuagacugugcacacgcgaggaauuuacuaaaaaggucaggaccaaugccgcaaugggagccguguucacggaggaaaaccaaugggagucugcucgggccgcgguagaggaugaagaguuuuggaagcuaguuggcagagaacgcgagcuucacaaacuggguaagugugggagcugcguguauaauaugaugggaaaaagggagaagaaacucggcgaauucggcaaggcaaaagggucacgagccauuugguacauguggcugggagcucgguauuuggaguuugaagcccuggguuuccucaacgaggaccauugguuuuccagagaaaauaguuacagcggcgucgagggggagggacuucacaagcugggcuacaucuuaagggauauuucuaagauccccgguggggcaauguaugcugacgauaccgccggaugggacacacgcauaacugaagaugaccugcacaacgaggaaaaaaucacccagcagauggacccagagcaucgucaguuggcuaaugccauuuucaagcucacauaccaaaacaaaguggugaagguccagcggccuacucccaaaggcaccguuauggauaucauuuccagaaaggaccagaggggcucagggcaggugggaacguauggucugaauacauuuaccaacauggaagcacaacuaauccgccagauggagggcgaggggguacuuagcaaggcggaucuggaaaauccacaccuccuggagaaaaagauaacucagugguuggaaacaaaaggaguggagcgauuaaagcggauggccauuucgggcgacgauugcgucgugaaacccaucgacgauagauucgcuaacgcccugcucgcacuuaacgacauggguaagguuaggaaggauaucccucaguggcaaccaucuaaaggguggcaugacuggcagcaggugccguuuuguagucaccacuuccaugaacugauuaugaaggauggacgcaaacuagucgugcccugcagaccucaggacgagcugauaggccgggcuaggaucucccaaggcgccggguggagccucaaggagaccgcauguuugggaaaagccuacgcgcagauguggucacugauguauuuccaccgucgagaucuucgccuggcuuccaaugccauuugcucugcaguaccaguucauugggugcccacuagcagaaccacauggaguauccacgcccaucaccaguggaugacgaccgaagacaugcucacugucuggaaccggguguggauugaggacaauccuuggauggaagauaagacaccaguuaccacuugggaggacgugcccuacuuagguaagagggaggaucaaugguguggcucccugaucggguugacaagccgcgcuaccugggcccagaacauacugacggcaauccagcaggucagaucucucauuggagacgaagaguuucuugauuauaugccuucaaugaaacgguucaggaaggaagaggaaagugagggcgcuaucugguga

SEQ ID NO: 15609 - RNA, 9873 nt, Artificial Sequence
  derived and/or modified CDS sequence (opt3) from DENV-3__KJ622192__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaacggcaagcgacucgagccaaauugggcuagugugaaaaaggaucugaucucuuacggcgggggauggcgccuuuccgcccaguggcaaaaaggugaagagguacaggucauagcgguggaacccggccggaacccuaagaauuuucagacuaugccagggaucuuccagaccacgacaggagagauuggcgccaucgcauuagacuucaagcccgguacuagcgggucgccuauuaucaacagagaaggaaaaguugugggccuguauggcaauggggucgugaccaagaacggagguuacguuucaggcauagcucaagccaaugcugagccggaugggccaacacccgagcucgaagaggaaauguuuaaaaagaggaacuugaccauuauggaccugcacccuggaucuggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaagagugaacauacagggcgcgagauaguagaucugaugugccacgcuaccuucacuaugagacucuuauccccggugaggguucccaauuauaaccugauuaucauggacgaagcccauuuuacagauccagcaagcauugccgcucggggauacaucucuacccgagucggcaugggcgaggcggccgcaauauucaugacggcuacuccucccgggacagccgaagcauuuccacagagcaaugccccuauucaggacgaggagagagacauccccgaacgcuccuggaacucaggaaaugaguggaucaccgauuucguggguaaaaccgugugguuugucccaaguauuaaggcuggcaacgacaucgccaacugucuuaggaaaaaugggaagaagguaauucaacugagccguaaaacuuucgauacagaauaucagaagaccaaacucaacgacugggauuuugugguuacaacugacauaucugagaugggagcgaauuucaaggcagaucgggugaucgacccgagaaggugcuugaaaccugucauucugacggauggccccgagcgcgugauccucgccgguccaaugcccguuaccgcugccuccgcugcacagcgaagagggcgggugggcaggaacccucagaaggaaaaugaccaauacaucuuuacaggacagccacugaacaaugaugaggaccacgcccacuggacugaagcuaagaugcuucuagacaacauuaauacccccgagggcauaaucccugcccuguucgaaccggagcgcgagaaaucagcagcgauugauggggaauaccguuugaagggagagaguagaaaaacauucgucgaauuaaugcggaggggugaccugccaguguggcucgcccauaagguagcuagcgagggcaucaaauauaccgaucgcaaguggugcuuugacggggaacgaaacaaucagauucuggaggagaacauggauguggaaaucuggacuaaagagggagaaagaaagaagcuucggcccagguggcuggacgcccgcacguacuccgauccucucgcauugaaagaguucaaggacuuugcugccggcagaaaaucuauagcacuggaucuaguuaccgaaaucgguaggguccccucgcaccuggcccaucggacacguaaugcucucgacaaccuugugaugcugcacacuagcgagcacgggggccgcgcguaucgacaugccguggaggaauuaccagagaccauggaaacauugcugcuccugggacuuaugauucugcucaccggcggggcaauguuguuccugaucucaggaaaggguauuggcaaaacuuccaucggguuaauaugugucauuguuaguucuggaaugcuauggauggcugaugugccucugcaguggaucgccagcgccauuguacucgaguuuuucaugauggugcuucugauccccgagccagaaaagcaaagaacaccucaggacaaucaguuggcauacgucgugauaggcauccugacgcucgcugccauuguugcggcuaacgagaugggucugcuugaaaccacuaagagggaucucgggauguccaaagagccgggcguggucucacccacaucuuaucuggacguagacuugcacccagccagcgcauggacccuguacgccguggcuaccacaguuaucacuccuauguuacggcauacgauugaaaauaguaccgcaaacgugucccuagccgcgaucgcuaaccaagccgucgugcugaugggacucgauaagggcuggcccauaagcaaaauggaccuuggggucccacuguuggcacugggaugcuauucucaggugaauccucucacacugacugccgcuguucuuuuacuggugacccacuacgccauuaucggccccggucuccaggcaaaggcuacacgcgaggcccagaaaagaaccgcggccgggaucaugaagaacccgacuguagauggaauuaugacgaucgacuuggauccagugauauacgacucaaaguuugagaaacaacugggccaggucaugcuacugguucucugugcagugcagcuucuguugaugaggacauccugggcucugugcgaagcccucacccuggcaacugguccuauuaccacauuaugggagggcagucccgggaaguucuggaauacuaccaucgcugucagcauggccaacauuuuucggggaucguaucuugccggcgcggggcuggcuuucucuaucaugaaauccgugggaacaggcaagcgagguacggggagccagggagaaacccucggcgagaaauggaagaagaaacuaaaucaacugucaagacgcgaauuugaguuguacaagaaaagugguauaacugagguagauaggacagaagcaaaggagggccugaaacggggggaaaccacucaucacgccgugucucguggauccgcuaagcuccagugguucguugagagaaacauggugaucccagaaggcagggucauugaccuuggguguggacgcggcgguuggagcuauuacugcgccgggcugaaaaaggugacagagguccggggauauaccaagggcggccccgggcacgaggaaccugugccgaugucaacguacggauggaauaccguuaaauugaugagugguaaggauguauuuuaucugcccccagagaaaugugacacacucuuaugcgauaucggcgaaagcuccccuucucccacuguggaggagagccgaaccauuagaguccugaagaugguggaaccuuggcuuaaaaacaaucaguucuguaucaagguucugaacccauacaugcccacagugauugagcaucuagaaaggcuccagcgcaagcacgggggaaugcugguccggaauccuuuguccagaaacucaacucaugagauguacuggaucucuaauggcaccgguaacauagugaguucgguaaauauggugagccgucugcuccuuaacagguucacaaugacccaccggcgcccaacuauugaaaaagacguugaucugggggcaggaacgcgacacgucaacgccgagcccgagacaccgaauauggacgugaucggcgaaagaaucaagaggauuaaagaggaacauuccucuaccuggcacuaugacgaugagaacccuuacaagacuugggcuuaucauggcucauacgaagugaaagcgaccgggagcgccuccaguaugauaaauggagucguuaaguuacugacaaagccaugggacgugguacccauggugacgcaaauggcaaugaccgauacuacaccuuuuggucagcagcgggucuucaaagagaagguggacacccgcacuccaagacccaugccgggcacaaggaaaguuauggagaucaccgcugaaugguuguggcgaacacucgggcggaacaagcguccuagacugugcacucgcgaggaauuuaccaaaaaggugaggacgaaugccgcaaugggagccgucuucaccgaggaaaaccaaugggagucugcucgggccgcgguggaggaugaagaguuuuggaagcuaguaggcagagaacgcgagcuucacaaacuggguaagugugggagcugcguuuauaauaugaugggaaaaagggagaagaaacucggcgaauucggcaaggcaaaagggucacgagccauuugguacauguggcugggagcucgguauuuggaguuugaagcccuggguuuccucaacgaggaccauugguuuuccagagaaaauaguuacagcggcguggagggggagggacuucacaagcugggcuacaucuuaagggauauuucuaagauccccgguggggcaauguaugcugacgauacagccggaugggacacucgcauaaccgaagaugaccugcacaacgaggaaaaaaucacacagcagauggacccagagcaucgucaguuggcuaaugccauuuucaagcucacuuaccaaaacaaagucgugaaggugcagcggccuacccccaaaggcacggucauggauaucauuuccagaaaggaccagaggggcucagggcagguuggaacauauggucugaauaccuuuacuaacauggaagcacaacuaauccgccagauggagggcgagggggugcuuagcaaggcggaucuggaaaauccacaccuccuggagaaaaagauaacacagugguuggaaaccaaaggaguagagcgauuaaagcggauggccauuucgggcgacgauugcguggucaaacccaucgacgauagauucgcuaacgcccugcucgcacuuaacgacauggguaaggugaggaaggauaucccucaguggcaaccaucuaaaggguggcaugacuggcagcagguuccguuuuguagucaccacuuccaugaacugauuaugaaggauggacgcaaacuagugguccccugcagaccucaggacgagcugauaggccgggcuaggaucucccaaggcgccggguggagccucaaggagacugcauguuugggaaaagccuacgcgcagauguggucacugauguauuuccaccgucgagaucuucgccuggcuuccaaugccauuugcucugcagugccaguacauuggguucccaccagcagaacaacguggaguauccacgcccaucaccaguggaugaccacugaagacaugcucacaguguggaaccgggucuggauugaggacaauccuuggauggaagauaagaccccagugacuacaugggaggacguucccuacuuagguaagagggaggaucaaugguguggcucccugaucggguugaccagccgcgcuacgugggcccagaacauacugacagcaauccagcaggugagaucucucauuggagacgaagaguuucuugauuauaugccuucaaugaaacgguucaggaaggaagaggaaagugagggcgcuaucugguga

SEQ ID NO: 15610 - RNA, 9873 nt, Artificial Sequence
  derived and/or modified CDS sequence (opt3) from DENV-3__KJ622193__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaaggcguugugguccucggaucacaggagggcgcuaugcacacggcccugaccggggcaacugaaauucagaauaguggagguacaagcauauucgccggccauuuaaagugucggcugaaaauggauaagcuagagcucaaagggaugucuuaugcuaugugccugaacaccuuugugcuuaagaaagaagucuccgagacacagcacggaacuaucuugauuaagguggaguacaagggcgaagacgcgccauguaaaauccccuucucaaccgaggauggucaagggaaggcacauaacggccgucugauaacggccaauccuguugugaccaaaaaggaagagccaguaaacauugaggcugaacccccguucggagagagcaauaucgucaucggcauuggggacaaagcccucaagaucaacugguacaagaaaggaaguucuauugguaagauguuugaagcaacagcccgcggcgcuagaaggauggccauacugggggauacugcaugggacuucggauccgugggcgguguucuuaauagccuggggaaaauggugcaccagaucuuuggcucggcguauaccgcuuuguucggaggcgucucuuggauuaugaagaucgggaucggagugcuccugacauggauuggcuuaaacuccaaaaauacuucaaugaguuuuagcugcauaguaaucgguauuaucacccuguaccuagggacggugguucaggccgauaugggaugugucauuaacuggaagggcaaggagcucaaaugcgguuccggcaucuucgugacaaaugaagugcauaccuggacugagcaguauaaguuucaagcagacucuccuaaacggcuggccacagcuauagccggggcaugggagaacggagucuguggcauccgaagcaccacucgcauggaaaaucuuuuguggaagcagauugcuaacgagcugaauuacauccucugggaaaacaauauuaaacugaccguuguggugggggauaucauaggaguauuagagcagggcaagagaacacugacgccccagccaauggaacuuaaauauucauggaagaccugggguaaggccaaaauugucacugcggagauccaaaacaguuccuucauuaucgacgggccuaacacacccgagugcccaagcgccucuagggcuuggaaugugugggaaguugaggacuacggauuuggcguguucaccacaaacauaugguugaagcuccgggaagucuauacucagaccugugaucaccgccugaugucagcagccaucaaagacgagagagcugugcacgccgauauggguuacuggauugaaagucagaagaauggcagcuggaaacuagagaaggcauccuuuaucgagguuaagacgugcacauggcccaaaucucauacccuguggucgaacggggugcucgaaagcgacaugauuaucccuaagucccuggcgggaccaauaucacagcacaaucauaggccgggcuaccacacucaaaccgccgggcccuggcaccuuggaaaauuggagcuggauuucaacuauugcgaaggcacaacuguagucauuaccgagaauugugguacacgugggccuaguuuacggacgaccacugugucuggaaagcucauccaugaguggugcugucgaagcugcacacugccaccccuuagauacaugggcgaagacgguuguugguauggcauggagaucaggccuauuaacgaaaaagaggaaaauauggugaagucccuggucucagcugggagcggaaagguugauaacuuuaccaugggcguguugugccucgccauccuguucgaggagguaaugcgcgggaaauucggaaagaaacacaugauugcaggcgugcuacugacuuuuaugcuccugcuuucuggucagauaacauggcgggacauggcucauaccuugaucaugauuggguccaaugccagugauagaaugggaaugggcgucacguaccuggcauuaaucgccacuuucaagauucagccauuucucgcucugggcuucuuucuuaggaaacugaccagccgcgaaaaccuacuccugggggugggauuggcgauggccacaacccugcaauuacccgaggacaucgaacagauggcaaaugguauagcucucggccugauggcccuuaagcugaucacucaguucgagacauaucaguuguggaccgcccucguuucucugacauguuccaacacuauuuuuacccuaacgguggcuuggcgaacagcaacccugauccuugccggggucucacuccugccggugugccaaaguagcucgaugcggaagacugauugguugccuguugcgguggcugccaugggagucccaccccugccuuuauucauuuuuucccucaaagacacccugaagcguagaucuuggccccuuaaugaaggcguaauggcagugggucugguuagcaucuuggccucaagucuccugaggaacgaugugccaauggcugggccucuagucgcaggaggccugcuuauagccuguuacgugauuacaggcacuuccgcggaccucaccguagagaaagcugccgacgugacgugggaggaagaggcagaacagacaggggucucucacaaccugaugaucaccguugaugacgauggaacuaugcgcaucaaggacgaugagacagaaaauauuuugaccguguuacugaaaacugcccuccugauagugagcgguaucuuccccuauuccauuccagcuacacuucuggucuggcauaccuggcagaagcagacgcaacggucaggcguguugugggacguuccgagcccucccgagacucagaaagccgagcuagaagaggggguauacagaaucaagcagcagggaauuuuuggcaagacccaagugggugucggggugcagaaagaaggaguuuuccacacaauguggcacgugaccaggggcgcaguccugacacauaacggcaagcgacucgagccaaauugggcuagugugaaaaaggaucugaucucuuacgggggagguuggcgccuuuccgcccaguggcaaaaaggcgaggaaguacaggucauagcgguggagcccgggcggaacccuaagaauuuucagacuaugccaggaaucuuccagaccacgacaggcgaaauuggugccaucgcauuagacuucaagcccgggacuagcggaucgccuauuaucaacagagagggcaaaguugugggccuguaugggaauggagucgugaccaagaacgguggcuacguuucagggauagcucaagccaaugcugaaccggauggaccaacacccgagcucgaggaagagauguuuaaaaagaggaacuugaccauuauggaccugcacccuggcucugguaaaacucguaaguaucucccagcaaucgugcgcgaagccaucaagcggagacugaggacccuuauucuggcccccacacgagucguggcugcggagauggaagaggcauugaaagggcuaccuauccgguaccagacgacugccaccaagagugagcauacaggacgcgaaauaguagaucugaugugccacgcuaccuucacuaugagacucuuauccccggugaggguucccaauuauaaccugauuaucauggacgaggcccauuuuacagauccagcaagcauugccgcucggggcuacaucucuacccgagucggcaugggggaagcggccgcaauauucaugacggcuacuccucccggaacagccgaggcauuuccacagagcaaugccccuauucaggacgaagagagagacauccccgagcgcuccuggaacucagguaaugaauggaucaccgauuucgugggcaaaaccgugugguuugucccaaguauuaaggcugggaacgacaucgccaacugucuuaggaaaaauggaaagaagguaauucaacugagccguaaaacuuucgauacagaguaucagaagaccaaacucaacgacugggauuuugugguuacaacugacauaucugaaaugggcgcgaauuucaaggcagaucgggugaucgacccgagaaggugcuugaaaccugucauucugacggauggucccgagcgcgugauccucgccgggccaaugcccguuaccgcugccuccgcugcacagcgaagaggccgggugggaaggaacccucagaaggagaaugaccaauacaucuuuacaggccagccacugaacaaugaugaagaccacgcccacuggacugaggcuaagaugcuucuagacaacauuaauacccccgaagggauaaucccugcccuguucgagccggaacgcgagaaaucagcagcgauugauggagaguaccguuugaagggugaaaguagaaaaacauucgucgaguuaaugcggaggggcgaccugccaguguggcucgcccauaagguagcuagcgaagggaucaaauauaccgaucgcaaguggugcuuugacggagagcgaaacaaucagauucuggaagagaacauggauguggagaucuggacuaaagaaggcgagagaaagaagcuucggcccagguggcuggacgcccgcacguacuccgauccucucgcauugaaagaauucaaggacuuugcugccgguagaaaaucuauagcacuggaucuaguuaccgagaucgggaggguccccucgcaccuggcccaucggacacguaaugcucucgacaaccuugugaugcugcacacuagcgaacacggcggacgcgcguaucgacaugccguggaggaguuaccagaaaccauggagacauugcugcuccugggccuuaugauucugcucaccgggggagcaauguuguuccugaucucagguaagggcauugggaaaacuuccaucggauuaauaugugucauuguuaguucuggcaugcuauggauggcugaugugccucugcaguggaucgccagcgccauuguacucgaauuuuucaugauggugcuucugauccccgagccagagaagcaaagaacaccucaggacaaucaguuggcauacgucgugauagguauccugacgcucgcugccauuguugcggcuaacgaaauggggcugcuugagaccacuaagagggaucucggcauguccaaagaaccgggaguggucucacccacaucuuaucuggacguagacuugcacccagccagcgcauggacccuguacgccguggcuaccacaguuaucacuccuauguuacggcauacgauugagaauaguaccgcaaacgugucccuagccgcgaucgcuaaccaagccgucgugcugaugggccucgauaagggguggcccauaagcaaaauggaccuuggagucccacuguuggcacugggcugcuauucucaggugaauccucucacacugacugccgcuguucuuuuacuggugacccacuacgccauuaucggucccgggcuccaggcaaaggcuacacgcgaagcccagaaaagaaccgcggccggaaucaugaagaacccgacuguagauggcauuaugacgaucgacuuggauccagugauauacgacucaaaguuugagaaacaacugggucaggucaugcuacugguucucugugcagugcagcuucuguugaugaggacauccugggcucugugcgaggcccucacccuggcaacuggcccuauuaccacauuaugggaagggagucccggaaaguucuggaauacuaccaucgcugucagcauggccaacauuuuucggggcucguaucuugccggggcgggacuggcuuucucuaucaugaaauccgugggcacagguaagcgagggacgggaagccagggcgagacccucggugaaaaauggaagaagaaacuaaaucaacugucaagacgcgaguuugaauuguacaagaaaaguggcauaacugagguagauaggacagaggcaaaggaagggcugaaacggggagagaccacucaucacgccgugucucguggcuccgcuaagcuccagugguucguugaaagaaacauggugaucccagaggggagggucauugaccuuggauguggccgcgguggguggagcuauuacugcgccggacugaaaaaggugacagaaguccggggcuauaccaagggcgggcccggacacgaggagccugugccgaugucaacguacgguuggaauaccguuaaauugaugaguggcaaggauguauuuuaucugcccccagaaaaaugugacacacucuuaugcgauaucggggagagcuccccuucucccacuguggaagagagccgaaccauuagaguccugaagaugguggagccuuggcuuaaaaacaaucaguucuguaucaagguucugaacccauacaugcccacagugauugaacaucuagagaggcuccagcgcaagcacggaggcaugcugguccggaauccuuuguccagaaacucaacucaugaaauguacuggaucucuaaugguaccgggaacauagugaguucgguaaauauggugagccgucugcuccuuaacagguucacaaugacccaccggcgcccaacuauugagaaagacguugaucugggagcaggcacgcgacacgucaacgccgaacccgagacaccgaauauggacgugaucggcgagagaaucaagaggauuaaagaagagcauuccucuaccuggcacuaugacgaugaaaacccuuacaagacuugggcuuaucaugggucauacgaggugaaagcgaccggaagcgccuccaguaugauaaauggugucguuaaguuacugacaaagccaugggacgugguacccauggugacgcaaauggcaaugaccgauacuacaccuuuuggccagcagcgggucuucaaagaaaagguggacacccgcacuccaagacccaugccggggacaaggaaaguuauggagaucaccgcugagugguuguggcgaacacucggacggaacaagcguccuagacugugcacucgcgaagaguuuaccaaaaaggugaggacgaaugccgcaaugggcgccgucuucaccgaagagaaccaaugggaaucugcucgggccgcgguggaggaugaggaauuuuggaagcuaguagguagagagcgcgaacuucacaaacuggggaaguguggaagcugcguuuauaauaugaugggcaaaagggagaagaaacucggcgaguucgggaaggcaaaaggaucacgagccauuugguacauguggcugggugcucgguauuuggaauuugaggcccugggcuuccucaacgaagaccauugguuuuccagagagaauaguuacagcgggguggaaggagagggccuucacaagcuggguuacaucuuaagggauauuucuaagauccccgggggagcaauguaugcugacgauacagccggcugggacacucgcauaaccgaggaugaccugcacaacgaagagaaaaucacacagcagauggacccagaacaucgucaguuggcuaaugccauuuucaagcucacuuaccaaaacaaagucgugaaggugcagcggccuacccccaaaggcacggucauggauaucauuuccagaaaggaccagagggggucaggacagguugguacauauggccugaauaccuuuacuaacauggaggcacaacuaauccgccagauggaaggggagggagugcuuagcaaggcggaucuggagaauccacaccuccuggaaaaaaagauaacacagugguuggagaccaaaggcguagaacgauuaaagcggauggccauuucgggugacgauugcguggucaaacccaucgacgauagauucgcuaacgcccugcucgcacuuaacgacauggggaaggugaggaaggauaucccucaguggcaaccaucuaaaggauggcaugacuggcagcagguuccguuuuguagucaccacuuccaugagcugauuaugaaggauggccgcaaacuagugguccccugcagaccucaggacgaacugauaggccgggcuaggaucucccaaggggccggauggagccucaaggagacugcauguuuggguaaagccuacgcgcagauguggucacugauguauuuccaccgucgagaucuucgccuggcuuccaaugccauuugcucugcagugccaguacauuggguucccaccagcagaacaacguggaguauccacgcccaucaccaguggaugaccacugaggacaugcucacaguguggaaccgggucuggauugaagacaauccuuggauggaggauaagaccccagugacuacaugggaagacguucccuacuuaggcaagagggaggaucaauggugugggucccugaucggauugaccagccgcgcuacgugggcccagaacauacugacagcaauccagcaggugagaucucucauuggcgacgaggaauuucuugauuauaugccuucaaugaaacgguucaggaaggaggaagagagugaaggugcuaucugguga

SEQ ID NO: 15611 - RNA, 9873 nt, Artificial Sequence
  derived and/or modified CDS sequence (opt3) from DENV-3__KJ622194__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaguggcaagcgacucgagccaaacugggcuucugugaaaaaggaucugaucuccuacggcgggggauggcgccuuagcgcccaguggcaaaaaggugaagagguacaggucauagcgguggaacccggccggaauccuaagaacuuucagacuaugccagggaucuuccagaccacgacaggagagauuggcgccaucgcauuagacuucaagcccgguacuucggggucaccuauuaucaauagagaaggaaaaguugugggccuguauggcaacggggucgugaccaagaauggagguuacguuucuggcauagcucaagccaacgcugagccggaugggccaacacccgagcucgaagaggaaauguuuaaaaagaggaauuugaccauuauggaccugcacccuggaaguggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaaguccgaacauacagggcgcgagauaguagaucugaugugccacgcuaccuucacuaugagacucuuaagcccggugaggguucccaacuauaaucugauuaucauggacgaagcccauuuuacagauccagcaucuauugccgcucggggauacaucagcacccgagucggcaugggcgaggcggccgcaauauucaugacggcuacuccucccgggacagccgaagcauuuccacaguccaacgccccuauucaggacgaggagagagacauccccgaacgcucauggaauaguggaaacgaguggaucaccgauuucguggguaaaaccgugugguuugucccaagcauuaaggcuggcaaugacaucgccaacugucuuaggaaaaacgggaagaagguaauucaacugucucguaaaacuuucgauacagaauaucagaagaccaaacucaaugacugggauuuugugguuacaacugacauauccgagaugggagcgaacuucaaggcagaucgggugaucgacccgagaaggugcuugaaaccugucauucugacggauggccccgagcgcgugauccucgccgguccaaugcccguuaccgcugccucagcugcacagcgaagagggcgggugggcaggaauccucagaaggaaaacgaccaauacaucuuuacaggacagccacugaauaacgaugaggaccacgcccacuggacugaagcuaagaugcuucuagacaauauuaacacccccgagggcauaaucccugcccuguucgaaccggagcgcgagaaaagugcagcgauugauggggaauaccguuugaagggagagagcagaaaaacauucgucgaauuaaugcggaggggugaccugccaguguggcucgcccauaagguagcuuccgagggcaucaaauauaccgaucgcaaguggugcuuugacggggaacgaaauaaccagauucuggaggagaauauggauguggaaaucuggacuaaagagggagaaagaaagaagcuucggcccagguggcuggacgcccgcacguacucugauccucucgcauugaaagaguucaaggacuuugcugccggcagaaaaucgauagcacuggaucuaguuaccgaaaucgguaggguccccagccaccuggcccaucggacacguaacgcucucgacaaucuugugaugcugcacacuucagagcacgggggccgcgcguaucgacaugccguggaggaauuaccagagaccauggaaacauugcugcuccugggacuuaugauucugcucaccggcggggcaauguuguuccugaucuccggaaaggguauuggcaaaacuaguaucggguuaauaugugucauuguuucuagcggaaugcuauggauggcugaugugccucugcaguggaucgccuccgccauuguacucgaguuuuucaugauggugcuucugauccccgagccagaaaagcaaagaacaccucaggacaaccaguuggcauacgucgugauaggcauccugacgcucgcugccauuguugcggcuaaugagaugggucugcuugaaaccacuaagagggaucucgggaugucaaaagagccgggcguggucucucccacaagcuaucuggacguagacuugcacccagccagugcauggacccuguacgccguggcuaccacaguuaucacuccuauguuacggcauacgauugaaaacuccaccgcaaaugugagccuagccgcgaucgcuaaccaagccgucgugcugaugggacucgauaagggcuggcccauaucuaaaauggaccuuggggucccacuguuggcacugggaugcuauucacaggugaacccucucacacugacugccgcuguucuuuuacuggugacccacuacgccauuaucggccccggucuccaggcaaaggcuacacgcgaggcccagaaaagaaccgcggccgggaucaugaagaauccgacuguagauggaauuaugacgaucgacuuggauccagugauauacgacuccaaguuugagaaacaacugggccaggucaugcuacugguucucugugcagugcagcuucuguugaugaggacaaguugggcucugugcgaagcccucacccuggcaacugguccuauuaccacauuaugggagggcagccccgggaaguucuggaacgcuacuaucgccgucucgauggccaauauuuuucggggaucuuaucuugcgggcgcugggcuggcauucuccaucaugaaaagcgugggaaccggcaagcgagguacagggucacagggagaaacgcucggcgagaaauggaagaagaaacuaaaccaacugaguagacgcgaauuugaguuguacaagaaaucugguauaaccgagguagauaggacugaagccaaggagggccugaaacggggggaaacaacccaucacgcugugucccguggaagcgccaagcuccagugguucguugagagaaauauggugaucccagaaggcagggucauugaccuuggguguggacgcggcgguuggucauauuacugcgcagggcugaaaaaggugacugagguccggggauauacaaagggcggccccgggcacgaggaaccugugccgaugaguaccuacggauggaacacgguuaaauugaugagcgguaaggauguauuuuaucugcccccagagaaaugugacacccucuuaugcgauaucggcgaauccucuccuagccccacaguggaggagucccgaacuauuagaguccugaagaugguggaaccuuggcuuaaaaauaaccaguucuguaucaagguucugaauccauacaugcccaccgugauugagcaucuagaaaggcuccagcgcaagcacgggggaaugcugguccggaacccuuugucaagaaauucuacacaugagauguacuggaucaguaacggcacugguaauauagugucgagcguaaacauggugucccgucugcuccuuaauagguucaccaugacacaccggcgcccaaccauugaaaaagacguugaucugggggccggaacucgacacgucaacgcugagcccgagacgccgaacauggacgugaucggcgaaagaaucaagaggauuaaagaggaacauucuucaacauggcacuaugacgaugagaauccuuacaagaccugggcguaucauggcagcuacgaagugaaagccacuggguccgcaaguucuaugauaaacggagucguuaaguuacugaccaagccaugggacgugguacccauggugacacaaauggcuaugacggauaccacuccuuuuggucagcagcgggucuucaaagagaagguggacacacgcaccccaagacccaugccgggcacuaggaaaguuauggagaucacagccgaaugguuguggcgaacccucgggcggaauaagcguccuagacugugcacacgcgaggaauuuacuaaaaaggugaggaccaacgcagccaugggagcugucuucacggaggaaaaucaaugggagagcgcccgggcggcaguggaggaugaagaguuuuggaagcuaguaggcagagaacgcgagcuucacaaacuggguaagugugggucaugcguuuauaacaugaugggaaaaagggagaagaaacucggcgaauucggcaaggccaaagggucccgagcuauuugguacauguggcugggagcccgguauuuggaguuugaagcacuggguuuccucaaugaggaccauugguuuaguagagaaaacagcuacucuggcguggagggggagggacuucacaagcugggcuacaucuuaagggauauuuccaagauccccgguggggcuauguaugccgacgauaccgcuggaugggacacacgcauaacugaagaugaccugcacaaugaggaaaaaaucacccagcagauggacccagagcaucgucaguuggccaacgcaauuuucaagcucacauaccaaaauaaagucgugaaggugcagcggccuacucccaaaggcaccgucauggauaucauuucaagaaaggaccagaggggcagcgggcagguuggaacguauggucugaacacauuuaccaauauggaagcgcaacuaauccgccagauggagggcgagggggugcuuucgaaggccgaucuggaaaacccacaccuccuggagaaaaagauaacucagugguuggaaacaaaaggaguagagcgauuaaagcggauggcuauuucuggcgacgauugcguggucaaacccaucgacgauagauucgccaaugcacugcucgcucuuaacgacauggguaaggugaggaaggauaucccucaguggcaaccaaguaaaggguggcaugacuggcagcagguuccguuuuguucccaccacuuccaugaacugauuaugaaggauggacgcaaacuagugguccccugcagaccucaggacgagcugauaggccgggccaggaucagccaaggcgcaggguggucacucaaggagaccgccuguuugggaaaagcguacgcucagauguggucccugauguauuuccaccgucgagaucuucgccuggccucuaacgcaauuugcagcgccgugccaguacauuggguucccacuaguagaaccacaugguccauccacgcucaucaccaguggaugacgaccgaagacaugcucacuguguggaaucgggucuggauugaggacaacccuuggauggaagauaagacaccagugaccacuugggaggacguucccuacuuagguaagagggaggaucaaugguguggcagccugaucggguugacaucucgcgccaccugggcacagaauauacugacggcuauccagcaggugagaucacucauuggagacgaagaguuucuugauuauaugccuaguaugaaacgguucaggaaggaagaggaauccgagggcgccaucugguga

SEQ ID NO: 15612 - RNA, 9873 nt, Artificial Sequence
  derived and/or modified CDS sequence (opt3) from DENV-3__KJ622195__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaacggcaagcgacucgagccaaauugggcuagugugaaaaaggaucugaucucuuacggcgggggauggcgccuuuccgcccaguggcaaaaaggugaagagguacaggucauagcgguggaacccggccggaacccuaagaauuuucagacuaugccagggaucuuccagaccacgacaggagagauuggcgccaucgcauuagacuucaagcccgguacuagcgggucgccuauuaucgauagagaaggaaaaguugugggccuguauggcaacggggucgugaccaagaauggagguuacguuucaggcauagcucaagccaacgcugagccggacgggccaacacccgagcucgaagaggaaauguuuaaaaagaggaauuugaccauuauggaucugcacccuggaucuggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaagagugaacauacagggcgcgagauaguagaccugaugugccacgcuaccuucacuaugagacucuuauccccggugaggguucccaacuauaaucugauuaucauggaugaagcccauuuuacagacccagcaagcauugccgcucggggauacaucucuacccgagucggcaugggcgaggcggccgcaauauucaugacggcuacuccucccgggacagccgaagcauuuccacagagcaacgccccuauucaggacgaggagagagauauccccgaacgcuccuggaauucaggaaacgaguggaucaccgacuucguggguaaaaccgugugguuugucccaaguauuaaggcuggcaaugauaucgccaacugucuuaggaaaaacgggaagaagguaauucaacugagccguaaaacuuucgacacagaauaucagaagaccaaacucaaugauugggacuuugugguuacaacugauauaucugagaugggagcgaacuucaaggcagaccgggugaucgauccgagaaggugcuugaaaccugucauucugacggacggccccgagcgcgugauccucgccgguccaaugcccguuaccgcugccuccgcugcacagcgaagagggcgggugggcaggaauccucagaaggaaaacgaucaauacaucuuuacaggacagccacugaauaacgacgaggaccacgcccacuggacugaagcuaagaugcuucuagauaauauuaacacccccgagggcauaaucccugcccuguucgaaccggagcgcgagaaaucagcagcgauugacggggaauaccguuugaagggagagaguagaaaaacauucgucgaauuaaugcggaggggugaucugccaguguggcucgcccauaagguagcuagcgagggcaucaaauauaccgaccgcaaguggugcuuugauggggaacgaaauaaccagauucuggaggagaauauggacguggaaaucuggacuaaagagggagaaagaaagaagcuucggcccagguggcuggaugcccgcacguacuccaacccucucgcauugaaagaguucaaggacuuugcugccggcagaaaaucuauagcacuggaucuaguuaccgaaaucgguaggguccccucgcaccuggcccaucggacacguaaugcucucgacaaccuugugaugcugcacacuagcgagcacgggggccgcgcguaucgacaugccguggaggaauuaccagagaccauggaaacauugcugcuccugggacuuaugauucugcucaccggcggggcaauguuguuccugaucucaggaaaggguauuggcaaaacuuccaucggguuaauaugugucauuguuaguucuggaaugcuauggauggcugaugugccucugcaguggaucgccagcgccauuguacucgaguuuuucaugauggugcuucugauccccgagccagaaaagcaaagaacaccucaggacaaucaguuggcauacgucgugauaggcauccugacgcucgcugccauuguugcggcuaacgagaugggucugcuugaaaccacuaagagggaucucgggauguccaaagagccgggcguggucucacccacaucuuaucuggacguagacuugcacccagccagcgcauggacccuguacgccguggcuaccacaguuaucacuccuauguuacggcauacgauugaaaauaguaccgcaaacgugucccuagccgcgaucgcuaaccaagccgucgugcugaugggacucgauaagggcuggcccauaagcaaaauggaccuuggggucccacuguuggcacugggaugcuauucucaggugaauccucucacacugacugccgcuguucuuuuacuggugacccacuacgccauuaucggccccggucuccaggcaaaggcuacacgcgaggcccagaaaagaaccgcggccgggaucaugaagaacccgacuguagauggaauuaugacgaucgacuuggauccagugauauacgacucaaaguuugagaaacaacugggccaggucaugcuacugguucucugugcagugcagcuucuguugaugaggacauccugggcucugugcgaagcccucacccuggcaacugguccuauuaccacauuaugggagggcagucccgggaaguucuggaauacuaccaucgcugucagcauggccaacauuuuucggggaucguaucuugccggcgcggggcuggcuuucucuaucaugaaauccgugggaacaggcaagcgagguacggggagccagggagaaacccucggcgagaaauggaagaagaaacuaaaucaacugucaagacgcgaauuugaguuguacaagaaaagugguauaacugagguagauaggacagaagcaaaggagggccugaaacggggggaaaccacucaucacgccgugucucguggauccgcuaagcuccagugguucguugagagaaacauggugaucccagaaggcagggucauugaccuuggguguggacgcggcgguuggagcuauuacugcgccgggcugaaaaaggugacagagguccggggauauaccaagggcggccccgggcacgaggaaccugugccgaugucaacguacggauggaauaccguuaaauugaugagugguaaggauguauuuuaucugcccccagagaaaugugacacacucuuaugcgauaucggcgaaagcuccccuucucccacuguggaggagagccgaaccauuagaguccugaagaugguggaaccuuggcuuaaaaacaaucaguucuguaucaagguucugaacccauacaugcccacagugauugagcaucuagaaaggcuccagcgcaagcacgggggaaugcugguccggaauccuuuguccagaaacucaacucaugagauguacuggaucucuaauggcaccgguaacauagugaguucgguaaauauggugagccgucugcuccuuaacagguucacaaugacccaccggcgcccaacuauugaaaaagacguugaucugggggcaggaacgcgacacgucaacgccgagcccgagacaccgaauauggacgugaucggcgaaagaaucaagaggauuaaagaggaacauuccucuaccuggcacuaugacgaugagaacccuuacaagacuugggcuuaucauggcucauacgaagugaaagcgaccgggagcgccuccaguaugauaaauggagucguuaaguuacugacaaagccaugggacgugguacccauggugacgcaaauggcaaugaccgauacuacaccuuuuggucagcagcgggucuucaaagagaagguggacacccgcacuccaagacccaugccgggcacaaggaaaguuauggagaucaccgcugaaugguuguggcgaacacucgggcggaacaagcguccuagacugugcacucgcgaggaauuuaccaaaaaggugaggacgaaugccgcaaugggagccgucuucaccgaggaaaaccaaugggagucugcucgggccgcgguggaggaugaagaguuuuggaagcuaguaggcagagaacgcgagcuucacaaacuggguaagugugggagcugcguuuauaauaugaugggaaaaagggagaagaaacucggcgaauucggcaaggcaaaagggucacgagccauuugguacauguggcugggagcucgguauuuggaguuugaagcccuggguuuccucaacgaggaccauugguuuuccagagaaaauaguuacagcggcguggagggggagggacuucacaagcugggcuacaucuuaagggauauuucuaagauccccgguggggcaauguaugcugacgauacagccggaugggacacucgcauaaccgaagaugaccugcacaacgaggaaaaaaucacacagcagauggacccagagcaucgucaguuggcuaaugccauuuucaagcucacuuaccaaaacaaagucgugaaggugcagcggccuacccccaaaggcacggucauggauaucauuuccagaaaggaccagaggggcucagggcagguuggaacauauggucugaauaccuuuacuaacauggaagcacaacuaauccgccagauggagggcgagggggugcuuagcaaggcggaucuggaaaauccacaccuccuggagaaaaagauaacacagugguuggaaaccaaaggaguagagcgauuaaagcggauggccauuucgggcgacgauugcguggucaaacccaucgacgauagauucgcuaacgcccugcucgcacuuaacgacauggguaaggugaggaaggauaucccucaguggcaaccaucuaaaggguggcaugacuggcagcagguuccguuuuguagucaccacuuccaugaacugauuaugaaggauggacgcaaacuagugguccccugcagaccucaggacgagcugauaggccgggcuaggaucucccaaggcgccggguggagccucaaggagacugcauguuugggaaaagccuacgcgcagauguggucacugauguauuuccaccgucgagaucuucgccuggcuuccaaugccauuugcucugcagugccaguacauuggguucccaccagcagaacaacguggaguauccacgcccaucaccaguggaugaccacugaagacaugcucacaguguggaaccgggucuggauugaggacaauccuuggauggaagauaagaccccagugacuacaugggaggacguucccuacuuagguaagagggaggaucaaugguguggcucccugaucggguugaccagccgcgcuacgugggcccagaacauacugacagcaauccagcaggugagaucucucauuggagacgaagaguuucuugauuauaugccuucaaugaaacgguucaggaaggaagaggaaagugagggcgcuaucugguga

SEQ ID NO: 15613 - RNA, 9873 nt, Artificial Sequence
  derived and/or modified CDS sequence (opt3) from DENV-3__KJ622196__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaaucacagagaccccuacuuggaauaggaaagaacuguugguaacauuuaagaacgcucacgccaaaaagcaagagguugugguccucggcucacaggaaggagcuaugcacacggcccugaccggcgcaacugagauucagaauagugggggaacaagcauauucgccggucauuuaaagugucggcugaaaauggauaagcuagaacucaaaggcaugucuuaugcuaugugccugaacaccuuugugcuuaagaaagaggucuccgagacacagcacgggacuaucuugauuaagguggaauacaagggagaggacgcgccauguaaaauccccuucucaaccgaagauggccaagguaaggcacauaacgggcgucugauaacggccaauccuguugugaccaaaaaggaggagccaguaaacauugaagcugagcccccguucggcgaaagcaauaucgucaucggaauuggcgacaaagcccucaagaucaacugguacaagaaagggaguucuauuggaaagauguuugaggcaacagcccgcggugcuagaaggauggccauacugggcgauacugcaugggacuucggguccgugggaggcguucuuaauagccuggguaaaauggugcaccagaucuuugggucggcguauaccgcuuuguucggcggagucucuuggauuaugaagaucggcaucggggugcuccugacauggauuggauuaaacuccaaaaauacuucaaugaguuuuagcugcauaguaaucggcauuaucacccuguaccuagguacggugguucaggccgauauggggugugucauuaacuggaagggaaaggaacucaaaugcggcuccgguaucuucgugacaaaugaggugcauaccuggacugagcaguauaaguuucaagcagacucuccuaaacggcuggccacagcuauagccggcgcaugggaaaacggggucuguggaauccgaagcaccacucgcauggagaaucuuuuguggaagcagauugcuaacgaacugaauuacauccucugggagaacaauauuaaacugaccguuguggugggcgauaucauagggguauuagaacagggaaagagaacacugacgccccagccaauggagcuuaaauauucauggaagaccuggggcaaggccaaaauugucacugcggagauccaaaacaguuccuucauuaucgacgguccuaacacacccgaaugcccaagcgccucuagggcuuggaaugugugggagguugaagacuacggguuuggaguguucaccacaaacauaugguugaagcuccgggaggucuauacucagaccugugaucaccgccugaugucagcagccaucaaagacgaaagagcugugcacgccgauaugggcuacuggauugagagucagaagaaugguagcuggaaacuagagaaggcauccuuuaucgaaguuaagacgugcacauggcccaaaucucauacccuguggucgaacggcgugcucgagagcgacaugauuaucccuaagucccuggcggggccaauaucacagcacaaucauaggccgggauaccacacucaaaccgccggccccuggcaccuugggaaauuggaacuggauuucaacuauugcgagggaacaacuguagucauuaccgagaauuguggcacacgugguccuaguuuacggacgaccacugugucugggaagcucauccaugaauggugcugucgaagcugcacacugccaccccuuagauacaugggagaggacggcuguugguaugguauggaaaucaggccuauuaacgagaaagaagagaauauggugaagucccuggucucagcuggcagcgggaagguugauaacuuuaccaugggaguguugugccucgccauccuguucgaggaaguaaugcgcggcaaauucgggaagaaacacaugauugcaggagugcuacugacuuuuaugcuccugcuuucuggccagauaacauggcgggacauggcucauaccuugaucaugauugguuccaaugccagugauagaauggggaugggagucacguaccuggcauuaaucgccacuuucaagauucagccauuucucgcucugggcuucuuucuuaggaaacugaccagccgcgagaaccuacuccugggcgugggguuggcgauggccacaacccugcaauuacccgaagacaucgagcagauggcaaauggaauagcucucggucugauggcccuuaagcugaucacucaguucgaaacauaucaguuguggaccgcccucguuucucugacauguuccaacacuauuuuuacccuaacgguggcuuggcgaacagcaacccugauccuugccggcgucucacuccugccggugugccaaaguagcucgaugcggaagacugauugguugccuguugcgguggcugccaugggggucccaccccugccuuuauucauuuuuucccucaaagacacccugaagcguagaucuuggccccuuaaugagggaguaauggcagugggccugguuagcaucuuggccucaagucuccugaggaacgaugugccaauggcugguccucuagucgcagggggacugcuuauagccuguuacgugauuacaggcacuuccgcggaccucaccguagagaaagcugccgacgugacgugggaagaggaagcagagcagacaggcgucucucacaaccugaugaucaccguugaugacgaugggacuaugcgcaucaaggacgaugaaacagagaauauuuugaccguguuacugaaaacugcccuccugauagugagcggaaucuuccccuauuccauuccagcuacacuucuggucuggcauaccuggcagaagcagacgcaacggucagguguguugugggacguuccgagcccucccgagacucagaaagccgaacuagaggaaggcguauacagaaucaagcagcaggggauuuuuggaaagacccaagugggcgucggugugcagaaagaggggguuuuccacacaauguggcacgugaccaggggagcaguccugacacauaacggcaagcgacucgagccaaauugggcuagugugaaaaaggaucugaucucuuacggcgggggauggcgccuuuccgcccaguggcaaaaaggugaagagguacaggucauagcgguggaacccggccggaacccuaagaauuuucagacuaugccagggaucuuccagaccacgacaggagagauuggcgccaucgcauuagacuucaagcccgguacuagcgggucgccuauuaucaacagagaaggaaaaguugugggccuguauggcaauggggucgugaccaagaacggagguuacguuucaggcauagcucaagccaaugcugagccggaugggccaacacccgagcucgaagaggaaauguuuaaaaagaggaacuugaccauuauggaccugcacccuggaucuggcaaaacucguaaguaucucccagcaaucgugcgcgaggccaucaagcggagacugaggacccuuauucuggcccccacacgagucguggcugcggaaauggaggaggcauugaaaggucuaccuauccgguaccagacgacugccaccaagagugaacauacagggcgcgagauaguagaucugaugugccacgcuaccuucacuaugagacucuuauccccggugaggguucccaauuauaaccugauuaucauggacgaagcccauuuuacagauccagcaagcauugccgcucggggauacaucucuacccgagucggcaugggcgaggcggccgcaauauucaugacggcuacuccucccgggacagccgaagcauuuccacagagcaaugccccuauucaggacgaggagagagacauccccgaacgcuccuggaacucaggaaaugaguggaucaccgauuucguggguaaaaccgugugguuugucccaaguauuaaggcuggcaacgacaucgccaacugucuuaggaaaaaugggaagaagguaauucaacugagccguaaaacuuucgauacagaauaucagaagaccaaacucaacgacugggauuuugugguuacaacugacauaucugagaugggagcgaauuucaaggcagaucgggugaucgacccgagaaggugcuugaaaccugucauucugacggauggccccgagcgcgugauccucgccgguccaaugcccguuaccgcugccuccgcugcacagcgaagagggcgggugggcaggaacccucagaaggaaaaugaccaauacaucuuuacaggacagccacugaacaaugaugaggaccacgcccacuggacugaagcuaagaugcuucuagacaacauuaauacccccgagggcauaaucccugcccuguucgaaccggagcgcgagaaaucagcagcgauugauggggaauaccguuugaagggagagaguagaaaaacauucgucgaauuaaugcggaggggugaccugccaguguggcucgcccauaagguagcuagcgagggcaucaaauauaccgaucgcaaguggugcuuugacggggaacgaaacaaucagauucuggaggagaacauggauguggaaaucuggacuaaagagggagaaagaaagaagcuucggcccagguggcuggacgcccgcacguacuccaauccucucgcauugaaagaguucaaggauuuugcugccggcagaaaaucuauagcacuggaccuaguuaccgaaaucgguaggguccccucgcaccuggcccaucggacacguaacgcucucgauaaucuugugaugcugcacacuagcgagcacgggggccgcgcguaucgacaugccguggaggaauuaccagagaccauggaaacauugcugcuccugggacuuaugauucugcucaccggcggggcaauguuguuccugaucucaggaaaggguauuggcaaaacuuccaucggguuaauaugugucauuguuaguucuggaaugcuauggauggcugacgugccucugcaguggaucgccagcgccauuguacucgaguuuuucaugauggugcuucugauccccgagccagaaaagcaaagaacaccucaggauaaccaguuggcauacgucgugauaggcauccugacgcucgcugccauuguugcggcuaaugagaugggucugcuugaaaccacuaagagggaccucgggauguccaaagagccgggcguggucucacccacaucuuaucuggauguagacuugcacccagccagcgcauggacccuguacgccguggcuaccacaguuaucacuccuauguuacggcauacgauugaaaacaguaccgcaaacgugucccuagccgcgaucgcuaaucaagccgucgugcugaugggacucgacaagggcuggcccauaagcaaaauggaucuuggggucccacuguuggcacugggaugcuauucucaggugaacccucucacacugacugccgcuguucuuuuacuggugacccacuacgccauuaucggccccggucuccaggcaaaggcuacacgcgaggcccagaaaagaaccgcggccgggaucaugaagaauccgacuguagacggaauuaugacgaucgauuuggacccagugauauacgauucaaaguuugagaaacaacugggccaggucaugcuacugguucucugugcagugcagcuucuguugaugaggacauccugggcucugugcgaagcccucacccuggcaacugguccuauuaccacauuaugggagggcagucccgggaaguucuggaacacuaccaucgcugucagcauggccaauauuuuucggggaucguaucuugccggcgcggggcuggcuuucucuaucaugaaauccgugggaacaggcaagcgagguacggggagccagggagaaacccucggcgagaaauggaagaagaaacuaaaccaacugucaagacgcgaauuugaguuguacaagaaaagugguauaacugagguagacaggacagaagcaaaggagggccugaaacggggggaaaccacucaucacgccgugucucguggauccgcuaagcuccagugguucguugagagaaauauggugaucccagaaggcagggucauugaucuuggguguggacgcggcgguuggagcuauuacugcgccgggcugaaaaaggugacagagguccggggauauaccaagggcggccccgggcacgaggaaccugugccgaugucaacguacggauggaacaccguuaaauugaugagugguaaggacguauuuuaucugcccccagagaaaugugauacacucuuaugcgacaucggcgaaagcuccccuucucccacuguggaggagagccgaaccauuagaguccugaagaugguggaaccuuggcuuaaaaauaaccaguucuguaucaagguucugaauccauacaugcccacagugauugagcaucuagaaaggcuccagcgcaagcacgggggaaugcugguccggaacccuuuguccagaaauucaacucaugagauguacuggaucucuaacggcaccgguaauauagugaguucgguaaacauggugagccgucugcuccuuaacagguucacaaugacccaccggcgcccaacuauugaaaaagauguugaccugggggcaggaacgcgacacgucaaugccgagcccgagacaccgaacauggaugugaucggcgaaagaaucaagaggauuaaagaggaacauuccucuaccuggcacuaugacgacgagaauccuuacaagacuugggcuuaucauggcucauacgaagugaaagcgaccgggagcgccuccaguaugauaaacggagucguuaaguuacugacaaagccaugggaugugguacccauggugacgcacauggcaaugaccgacacuacaccuuuuggucaacagcgggucuucaaagagaagguggauacccgcacuccaagacccaugccgggcacaaggaaaguuauggagaucaccgcugaaugguuguggcgaacacucgggcggaauaagcguccuagacugugcacucgcgaggaauuuaccaaaaaggugaggacgaacgccgcaaugggagccgucuucaccgaggaaaaucagugggagucugcucgggccgcgguggaggacgaagaguuuuggaagcuaguaggcagagaacgcgagcuucauaaacuggguaagugugggagcugcguuuauaacaugaugggaaaaagggagaagaaacucggcgaauucggcaaggcaaaagggucacgagccauuugguacauguggcugggagcucgguauuuggaguuugaagcccuggguuuccucaaugaggaucacugguuuuccagagaaaacaguuacagcggcguggagggggagggacuucacaagcugggcuacaucuuaagggacauuucuaagauccccgguggggcaauguaugcugaugacacagccggaugggauacucgcauaaccgaagacgaucugcauaaugaggaaaaaaucacacaacagauggacccagagcaccgucaguuggcuaacgccauuuucaagcucacuuaccagaauaaagucgugaaggugcaacggccuacccccaaaggcacggucauggacaucauuuccagaaaggaucagaggggcucagggcagguuggaacauauggucugaacaccuuuacuaauauggaagcacagcuaauccgccaaauggagggcgagggggugcuuagcaaggcggaccuggaaaacccacaucuccuggagaaaaagauaacacagugguuggaaaccaaaggaguagagcgauuaaagcggauggccauuucgggcgaugacugcguggucaaacccaucgaugacagauucgcuaacgcccugcucgcacuuaaugauauggguaaggugaggaaggacaucccucaguggcagccaucuaaaggguggcacgauuggcaacagguuccguuuuguagucaccauuuccacgaacugauuaugaaggacggacgcaaacuagugguccccugcagaccucaggaugagcugauaggccgggcuaggaucucccagggcgccggguggagccucaaggagacugcauguuugggaaaagccuacgcgcaaauguggucacugauguauuuccaucgucgagaccuucgccuggcuuccaacgccauuugcucugcagugccaguacacuggguucccaccagcagaacaacguggaguauccaugcccaccaccaguggaugaccacugaagauaugcucacaguguggaaucgggucuggauugaggacaacccuuggauggaagacaagaccccagugacuacaugggaggauguucccuacuuagguaagagggaggaccagugguguggcucccugaucggguugaccagccgcgcuacgugggcccaaaauauacugacagcaauccagcaggugagaucucucauuggagaugaagaguuucuugacuauaugccuucaaugaaacgguucaggaaggaagaggaaagugagggcgcuaucugguga

SEQ ID NO: 15614 - RNA, 9873 nt, Artificial Sequence
  derived and/or modified CDS sequence (opt3) from DENV-3__KJ830751__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuugggccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacauggguugugucaucaauuggaaagggaaggagcugaagugcggauccggcauuuucgugaccaacgaggugcauacuuggacagaacaguacaaauuucaagcugauucucccaagcggcuagccaccgcaaucgcuggugccugggagaauggcgucugugggauacgaagcacuacccgcauggaaaaccuccuguggaaacagaucgcgaaugagcuuaacuauauuuugugggaaaauaacaucaagcugacaguuguggugggagacacgauuggcguacucgagcaggggaaaagaacccugacuccacagccuauggaguuaaaguacucauggaaaacauggggaaaggccaagaucgucaccgcugaaacacaaaacaguuccuucauaauugauggccccaauacuccagagugccccagcgcaucuagggccuggaacgugugggaaguugaggacuaugguuuugggguguucaccacgaauaucuggcugaaacuucgggaagucuacacacaguugugugaccaccgccucaugucagcugccgugaaggaugagagagcaguucacgcggacaugggauacuggauugagagucagaaaaacggcagcuggaagcuggaaaaagccucccuaaucgaggugaagaccugcacuuggccuaagucucauacccuguggucgaaugguguacucgaaagcgauaugauaaucccaaaaucccuggcuggcccgauuucacagcacaacuauaggcccggguaccauacacaaacugccggaccuuggcaccuuggcaaguuggagcuggacuuuaauuauugcgaggggaccacagucgugaucacggaaaguuguggaacccguggcccaucuuuacggacuacaaccgugagcgguaaacucauucacgaguggugcugucgauccugcacucugcccccucuuagauacaugggggaagauggauguugguauggcauggagaucaggccaauaucagaaaaggaggagaacauggucaaaagccugguuucugcagguuccggcaagguggacaauuucacaauggggguauugugccucgcuauucuguacgaagaggugaugcgcggaaaguuuggcaaaaagcauaugaucgccggggucuucuucaccuuugugcuacugcucaguggacagaucacguggcggaacauggcacacacucugauuaugaucggcagcaaugccucugauagaauggguauggggguuaccuaucuugcuuugauugcgacauucaaaauacagcccuuucuggccuuaggauucuuucucaggaagcugaccucccgcgaaaaccuucugcuaggcgugggccucgcaauggcuacuacacugcaauugccggacgauaucgagcagauggccaaugggauugcccugggauuaauggcucucaaacugaucacccaguucgaaacauaccagcuuuggacugcacuggucucauugaccuguaguaacacgauguuuacacucaccguggccuggcgaacugcgacccugauucuagcugguguuagccugcuuccugugugccaaucguccucuaugcggaagacagacuggcucccaauggccgucgcagccaugggcguacccccucugcccuuguucaucuuuaaucugaaggauacuuuaaaacguagaagcuggccacucaacgagggggugauggcuguuggacuggugucaauacuugcaaguucccuguugaggaacgacgucccuauggccggcccccucguggcgggugggcugcuaaucgcuuguuacguaauuaccggaacgucugccgaucugacaguggagaaggcagccgacgucaccugggaagaggaagcugagcagacuggcguuagccauaaucuuaugaucacaguggacgaugacggcaccaugcgcauuaaagaugacgaaaucgagaacauacucacugugcuguugaagacagccuuacugauugucuccgggaucuucccauauucaaucccggcaacccuccugguguggcacacguggcagaaacagacucaacggagcggaguucuuugggauguaccuagucccccagagacccagaaggcugaacuggaggaagguguguacagaauuaaacagcagggcauauuugggaagacacaagucggagugggcguucagaaggaggguguguuccauaccauguggcacgucacaaggggggccguguugacucacaauggaaaacgacuagagcccaacugggcgucuguaaagaaagaccugaucuccuauggcggcggguggcgccucagcgcccaguggcaaaagggagaagagguccaggugauugcaguugaaccugguaaaaauccaaagaacuuucagaccaugcccggcacguuccagacaacuaccggggagaucggagcuauugcccuggauuucaagccuggcacaucggguucaccgaucauaaaucgggaagggaaaguggucggacuuuacggcaacggcgugguuaccaagaaugggggauaugugucugguaucgcucaaacuaacgcagagccagacggccccaccccugaguuagaagaggaaauguuuaaaaagagaaaucugacaauuauggaucuccauccagggaguggaaaaacgaggaaguacuugcccgccaucguccgugaggccauuaagcgccggcugagaacucucauccuggcuccuaccagggugguagcggcagaaauggaggaggcccuuaaaggccugccgauacgauaucagacaaccgcuacuaaguccgaacacacaggucgggagauuguggacuugaugugccaugccaccuucacgaugcgccuacugagccccguuagagucccaaacuacaaucucaucaucauggaugaagcacacuuuacugacccugccucuauugcugcgaggggguacaucagcacacgggugggaaugggcgaggccgcagcuauauucaugaccgccacccccccaggcacugcagaugccuuuccucaguccaacgcucccauucaggacgaagagcgagacaucccagagagaucauggaauagugggaacgaauggauuacagauuucgccggaaaaaccgugugguuugucccgagcaucaaggcggguaacgacauagcaaauuguuuacgcaaaaacggcaagaagguaauucaacugucuaggaaaacauucgauacugaguaucagaagacgaaacuuaaugacugggauuuugugguuaccacagacaucuccgaaaugggggccaacuucaaggcugaucgugugaucgacccucggagaugccugaaacccgucauucucacugauggaccagagagggugaucuuggccggccccaugccuguuaccgcugcaucagccgcucagcgccgagguagaguggggcggaauccacagaaggagaacgaccaauacauuuuuacaggccagccccugaauaacgaugaagaccaugcccacuggaccgaggcaaagaugcuccuggacaauauaaacacuccugaaggaauccuuccggcgcuauucgagccagaaagggagaaaagugccgcuauugauggcgaguaucgccugaagggggaaagccguaaaacguucgucgaguugaugagacggggagacuuacccguguggcuggcccacaagguagcauccgaagguaucaaauacaccgauaggaaguggugcuuugacggccagcgcaauaaccagauccucgaggaaaauauggauguggagauuuggacaaaagagggggaaaagaagaaacugcgaccuagauggcuugacgcucggacuuauucugauccccuggcccucaaggaguucaaagacuuugcagccggaaggaagucgauagcuuuggaucugguuaccgaaaucggccgcgucccaagccaucuagcgcacagaacaaggaacgcccuggacaaucucgugaugcuucauaccucagagcacggugggcgggcauaccgucacgcuguggaagagcugccugagacuauggaaacauuauugcugcucggccugaugauucuucugacgggaggcgccaugcucuucuugaucuccgggaaaggaauugguaagaccaguaucggccugauaugugucaucgccucuagcgggauguuauggauggcagagguuccccuacaauggauugcuuccgccaucgugcuggaauuuuucaugaugguacuccuuauuccagagccugagaagcagcgcacuccgcaggauaaccaacuggcguauguggucaucggaauauugacacuggcugccauuaucgcagccaaugaaaugggccuccuggagaccaccaaacgagaccuugguaugucaaaggaacccggggugguuucuccaacaagcuaccucgauguggaccugcauccugcuagugcauggacuuuguacgccgucgcgacgaccguaauuacacccaugcugagacacacuaucgagaacuccaccgcuaacgugagcuuagccgcaauagccaaucaggcuguugugcuaaugggccuggacaaaggauggccaaucucuaagauggaucucggcgucccucuucuggccuuggggugcuauucacaggugaacccccugacacucaccgcagcuguccugcuuuuaauuacucauuacgccaucauuggaccgggccugcaggcgaaagccacgagggaagcacaaaagcggacagcugccgguaucaugaagaauccaaccguggacgggauaaugacuauugaucucgacccuguuaucuaugauuccaaauuugagaagcaguugggacaggugaugcugcuaguacugugugcagugcagcuccuucugaugcgcaccaguugggcuuugugcgaggcccugacacucgccacuggccccaucaccacacugugggaagguagcccaggcaaauucuggaacacgaccauugcggucucgauggcuaauaucuuuagagggucuuacuuagcaggagccggccuugcuuucuccauaaugaagagcguugggacuggaaaaaggggcacagguucacaaggggagacccugggagaaaaguggaagaaaaagcucaaccagcuaagucggaaagaguuugaccuguauaagaaaucuggcauuacugaaguggaucgaacagaggccaaggaggguuugaaaagaggcgaaaccacgcaccaugcagucucccgcgggagcgccaagcugcagugguucguggagaggaauaugguagugcccgaaggacggguuaucgaccucggcugugggcguggaggcuggucauacuauugcgcuggucuuaagaaagugaccgaggucagaggguacacaaagggaggcccuggccacgaagagccggugcccaugaguacuuacggguggaacauugucaaacugaugagcggaaaggauguguuuuauuugccaccugagaaaugugacacccugcucugcgauaucggugaauccucucccagcccuacaguugaggaauccaggacuauacgcguauuaaagaugguggagccauggcugaagaauaaccaguucuguaucaaaguccuuaaucccuacaugccuaccgugauugagcaccuggaacggcuacaacgaaagcauggcgggaugcucguuagaaacccacugucaaggaauucuacacacgagauguauuggaucaguaacggaaccggcaauauugugucgagcgucaacauggugucccgcuugcugcucaaccgguucacuaugacgcauagacgucccacaaucgaaaaagacguagaucuuggugcggggaccaggcacgugaaugccgagccggaaacuccuaacauggacguuauuggagagcggaucaagcgcauaaaagaggaacacaauucuaccuggcauuacgacgaugagaacccauauaagacaugggcauaccacggcucauaugaagucaaggcuacgggcagcgccuccaguaugauuaaugggguggugaaacuguuaaccaagcccugggacgucguuccuauggugacucagauggcaaugacagauaccacuccauuuggacagcaacgaguauucaaagagaagguggacacaagaacccccaggccgaugccugguacacggaaagucauggaaaucacugccgaguggcuguggcgcaccuugggcagaaacaagaggccccgacucugcacgcgggaggaauuuaccaagaaagugcguacaaaugcugccaugggggcgguuuucacugaggaaaaccagugggauucugcaaaggccgcuguggaggacgaagaguuuuggaaacuggucgauagagagcgcgaacuacauaagcuuggaaaauguggcagcugcguguacaauaugauggguaagagggagaaaaagcugggggaauucggaaaggccaaaggcucacgggcaaucugguacauguggcucggcgcuagauaucuggaguuugaggccuugggguuccugaacgaagaccacugguuuucccgcgagaauaguuacagcggaguagaaggugagggccuccauaagcuuggguauauucugagggauauaucuaaaaucccaggaggcgcuauguacgccgacgauaccgcagguugggacacacgaauuacugaagacgauuuacacaacgaggagaagaucauucagcagauggacccugaacaccggcaacuggcgaaugccaucuucaaauugaccuaucagaacaagguugugaagguccagagacccacgccaacagggaccgugauggauauaaucuccaggaaagaccagcgcggaucaggccaagugggcacuuacgggcucaauacauuuaccaacauggaggcucagcugguccgucagauggaaggagaggguguucuaacuaaggccgaucuugaaaacagccaucugcccgagaaaaagauuacccaguggcucgagacaaaaggcguggaacggcugaagagaauggcaaucucgggggacgauugcguagugaagccuauugacgauagguucgcuaaugccuuggucgcauuaaacgacaugggaaaagugcgcaaggauaucccacaauggcagccgucucgaggcuggcacgacuggcagcagguucccuuuuguagucaucacuuccacgagcugauaaugaaagauggucggaagcucguggucccuugcagaccacaagacgaacuuauugggagggcccgcaucucccagggagcgggcuggagccugagagagacggcuugucuaggcaaagccuaugcacagauguggucacugauguacuuccaucggagggaccuccguuuggccuccaaugcuaucugcucugccgugcccguacacuggguuccuaccagccgaacuacauggaguauucaugcacaccaucaauggaugaccacugaagauaugcugacaguguggaaccgcgucuggauagaggagaauccauggauggaagacaagacccccgugacgacaugggagaacguuccuuaccuugggaagagagaagaucagugguguggaucccugaucggucucaccagccgggcuacuugggcccagaauauuccgaccgcgauccagcaagugaggucuuuaauuggcaacgaggaguuucuggacuauaugccaucaaugaaacgcuucagaaaggaagaggaaagugagggggcuaucugguga

SEQ ID NO: 15615 - RNA, 9873 nt, Artificial Sequence
  derived and/or modified CDS sequence (opt3) from DENV-3__KC762681__SS-prME
accagccugugccucaugaugaugcuucccgccacucuggcuuuccacuugacuuccagagacggcgaaccuaggaugaucguggggaagaacgaacggggaaaaucuuuacuguuuaagacggccucagguauuaauauguguacccugauagccauggaucucggcgaaaugugcgacgauaccgucacuuacaaauguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguuuaucgagggaaaagugguccagcacgaaaaucugaaguauacugugauaauuaccguucauacaggugaccagcaccaggugggcaacgagacccaaggggucacugccgaaaucacgccccaggcauccacaguggaggcuauucucccugaauacggaacccuuggccuggagugcucuccacgaacugguuuggacuucaaugagaugauccuacugaccaugaaaaacaaggccuggaugguacauagacagugguuuuucgaucucccgcugcccuggacaagcggggcgaccacugaaacaccuacguggaauaaaaaggagcuucugguuaccuuuaaaaacgcccacgcaaagaagcaagaaguggucguguugggcucccaggagggagcuaugcacacugcccucacaggcgcuaccgaaauccagacaucagggggaacaaguauuuucgccggucaucugaaauguagguuaaagauggacaaacuggagcuaaagggcaugagcuaugcaaugugccucaaugccuucguccugaaaaaggaggugucugaaacccagcacgggacgauacuuaucaagguugaguacaaaggagaagaugcuccauguaagauucccuuuuccaccgaggacggccaagguaaagcgcauaacgggcgguugaucacagcaaacccugugguaacuaagaaagaggaaccagucaauauagaggccgaacccccguucggcgagucaaacauugugaucggaaucggcgauaaggcucugaagauuaauugguacaaaaaggggagcaguaucggaaaaauguuugaagccaccgcacguggugcccgcagaauggcuauucucggcgacacagccugggauuucgggucuguuggaggcgugcugaacucccuugguaagaugguccaccagauauuugggagcgcauauacugcgcuguucucgggcgugucuuggaucaugaaaauuggaaucggcguauugcucaccuggaucgggcuaaauuccaagaacacgucaaugaguuuuagcugcauugugauaggaaucauuacauuauaccugggcgcuguuguccaggccgacauggguugugugaucaauuggaaggggaaagagcuaaagugcggauccggcauuuucgugaccaacgagguccauacuuggacagaacaguauaaauuucaagcagauucuccuaagaggcucgccaccgcuaucgccggugcaugggagaauggcguuugugggauacggagcacuacccgaauggaaaaccugcuuuggaaacagaucgcuaaugaguugaacuacauucugugggaaaauaacaucaagcucacaguggugguaggagacauuaucggcguccuggagcaggggaaacgcacguuaacaccccagccaauggaucugaaguauucauggaagacuuggggaaaagccaagauagugacagcggagacccaaaauaguuccuucauuaucgacggcccuaacacacccgaaugcccaagcgccucuagagcuuggaacguuugggagguggaagacuacgguuuuggggucuucacuaccaauauuuggcuuaaauugagggagauguauacgcagcucugugaucaccggcugaugucagcagccgugaaggacgaacgcgcuguucacgccgauaugggauacuggaucgagagucagaaaaacggcagcuggaagcuagagaaggcaucccugauagaagugaaaacaugcaccuggcccaagucucauacucucuggucgaaugguguacuggagagcgacaugaucauuccuaaaucccuugcgggcccagucucacagcacaacuacagaccgggguaucauacccaaacagccggacccuggcacuugggcaagcuggaauuagauuuuaauuacugcgaggggacuaccguggugaucacagagaacuguggaacgaggggcccuagucuccguaccacuacagucucugguaaacugauucacgaauggugcugucggagcugcacccuuccaccccugcgauauaugggggaggacggauguugguacggcauggaaaucagaccuauaaaugagaaggaagagaacaugguuaaguccuuggugucagcugguagcggcaaaguagauaauuucacuaugggggugcucugccuggccauucuauucgaggaagucaugaggggaaaguuuggcaaaaagcauaugaucgcaggggugcuguucacauuuguucuccugcuuucuggacagaucaccuggcgcgacauggcucggacguugauuaugaucggcuccaacgccagugauagaauggguaugggggugacuuaucuggcauuaauugccaccuucaaaauacagccauuucucgcucugggauucuuucuuaggaagcugacaagccgcgagaaucuacuccugggcgucggcuuggcgauggccaccacucugcaauuacccgaagacaucgagcagauggcaaacgggauugcucucggacugauggcccuuaagcugaucacacaguucgaaaccuaccaguuguggacagcccucgugucucugauguguuccaauacuauguuuacccuaacgguugcuuggcgaacagcaacccugauucuugccgguaucucacuccugccggugugccaaaguagcucgaugcggaaaacugauugguugccugucaccguagcggcuaugggcgugccaccccugccuuuauucauauuuucccucaaggacacacugaaacguagaucuuggccccuuaacgaggggguuauggccgugggacuggucagcaucuuggcaucaagucuccugaggaaugaugugccaauggccggcccucuaguagcuggugggcugcuuauugcauguuaugugaucacuggaaccuccgccgaccucacggucgagaaggcggcugacguuauuugggaagaggaagccgagcagacaggcgugucucacaaccugaugaucaccguggaugacgauggcacuaugcgcauaaaagacgaugaaacagagaacauuuugaccgucuuacugaagacugcacuccugaucgugagcgggaucuuccccuacuccauuccagccacacuucugguuuggcauaccuggcagaaacagacgcaacggucaggaguauugugggacgugccgagcccucccgagacucagaaggcugaacuagaggaaggugucuacagaauaaagcagcagggcaucuuugggaaaacccaagugggaguuggcgugcagaaggagggugucuuccacacaauguggcaugugaccagaggggccguacugacacacaauggaaaacgacucgagccaaacugggcaagugucaagaaagaucugauuucuuauggcggcggguggcgccuuuccgcucaguggcaaaagggagaagaggugcagguuaucgccguggaacccgguaagaauccuaaaaacuuccagacuaugccaggcauuuuucagaccacgacaggggagaucggagcgauagccuuagacuucaagcccggcacuagcgguucgccuaucauuaaucgggaagggaaagucgugggacuguacggcaacggcguugugaccaagaaugggggauaugucucagguaucgcacaaacaaacgcugagccggauggcccaacccccgagcucgaagaggaaauguuuaaaaagagaaauuugacuauuauggaccugcacccugggucuggaaagaccaggaaauaccucccagccaucgugcgugaggcuauaaagcgccggcugagaacacuuauucuggcacccacgaggguaguggccgccgaaauggaggaggcuuugaaaggccuaccuauccgauaucagacuaccgcgacaaagagugcacauaccgguaaagaaaucguugaucugaugugccacgccacuuucacaaugcggcucuuauccccgguccgcgugcccaacuacaaucugauuaucauggacgaggcucauuuuaccgauccagccagcauagcagccagaggguauauuucuacgagggugggaaugggcgaagcugcggccaucuucaugacugcaacaccucccggcaccgcugacgccuuuccacagagcaacgcaccuauucaggacgaggaacgggauauccccgagcgauccuggaacucagggaacgaguggauaaccgacuucgccggaaagacugucugguuuguaccaaguauuaaggcugguaaugauaucgccaacugucuuaggaagaauggcaagaaagugauccaacugagccgcaagacauucgacaccgaauaccagaaaacaaagcucaaugauugggacuuuguugugacuacggauauuucugagaugggggcgaacuucaagaccgacagggucaucgauccgcgucggugcuugaaaccugugauucugacagacggacccgaaagaguuauacucgcaggcccaaugcccgugacugucgccuccgcugcccagaggcgcggucgaguggggagaaauccucagaaggagaacgaucaauacaucuucaccggccagccacugaauaacgacgaggaccacgcucauuggacagaagcaaaaaugcuucuagauaauauuaacacccccgagggaaucaucccugcccuguuugaaccggagcgggaaaagucagcugccauugacggcgaguauagguugaaaggggagagucgcaagacuuucguagaauuaaugcguagaggagaucugccaguguggcucgcacacaaaguugcgagcgaggguauaaaguacacggaccggaaguggugcuuugauggcgaaaggaauaaccagauccuggaggaaaauauggacgucgagauuuggaccaaagagggggaaaagaagaaacuucgcccccgauggcuggaugccagaacauauuccgacccucucgcuuugaaagaguucaaagauuuugccgcaggacggaagucuaucgcucuggaccuagugacugaaauuggcagggugcccucgcaccuggcccaucgcaccagaaacgcacucgauaaucuugucaugcugcacacaagcgagcauggugggagggccuaccggcacgcuguugaagaguuaccagagaccauggaaacuuugcugcuccugggccuuaugauccugcucacaggaggcgcgauguuguuccugauaucagggaaaggaaucgguaagacguccauuggcuuaaucugugugguagccaguucugggaugcuauggauggcagacgugccucugcaguggauugcuagcgccaucguccucgaguuuuucaugauggugcuucugauacccgaaccagagaaacaacguaccccucaggauaaccaguuggccuauguugugauuggaauccugacucucgcagcuauugucgccgcgaaugagaugggccugcuugaaacaaccaagcgcgaccucgguauguccaaagagccggggguagugucacccaccucuuaccuggacguugauuugcacccagcuagcgccuggacacuguaugcaguggccacuacggucaucaccccuauguuacgacauacaauagaaaacaguacugcuaaugugucccuagcagccaucgcgaaccaagcugucgugcugaugggccucgacaagggauggcccauuagcaagauggaucuuggcguuccacuguuggcccuggggugcuacucucaggugaacccucucacccugacagcagccguacuuuuacuggugacccacuacgcuaucauuggacccggccuccaggccaaagcaacuagagaggcucagaagaggacggccgcggguaucaugaaaaauccgacagucgacgggauaaugaccauugauuuggacccaguuaucuaugauucaaaguuugaaaaacaacugggacaggugaugcuacugguccucugugccgugcagcuucuguugaugcggacuuccugggcauucugcgaggcucugacccucgccacaggcccuaucacuacccugugggaggguagucccggcaaguuuuggaacacaacgauugcaguaagcauggcuaauaucuuccgcgggucguacuuagccggagccggccuugcguuuucuauaaugaaguccguggggaccggaaaaagaggcacugguagccagggggaaacacugggagagaaguggaaaaagaaacucaaccaacuaucaaggaaggaguucgaccuguauaaaaagaguggcauuaccgagguugaucggacugaagcuaaggaggguuugaaacgaggcgagaucacacaucacgcagugucuagaggguccgccaagcugcagugguucgucgaacgcaauauggugauuccagagggaagggucaucgaccucggcugugggcggggaggcuggagcuacuauugcgcuggucuuaaaaaggugaccgaaguucguggguacacgaaaggaggccccggccaugaggaaccuguaccgaugucaaccuauggguggaacauagugaagcugaugaguggaaaggaugucuuuuacuugcccccagagaaaugugacacacugcucugcgauaucggugagagcuccccuucucccacuguggaagagagcagaaccauuaggguuuuaaagaugguggaaccuuggcugaaaaauaaccaguucuguaucaagguccuuaauccauacaugcccacagugauugagcaccuggagcgccuacagcggaaacacggcgggaugcucguacgaaacccucuguccagaaauucaacucaugaaauguauuggaucucuaacggaaccggcaauauugugaguucgguuaacauggucagcagguugcugcucaaucgcuuuacaaugacccaccggagaccaacuaucgagaaggacguggaccuuggugccgggacgcgucaugugaacgcagaacccgagacaccgaacauggaugucauaggagaaaggauucggcgcaucaaggaggagcacuccucuaccuggcacuacgacgaagagaauccuuauaaaacuugggccuaccauggcucauaugaaguuaaggcuaccggcagcgcguccaguaugaucaacggggugguaaaacuguuaacaaagccaugggaugugguccccacggugacccaaauggccaugacugacacaaccccuuucggacagcagcgaguuuuuaaagagaagguggauacuagaacaccaaggcccaugccggguacccggaaggcaauggaaauuacagcugaguggcuguggcgcacuuugggcagaaauaaaaggccucgacucugcacccgggaggaguucacgaagaaaguccguaccaacgccgcaaugggggccguguuuacagaggaaaaucaaugggacucugcuagagccgcgguagaggaugaagaguucuggaagcugguugaccgcgagagggaacuacacaaacuuggaaaguguggcagcugcguguacaacaugauggguaaacgggagaagaagcugggggaauuuggaaaagcaaagggcucaagagccauaugguauauguggcucggcgcucgcuaccuggaguucgaggccuugggguuucugaaugaagaucauugguucuccagggagaacaguuuuagcggagucgaaggugagggccuccacaaacuuggguacauccugcgagacauuucuaagauccccggaggcgcaauguaugcugaugacacugccgguugggacacccggauuacagaagaugacuuacauaaugaggagaaaaucacucagcagauggauccagaacacagacagcuggcuaacgccauauucaaguugaccuaccaaaauaagguggugaaaguccagaggccuacgcccaaggggacaguuauggacaucauuucccgcaaagaucagcguggaucaggccaggugggcaccuaugggcucaacacuuucacaaauauggagguacaacugauccggcagauggaaggagagggugugcuaagcaaggcagaccuugaaaacccacaucugcucgagaaagagauuacccaguggcuggaaacuaagggcgucgagagauugaagaggauggcgaucucgggggaugacugcgugguuaaacccauagaugaccgcuuugccgaugcuuuacuggcccucaaugacaugggaaaggugcgaaaagauauuccucaguggcaaccaucuaagggcuggcaugacuggcagcaggucccguucuguagucaccauuuucacgaacuuaucaugaaagacggucggaagcuggugguacccugcagaccucaggaugagcuaaucgggagggcacgcauuucccaaggagcuggcuggagccugaaggaaaccgccugucucggcaaagcauacgcccagaugugggcguugauguauuuccacagacgggaccugaggcuugcuucaaacgccauaugcuccgcaguuccagugcauuggguccccacaucucguacgaccuggagcauccacgcccaucaccaguggaugacuacagaggauaugcugaccguguggaaccgaguuuggauugaggacaauccuuggauggaagauaagacuccagugacaaccugggaggacguccccuaccucgggaaacgcgaagaucaaugguguggaaguuuaaucggucuggcuuccagagccacgugggcacagaacauuuugacagcuauccaacaggugcggagccugauaggcaaugaggaguuucucgacuauaugccuucuaugaagagguuccgcaaagaagaggaaucagagggggccaucugguga

SEQ ID NO: 15616 - RNA, 9873 nt, Artificial Sequence
  derived and/or modified CDS sequence (opt3) from DENV-3__KC762684__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacaguguccauaacuguucauaccggugaccagcaccaggugggcaacgagacacaaggggucaccgcagaaauuacuccccaggcuucuacgguggaggccauccuuccugaauacggaacacugggcuuggagugcagcccacgaaccggucuagacuuuaaugagaugauucugcucacuaugaaaaacaaggcguggaugguacauagacagugguucuuugaucugccgcuucccuggaccuccggggccacaaccgaaacuccuacauggaauaaaaaggagcuguugguuacguucaaaaacgcacacgcuaagaagcaagaaguggucgugcucggcucacaggagggagccaugcacaccgcucugacuggcgccacagaaauccagaccagugggggaacaagcaucuuugcaggucauuuaaaauguaggcugaagauggacaaacuagagcucaagggcaugucuuaugccaugugcuccaaugcuuucguccugaaaaaggaggugucagaaacucagcacgggaccauucuuauaaagguugaguacaaaggagaagaugcgccauguaagauccccuucagcacggaggacggccaagguaaagcacauaacgggcgguugauuaccgccaacccugugguaacaaagaaagaggaaccagucaauaucgaggcugaacccccguuuggcgagaguaacauaauuaucggaaucggcgauaaggcccugaagauuaauugguacaaaaaggggucuuccaucggaaaaauguucgaagcaacugcccguggugcucgcagaauggccauucucggcgacaccgcaugggauuuugggagcgugggaggcguucugaacucgcuugguaagauggugcaccagauauucgggucugcguauacagcucuguuuuccggcgucucauggaucaugaaaauuggaaucggcguguugcucacuuggaucgggcugaauaguaagaacaccagcauguccuucucuugcauuguaauaggaaucauuacguuauaccugggcgccgugguucaggcagacauggguugugucaucaauuggaaggggaaagagcuaaagugcggaagcggcauuuuugugacaaacgaggugcauaccuggacugaacaguauaaauuccaagccgauucaccuaagaggcucgcuacagccaucgcaggugcuugggagaauggcgucugugggauacggaguaccacucgaauggaaaaccugcuuuggaaacagaucgccaaugaguugaacuacauucugugggaaaauaacaucaagcucaccguuguggugggagacauuaucggcauacuggagcaggggaaacgcacauuaacgccccagccaauggagcugaaguauuccuggaagaccuggggaaaagcgaagauuguaacugccgaaaugcaaaauagcucuuuuaucauugauggcccuaacacacccgagugcccaaacgcuucaagagcauggaaugucugggaaguggaggacuacgguuucgggguuuuuaccacaaacaucuggcuuaaauugagggaaauguauacucagcucugugaccaccggcugaugagugccgcuauaaaggaugagcgcgccgugcacgcagacaugggauacuggaucgagagccagaaaaauggcuccuggaagcuagaaaaggcgucucugauugaggucaaaaccugcacguggcccaagucgcauacacucuggagcaacggugugcuggaauccgauaugaucauuccuaaaucacuugccggcccaaucagucagcacaauuacagaccgggguaucauacccaaacugcuggacccuggcacuugggcaagcuggaguuagacuucaacuacugcgaggggaccacaguugugauaacugaaaauuguggaaccaggggcccuucucuccguacaacgaccguaagcgguaaacugauucacgaguggugcugucgguccugcacucuuccaccccugcgauauaugggggaagauggauguugguacggcauggagaucagaccuaucaacgaaagggaggagaauauggucaagucauuggugagcgccgguucuggcaagguggacaacuuuacaauggggguccucugccuggcaauucuauucgaagagguuaugcgcggaaaauucggcaagaaacauaugaucgcugggguguuuuucaccuuuguacugcuccuguccggacagauuacuuggcgggauauggccagaacacuuauaaugaucggcaguaaugcaagcgacaggauggguaugggggugaccuauuuggcccugauugcuacguucaagauccagccauuuuuagcgcucggauucuuucugcgcaaacuuacuucucgagaaaaccugcuacucggcgucggccuggccauggcaaccacauugcaacugcccgaggauauugaacagauggcuaaugggaucgccuuaggacucauggcccugaagcuugugacccaguucgagacuuaccagcuguggacagcuuugguuucccucauguguucaaacaccauauuuacacugacuguggcauggcggaccgccacgcuaauccuggcggguauuagucuucucccgcugugccaaagcucgggcaugcguaagacagacugguugccuaugaccgucgcugccaugggggugccaccccugccuuuauucaucuuuucccucaaagauacucugaagagaaggucuuggccccuuaaugagggaguuauggcagugggccuggucagcauuuuggccucaagucuccugcgcaacgacguaccaauggcugguccucuaguggcagggggacugcuuaucgccuguuauguuauaaccggcacauccgcggaucucacuguggaaaaagcugccgacgucaccugggaggaagaggcagaacagacgggcgugucucacaaccugaugauuacaguagacgaugacgggaccaugcggaucaaggaugacgagacugagaauaucuugacaguguuacugaaaaccgcccuccugauugucagcggaauauuccccuacuccaucccagcuacucuucugguuuggcauacauggcagaagcagacccaaagaucagguguguugugggaugugccgagcccucccgaaacgcagaaagccgagcuagaagagggcgucuacaggauuaagcagcaggggaucuuuggaaagacucaagugggcguugguguacagaaagaggggguguuccacaccauguggcaugucacacgaggagcagugcugaccuauaacggcaagcgccucgaaccaaauugggcuaguguuaaaaaggaccugauuucuuacggcgggggauggcggcuuuccgcccaguggcaaaaaggugaggaagugcaggucaucgcgguggagcccggcaagaacccuaagaauuuccagacaaugccagggauauuucagacuaccacgggagaaaucggcgccauugcauuagauuucaaacccgguacaagcgggucgccuaucauuaacagagagggaaagguagucggccuguauggcaauggggugguuacuaaaaacggagguuacgugucaggcaucgcucaaaccucugccgagccggacgggccaacacccgaacucgaggaagagauguuuaagaaaaggaauuugaccauaauggaucugcacccuggaaguggcaagacucguaaguaucucccagcuauuguccgcgaagcaaucaaacggagacugaggacccuuauccuggcccccacacgagugguugccgcugagauggaggaagcguugaagggucuaccuauucgguaccagacgacugcaaccaaauccgagcacacagggaaggaaaucguggaccugaugugccaugccaccuucacuaugcgccucuuaagcccggucagagugcccaacuauaaucugauaauuauggaugaggcucacuuuacagacccagccucuaucgcagccaggggauacauuagcacccggguaggcaugggcgaagcugcggccaucuucaugacggcaacuccucccgggacagcugaugccuuuccacaguccaacgcaccuauacaggacgaggagcgagacauucccgaaagaucauggaauaguggaaacgauuggaucaccgacuucgccgguaaaaccgugugguuuguuccaagcaucaaggcuggcaaugauauugccaacugucuucgcaagaacgggaaaaaggucauccaacugucuaggaaaacuuucgacacagaguaccagaagaccaaacucaaugauugggacuuuguggugacaacugauauuuccgaaaugggagcgaacuucaaggcagaccgugucauagauccgcggagaugcuugaagccuguaauccugacggacggccccgagagggugauucucgccgguccaaugcccguuaccguggcuucagccgcucagcgccgagggagagucggccggaauccucagaaagagaacgaucaauauaucuucacaggacagccacugaauaacgacgaagaccaugcacacuggacugaggccaagaugcuucuagauaauaucaacacccccgaaggcauuauaccugcucuguuugagccggaaagggagaaaagugccgcaaucgacggggaguaccgcuugaagggagaaagccguaaaacauucguggaguuaaugagacggggugaucugccaguuuggcucgcgcauaagguggccuccgaaggcauuaaauauaccgacaggaaguggugcuuugauggggagcgcaauaaccagauccuggaagagaauauggacgucgagauuuggacuaaggaaggagagaaaaagaaacuucgacccagauggcuggaugcucggacguacucugacccucucgccuugaaggaauucaaagauuuugcagcuggcaggaagucgaucgcccuggaccuagugaccgagauaggucgcguacccagccaccuggcacacagaacaaggaacgcccucgauaaucuugugaugcugcauacuucagaacacgggggccgggcuuaucgucaugcgguugaggaguuaccagaaaccauggagacauugcugcuccugggacuuaugauccugcucaccggcggggucauguuguuccugauuuccggaaagggugugggcaaaacuaguaucggguuaauuuguguggucgccucuagcuccaugcuauggauggcagacaucccucugcaguggauagcuucagccauuguucucgaauuuuucaugauggugcuucugauccccgagccagagaagcaacgcacaccucaggauaaccaguuggccuacguagugauuggaauccugacgcucgcagcuauagucgccgcgaaugaaaugggccugcuugagaccacuaaacgagaccucgguaugucuaaggaaccgggggugguuagccccacaaguuaucuggacguggauuugcacccagcuuccgccuggacccuguacgcagucgccaccacaguaaucacuccuauguuaagacacacgauugagaacagcaccgcuaaugugucucuagcagccaucgcgaaccaagcuguugugcugaugggccucgacaaaggauggcccauuucaaagauggaucuuggcgucccacuguuggcccuggggugcuacucccaggugaacccucucacacugacugcagccguccuuuuacuggugacccauuaugcuaucauaggacccggccuccaggccaaggcaacaagggaagcucagaaacggaccgccgcggguauuaugaagaauccgacuguugacgggaucaugacgaucgauuuggacccagugauuuacgauaguaaauuugagaagcaacugggacagguaaugcuacuggugcucugugccguccagcuucuguugaugcgcacaagcugggcauucugcgaggcucugacccucgccacuggcccuaucaccacacugugggaagguucgcccggcaaauuuuggaacacuaccauagcaguuucuauggcuaauauuuucagaggguccuauuuagccggagccggccuugcguuuagcaucaugaagucaguggggacaggaaagaggggcacggguagucagggggagacccugggagaaaaauggaagaaaaagcucaaccaacuaucucggaaagaguucgaccuguacaagaaauccggcauuacugaagucgaucgaacagaggcuaaggaggguuugaagagaggcgaaaucacccaccaugcagugagccgcgggucagccaaacugcagugguucguagagaggaauauggugauaccagaaggacggguuaucgaccucggcugugggcguggaggcuggaguuauuacugcgcuggucuuaagaaagugacugaggucagaggguauacaaagggaggccccggccacgaagagccugugccgaugagcaccuacggguggaacauugucaaacugauguccggaaaggauguguuuuacuugcccccagagaagugugacacgcugcucugcgauaucggugaaucuagcccuucccccaccguugaggaaucaaggacaauucgcguauuaaaaaugguggagccuuggcugaagaauaaccaguucuguaucaaaguccuuaauccauauaugcccgccgugauugagcaucuggaacggcuacagcgaaagcacggcgggaugcucguuagaaacccucugucuaggaauaguacucacgagauguacuggaucucgaacggaaccggcaauauagugagcuccgucaacauggugucucgcuugcugcucaaucgguuuacaaugacuuauagacguccaaccauugaaaaagacguagaccuuggugcagggacaaggcaugugaacgccgagcccgaaaccccgaacauggauguuaucggagagcggauccgccgaauuaaggaggaacacucaagcacuuggcauuacgacgaugagaauccuuauaagacgugggcuuaccacggcuccuaugaagucaaagcgacaggcagugccucuagcaugauaaacgggguggugaagcuguuaaccaaaccaugggacgucguucccacugugacccaaauggcaaugacagauacgaccccuuucggacagcagagaguauuuaaggagaaaguggacacuaggacaccaaagcccaugccggguacccggaaggucauggaaaucacugcugaguggcuguggcgcacauugggcagaaauaaaaggccucgacucugcacccgggaggaauucacaaagaaagugcguacuaacgccgcaaugggggccguuuuuaccgaggaaaaucaaugggauucagcuagagccgcgguggaggacgaagaguucuggaagcuggucgaucgcgagagggaacuacacaaacuuggaaaguguggcuccugcguguacaacaugauggguaaacgggagaagaagcugggggaauuuggaaaagcaaagggcaguagagccauuugguacauguggcucggcgcucgcuaucuggaguucgaggccuugggguuucugaaugaagaccauugguucagcagggagaacucuuacuccggaguagaaggugagggccuccacaaacuuggguauauccugcgagauauuucaaagauccccggaggcgcaauguacgcugacgacacggccgguugggauacccggauaacagaagacgauuuacauaaugaggagaaaaucacucagcagauggacccagaacacagacagcuggcuaacgccauuuuuaaguugaccuaucaaaauaagguugugaaaguccagaggccuacacccaaggggacugugauggauaucauuagccgcaaagaccagcguggaucgggccaggugggcaccuacgggcucaacacguucacaaauauggaggcacaacugauccggcagauggaaggagaggguguccuaucuaagaccgaucuugaaaacccacaucugcucgagaaaaagauaacucaguggcuggagacaaagggcguugaaagauugaaaaggauggcgauuaguggggacgauugcgugguaaagcccaucgacgaucgcuucgccaaugcuuuacuggcccucaacgacaugggaaaagugcgaaaggauaucccucaguggcaaccauccaaaggcuggcacgacuggcagcaggucccguuuuguagccaccauuuccacgagcuuauuaugaaggacggucggaagcuggugguucccugcagaccucaggaugaacuaauagggagggcacgcaucucacaaggagcuggcuggucccugaaagagaccgccugucucggcaaggcauaugcccagaugugggcguugauguacuuucauagacgggaccugaggcuugcuucuaacgccauuugcagcgcagugccaguccacugggugcccacuagucguaccacaugguccauccacgcccaucaccaguggaugacgaccgaagauaugcugacuguauggaaucgaguuuggauugaggacaacccuuggauggaggauaaaacaccagugaccacuugggaagacguccccuaccucgggaagcgcgaggaucaaugguguggaagcuuaaucggucugacaucuagagcuaccugggcccagaauauauugacggcaauccagcaggugcggucacugauuggcaacgaagaguuccucgacuauaugccuaguaugaaaagguuucgcaaggaggaagaguccgaaggggcuaucugguga

SEQ ID NO: 15617 - RNA, 9873 nt, Artificial Sequence
  derived and/or modified CDS sequence (opt3) from DENV-3__KC762686__SS-prME
accagccugugccucaugaugaugcuucccgccacccuggcuuuccacuugacuuccagagacggcgaaccuaggaugaucguggggaagaacgaacggggaaaaucuuuacuguuuaagacggccucagguauuaauauguguacccugauugccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagaguuuaucgagggaaaagugguccagcacgaaaaucugaaguauacagugauaauuacuguucauaccggugaccagcaccaggugggcaacgagacacaaggggucaccgcagaaaucacuccccaggcuuccacgguggaggccauucucccugaauacggaacacuuggccuggagugcucuccacgaaccgguuuggacuucaaugagaugauccuacugacuaugaaaaacaaggcguggaugguacauagacagugguuuuucgaucucccgcugcccuggaccagcggggccacaaccgaaacuccuacauggaauaaaaaggagcuucugguuacguuuaaaaacgcacacgcuaagaagcaagaaguggucguguugggcucccaggagggagccaugcacaccgcucucacuggcgccacagaaauccagaccucagggggaacaaguauuuucgcaggucaucugaaauguagguuaaagauggacaaacuggagcuaaagggcaugagcuaugccaugugccucaaugcuuucguccugaaaaaggaggugucugaaacucagcacgggaccauacuuaucaagguugaguacaaaggagaagaugcgccauguaagauucccuuuuccacggaggacggccaagguaaagcacauaacgggcgguugaucaccgccaacccugugguaacaaagaaagaggaaccaauaaauauugaggcugaacccccguucggcgagucaaacaucgucaucggaauuggcgauaaggcccugaagaucaauugguacaaaaaggggagcaguauuggaaaaauguuugaagcaacugcccguggugcucgcagaauggccauacucggcgacaccgcaugggauuucgggucugugggaggcguucugaacucccuugguaagauggugcaccagaucuuugggagcgcguauacagcucuguucucgggcgucucuuggauuaugaaaaucggaaucggcguguugcucacuuggauugggcuaaauuccaagaacaccucaaugaguuuuagcugcauaguaaucggaauuaucacguuauaccugggcgccgugguucaggcagacauggguugugucauuaauuggaaggggaaagagcuaaagugcggauccggcaucuucgugacaaacgaggugcauaccuggacugaacaguauaaauuucaagccgauucuccuaagaggcucgcuacaaccauagccggugcaugggagaauggcgucugugggauccggagcacuacccgaauggaaaaccugcuuuggaaacagauugcuaaugaguugaacuacauccugugggaaaauaacauuaagcucacaguuguggugggagacaucauaggcguacuggagcaggggaaacgcacguuaacaccccagccaauggagcugaaguauucauggaagacuuggggaaaagccaagauugucacagcggaaacccaaaauaguuccuucaucauugauggcccuaacacacccgagugcccaagcgccucuagagcuuggaacgugugggaaguugaggacuacgguuuugggguguucacuaccaauaucuggcuuaaauugagggaaauguauacgcagcucugugaccaccggcugaugucagcagccgucaaggaugagcgcgcugugcacgccgacaugggauacuggauagagagucagaaaaacggcagcuggaagcuagaaaaggcaucccugaucgagguuaaaacaugcaccuggcccaagucucauacucucuggucgaauggugugcuggaaagcgauaugauuaucccuaaaucccuugcgggcccaguaucacagcacaaccauagaccgggguaccacacccaaacagccggacccuggcacuugggcaagcuggaguuagacuuuaauuauugcgaggggacuaccgucgugauuacagaaaacuguggaacgaggggcccuagucuccguaccacuacagugucugguaaacugauccaugaguggugcugucggagcugcacccuuccaccccugcgauacaugggggaagauggauguugguauggcauggagauaagaccuauuaaugaaaaggaggagaacauggucaaguccuugguuucagcugguagcggcaaaguggacaauuucacuauggggguacucugccuggccauccuauucgaagaggugaugaggggaaaguuuggcaaaaagcacaugaucgcagggguccuguucacauuugugcuccugcuuucuggacagauuaccuggcgcgauauggcucggacguugaucaugauuggcuccaacgccagugacagaauggguauggggguuacuuaccuggcauuaauagccaccuucaaaauccagccauuucucgcucugggauucuuucuuaggaagcugacaagccgcgaaaaucuacuccugggcgugggcuuggcgauggccaccacucugcaauuacccgaggauauugaacagauggcaaacgggaucgcucucggacugauggcccuuaagcugauuacacaguucgagaccuaucaguuguggacagcccucgucucucugauguguuccaauacuaucuuuacccuaacgguggcuuggcgaacagcaacccugauacuugccgguaucucacuccugccgguuugccaaaguagcucgaugcggaaaacugacugguugccugugaccgucgcggcuaugggcguaccaccccugccuuuauucauauuuucccucaaggauacacugaaacguagaucuuggccccuuaacgagggggugauggccguuggacuggugagcaucuuggcaucaagucuccugaggaaugacgucccaauggccggcccucuaguggcuggugggcugcuuauugcauguuacguaaucacuggaaccuccgccgaucucacgguggaaaaggcggcugacgucauaugggaggaagaggccgaacagacaggcguuucucauaaccugaugauuaccguggacgaugacggcacuaugcgcaucaaagaugacgagacagagaacaucuugaccguguuacugaagacugcacuccugauugucagcgggauauuccccuauuccaucccagccacacuucugguguggcacaccuggcagaaacagacgcaacggucaggaguuuugugggauguaccgagcccucccgaaacucagaaggcugagcuagaagaggguguguacagaauuaagcagcagggcaucuuugggaaaacccaagucggagugggcguucagaaggaggguguguuccauacaauguggcacgucaccagaggggccgugcugacacacaauggaaaacgacucgaaccaaacugggcaaguguaaagaaagaccugauuucuuacggcggcggguggcgccuuuccgcucaguggcaaaagggagaggaaguccaggugaucgccguugagcccgguaagaauccuaaaaacuuccagacuaugccaggcauauuucagaccacgacaggggaaaucggagcgauugccuuagauuucaagcccggcacuagcgguucgccuaucauuaaucgggaggggaaaguggucggacuguauggcaacggcgugguuaccaagaaugggggauacgugucagguaucgcacaaacaaacgcugagccggacggcccaacccccgaacucgaggaagagauguuuaaaaagagaaauuugacuauaauggaucugcauccugggucuggaaagaccaggaaauaucucccagccauuguccgugaagcuaucaagcgccggcugagaacacuuauccuggcacccacgagggugguagccgccgagauggaggaggcuuugaaaggccuaccuauucgauaccagacuaccgcgacaaagagugcacacaccgguaaagagaucguggaccugaugugccaugccacuuucacaaugcggcucuuauccccgguucgcguccccaacuauaaucugauaauuauggaugaagcucacuuuaccgacccagccagcaucgcagccagaggguacauuucuacgagggugggaaugggcgaggcugcggccaucuucaugacugcaacaccucccggcaccgcugaugccuuuccacagagcaacgcaccuauacaggacgaagaacgggacauucccgagcgauccuggaacucagggaacgaauggaucaccgauuucgccggaaagacugugugguuugucccaaguaucaaggcugguaaugacauugccaacugucuuaggaagaauggcaagaaaguaauccaacugagccgcaagacauucgauaccgaguaucagaaaacaaagcucaaugacugggauuuugugguuacuacggacauuucugaaaugggggcgaacuucaaggcagauagggugauagacccgcgucggugcuugaaaccugucauccugaccgauggacccgagagagugauucucgccggcccaaugcccguuacaguggcuuccgccgcucagaggcgcggucgagucgggagaaauccucagaaggagaacgaccaauacaucuucacuggccagccacugaauaacgaugaagaccaugcacacuggaccgaggccaaaaugcuucuagacaauaucaacacacccgaaggaauuauaccugcucuguuugagccggaacgggagaagucagccgcaaucgauggcgaguacagguugaaaggggaaagucgcaagaccuucguggaguuaaugcguagaggagaccugccaguauggcucgcgcacaaaguggccagcgaagguauuaaguauacugaucggaaguggugcuuugacggcgagaggaauaaccagauccuggaagagaauauggauguugagauuuggacgaaagaaggggagaagaagaaacuucgcccccgauggcuggacgcuagaaccuacuccgauccucucgccuugaaagaguucaaagacuuugcagcuggacggaagucuaucgcccuggaucuagucacagagauaggcagggugcccucgcaucuggcacaccgcacuagaaacgcccucgacaaucuugugaugcugcauaccagcgaacacggugggagggcuuaucggcacgcggucgaggaguuaccagaaacaauggagaccuugcugcuccugggccuuaugauccugcucacuggaggcgccauguuguuccugauuucagggaaaggaaucgguaagacauccauuggcuuaaucuguguuguggcaaguucugggaugcuauggauggcugauguaccucugcaguggauagccagcgccauugugcucgaauuuuucaugaugguccuucugauccccgagccagagaaacaacguacgccucaggacaaccaguuggcauacgugguuauuggaauccugacccucgcugccauaguggcggcuaaugaaaugggccugcuugagacuacaaagcgcgaucucgguauguccaaagaaccgggggucguaucacccaccucuuaucuggacguggacuugcauccagccagcgcauggacccuguacgccguugcuacaacugugaucacgccuauguuacgacacaccauugagaacaguacagcaaaugucucccuagccgcgaucgcuaaccaagccgugguccugaugggccucgauaagggauggcccauuagcaagauggaccuuggcgugccacuguuggcacuggggugcuauucucagguuaacccucucacucugaccgccgcugugcuuuuacugguaacacauuacgccaucauaggacccggccuccaggcaaaagcuaccagagaagcccagaagaggacugcggccgguauuaugaaaaauccgacgguggaugggaucaugacaaucgacuuggauccagucauuuacgacucaaaguuugagaaacaacugggacagguuaugcuacuggugcucugugcaguccagcuucuguugaugcggaccuccugggcuuucugcgaggcccugacucucgcaaccggcccuaucacaacucugugggaagguagucccggcaaguuuuggaacaccacaauagcugugagcauggccaauauuuuccgcgggucguauuuagccggagcgggccuugcuuuuucuaucaugaaguccguagggacgggaaaaagaggcaccgguagccagggggagacucugggagaaaaguggaaaaagaaacucaaccaacuaucaaggaaggaguucgaucuguacaaaaagaguggcauuacagaaguggaccggaccgaggcaaaggaggguuugaaacgaggcgaaaucacucaccaugccguuucuagaggguccgcuaagcugcagugguucguggagcgcaauauggucauaccagaaggaagggugaucgaucucggcugugggcggggaggcuggagcuauuacugcgccggucuuaaaaaggucacagaggugcguggguauaccaaaggaggccccggccacgaagaaccuguuccgaugucaacguacggguggaacauuguaaagcugaugaguggaaaggacguguuuuauuugcccccagagaaaugugauacccugcucugcgacaucggugaaagcuccccuucucccacagucgaggaaagcagaacuauuaggguguuaaagaugguugagccuuggcugaaaaauaaccaguucuguaucaaggugcuuaauccauacaugcccaccgucauugagcaccuggaacgccuacagcggaaacauggcgggaugcucgugcgaaacccucuguccagaaauucaacacacgagauguacuggaucucuaacggaacuggcaauauaguaaguucggugaacaugguuagcagguugcugcucaaucgcuuuaccaugacacaucggagaccaaccauugaaaaggaugucgaccuuggugcagggacucgucacgugaacgccgagcccgaaacgccgaacauggacgugaucggagagaggauccggcgcauuaaggaggaacacuccucuacauggcauuaugaugaggaaaauccuuacaaaaccugggcuuaucacggcucauacgaggucaaggcgacuggcagcgccuccaguaugauaaacgggguugugaaacuguuaaccaagccaugggacguagugcccacagucacgcaaauggcaaugaccgauacuacaccuuucggacagcagcgaguguuuaaagaaaagguugacaccagaacuccaaggcccaugccggguacacggaaggcuauggagaucaccgccgaguggcuguggcgcacauugggcagaaauaaaaggccucgacucugcacucgggaagaguucaccaagaaagugcguacgaacgcagccaugggggcugucuuuaccgaagagaaucaaugggauucugccagagcggcaguggaagacgaggaguucuggaagcugguagaucgcgaaagggagcuacauaaacuuggaaaguguggcagcugcguuuauaacaugauggguaaacgggaaaagaagcugggggaguuuggaaaagccaagggcucaagagcuauuugguacauguggcucggcgcccgcuaucuggaguucgaagcauugggguuucugaaugaggaccacugguucuccagggaaaacaguuuuagcggaguggagggugaaggccuccauaaacuuggguacauccugcgagauauuucuaagauccccggaggcgcuauguacgccgacgauacagcugguugggacacucggauaaccgaggacgauuuacacaaugaggagaaaaucacacagcagauggagccagaacacagacagcuggccaacgcaauuuucaaguugacuuaucaaaauaaggucgugaaagugcagaggccuacccccaaggggacggucauggacaucauuucccgcaaagaucagcguggaucaggccagguuggcacauacgggcucaacaccuucacuaauauggaggugcaacugauccggcagauggaaggagaggguguacuaagcaaggcggaccuugagaacccacaucugcucgaaaaagagauaacacaguggcuggaaaccaagggcguggagagauugaagaggauggccauuucgggggaugacugcgucgugaaacccaucgaugaccgcuuugcugaugccuuacuggcacucaaugacaugggaaagguucgaaaagauaucccucaguggcaaccaucuaagggcuggcacgacuggcaacaggugccguucuguagucaucacuuucacgaacuuauuaugaaagauggucggaagcuggucgugcccugcagaccucaggacgagcuaauagggagggcucgcaucucccaaggagccggcuggagccugaaggagacugcaugucucggcaaagccuaugcgcagaugugggcuuugauguacuuccauagacgggaccugaggcuugccucaaacgcaauuugcuccgccguaccaguucacugggugcccaccucucguacaacguggagcauccaugcucaccaucaguggaugaccacugaagauaugcugacagucuggaaccgaguguggauugaggacaauccuuggauggaagauaagaccccaguuacuacaugggaggacgugcccuaucucgggaaacgcgaggaucaaugguguggaaguuuaaucggucuggccuccagagcaaccugggcucagaacauauugacggccauccagcagguccggagccugauuggcaaugaagaguuucucgacuacaugccuucuaugaagagguuccgcaaagaagaggaaucagagggggcgaucugguga

SEQ ID NO: 15618 - RNA, 9873 nt, Artificial Sequence
  derived and/or modified CDS sequence (opt3) from DENV-3__KC762685__SS-prME
accagccugugccucaugaugaugcuucccgccacucuggcuuuccacuugacuuccagagacggagaaccuaggaugaucguggggaagaacgaacggggaaaaucuuuacuguuuaagacggccucagguauuaauauguguacccugauagccauggaucucggcgagaugugcgacgauaccgucacuuacaaauguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcacaaaguuccaauguuuagaguuuaucgagggaaaagugguccagcacgaaaaucugaaguauacugugauaauuaccguucauacaggugaccagcaccaggugggcaacgagacccaaggggucacugccgaaaucacgccccaggcauccacaguggaggcuauucucccugaauacggaacccuuggccuggagugcucuccacgaacugguuuggacuucaaugagaugauccuacugaccaugaaaaacaaggccuggaugguacauagacagugguuuuucgaucucccgcugcccuggacaagcggggcgaccacugaaacaccuacguggaauaaaaaggagcuucugguuaccuuuaaaaacgcccacgcaaagaagcaagaaguggucguguugggcucccaggagggagcuaugcacacugcccucacaggcgcuaccgaaauccagacaucagggggaacaaguauuuucgccggucaucugaaauguagguuaaagauggacaaacuggagcuaaagggcaugagcuaugcaaugugccucaaugccuucguccugaaaaaggaggugucugaaacccagcacgggacgauacuuaucaagguugaguacaaaggagaagaugcuccauguaagauucccuuuuccaccgaggacggccaagguaaagcgcauaacgggcgguugaucacagcaaacccugugguaacuaagaaagaggaaccagucaauauagaggccgaacccccguucggcgagucaaacauugugaucggaaucggcgauaaggcucugaagauuaauugguacaaaaaggggagcaguaucggaaaaauguuugaagccaccgcacguggugcccgcagaauggcuauucucggcgacacagccugggauuucgggucuguuggaggcgugcugaacucccuugguaagaugguccaccagauauuugggagcgcauauacugcgcuguucucgggcgugucuuggaucaugaaaauuggaaucggcguauugcucaccuggaucgggcuaaauuccaagaacacgucaaugaguuuuagcugcauugugauaggaaucauuacauuauaccugggcgcuguuguccaggccgacauggguugugugaucaauuggaaggggaaagagcuaaagugcggauccggcauuuucgugaccaacgagguccauacuuggacagaacaguauaaauuucaagcagauucuccuaagaggcucgccaccgcuaucgccggugcaugggagaauggcguuugugggauacggagcacuacccgaauggaaaaccugcuuuggaaacagaucgcuaaugaguugaacuacauucugugggaaaauaacaucaagcucacaguggugguaggagacauuaucggcguccuggagcaggggaaacgcacguuaacaccccagccaauggagcugaaguauucauggaagacuuggggaaaagccaagauagugacagcggaaacccaaaauaguuccuucauuaucgauggcccuaacacacccgagugcccaagcgccucuagagcuuggaacguuugggaaguggaggacuacgguuuuggggucuucacuaccaauauuuggcuuaaauugagggaaauguauacgcagcucugugaccaccggcugaugucagcagccgugaaggaugagcgcgcuguucacgccgacaugggauacuggaucgagagucagaaaaacggcagcuggaagcuagaaaaggcaucccugauagaggugaaaacaugcaccuggcccaagucucauacucucuggucgaaugguguacuggaaagcgauaugaucauuccuaaaucccuugcgggcccagucucacagcacaacuacagaccgggguaucauacccaaacagccggacccuggcacuugggcaagcuggaguuagacuuuaauuacugcgaggggacuaccguggugaucacagaaaacuguggaacgaggggcccuagucuccguaccacuacagucucugguaaacugauucacgaguggugcugucggagcugcacccuuccaccccugcgauauaugggggaagauggauguugguacggcauggagaucagaccuauaaaugaaaaggaggagaacaugguuaaguccuuggugucagcugguagcggcaaaguagacaauuucacuaugggggugcucugccuggccauucuauucgaagaggucaugaggggaaaguuuggcaaaaagcauaugaucgcaggggugcuguucacauuuguucuccugcuuucuggacagaucaccuggcgcgauauggcucggacguugauuaugaucggcuccaacgccagugacagaauggguaugggggugacuuaucuggcauuaauugccaccuucaaaauacagccauuucucgcucugggauucuuucuuaggaagcugacaagccgcgaaaaucuacuccugggcgucggcuuggcgauggccaccacucugcaauuacccgaggauaucgaacagauggcaaacgggauugcucucggacugauggcccuuaagcugaucacacaguucgagaccuaccaguuguggacagcccucgugucucugauguguuccaauacuauuuuuacccuaacgguugcuuggcgaacagcaacccugauccuugccgguauaucacuccugccggugugccaaaguagcucgaugcggaaaacugacugguugccugucaccguagcggcuaugggcgugccaccccugccuuuauucaucuuuucccucaaggauacacugaaacguagaucuuggccccuuaacgaggggguuauggccgugggacuggucagcauuuuggcaucaagucuccugaggaaugacgugccaauggccggcccucuaguagcuggugggcugcuuaucgcauguuaugugauuacuggaaccuccgccgaucucacggucgaaaaggcggcugacguuaucugggaggaagaggccgaacagacaggcgugucucacaaccugaugauaaccguggacgaugacggcacuaugcgcauuaaagaugacgagacagagaacaucuugaccgucuuacugaagacugcacuccugaucgugagcgggauuuuccccuacuccauaccagccacacuucugguuuggcauaccuggcagaaacagacgcaacggucaggaguauugugggaugugccgagcccucccgaaacucagaaggcugagcuagaagagggugucuacagaaucaagcagcagggcauuuuugggaaaacccaagugggaguuggcgugcagaaggagggugucuuccacacaauguggcaugugaccagaggggccguacugacacacaauggaaaacgacucgaaccaaacugggcaagugucaagaaagaccugaucucuuauggcggcggguggcgccuuuccgcucaguggcaaaagggagaggaagugcagguuauugccguggagcccgguaagaauccuaaaaacuuccagacuaugccaggcaucuuucagaccacgacaggggaaauaggagcgaucgccuuagauuucaagcccggcacuagcgguucgccuauuaucaaucgggaggggaaagucgugggacuguacggcaacggcguugugaccaagaaugggggauaugucucagguauugcacaaacaaacgcugagccggacggcccaacccccgaacucgaggaagagauguuuaaaaagagaaauuugacuaucauggaucugcacccugggucuggaaagaccaggaaauaccucccagccauagugcgugaagcuauuaagcgccggcugagaacacuuauccuggcacccacgaggguaguggccgccgagauggaggaggcuuugaaaggccuaccuauccgauaucagacuaccgcgacaaagagugcacauaccgguaaagagauuguugaccugaugugccacgccacuuucacaaugcggcucuuauccccgguccgcgugcccaacuacaaucugaucauaauggaugaagcucauuuuaccgacccagccagcauugcagccagaggguauaucucuacgagggugggaaugggcgaggcugcggccauuuucaugacugcaacaccucccggcaccgcugaugccuuuccacagagcaacgcaccuauccaggacgaagaacgggacauacccgagcgauccuggaacucagggaacgaauggauuaccgauuucgccggaaagacugucugguuuguaccaaguaucaaggcugguaaugacaucgccaacugucuuaggaagaauggcaagaaagugauucaacugagccgcaagacauucgauaccgaguaccagaaaacaaagcucaaugacugggauuuuguugugacuacggacaucucugaaaugggggcgaacuucaaggcagauagggucauugacccgcgucggugcuugaaaccugugauacugaccgauggacccgagagaguuauccucgccggcccaaugcccgugacagucgcuuccgccgcucagaggcgcggucgaguggggagaaauccucagaaggagaacgaccaauacauuuucacuggccagccacugaauaacgaugaagaccacgcacauuggaccgaggccaaaaugcuucuagacaauaucaacacacccgaaggaaucauuccugcucuguuugagccggaacgggagaagucagccgcaauagauggcgaguauagguugaaaggggaaagucgcaagaccuucguagaguuaaugcguagaggagaccugccaguguggcucgcgcacaaaguugccagcgaagguaucaaguacacugaucggaaguggugcuuugacggcgagaggaauaaccagauucuggaagagaauauggaugucgagaucuggacgaaagaaggggagaagaagaaacuucgcccccgauggcuggacgcuagaaccuauuccgauccucucgccuugaaagaguucaaagacuuugcagcuggacggaagucuauugcccuggaucuagugacagagaucggcagggugcccucgcaccuggcacaucgcacuagaaacgcccucgacaaucuugucaugcugcacaccagcgaacauggugggagggcuuaccggcacgcgguugaggaguuaccagaaacaauggagaccuugcugcuccugggccuuaugauacugcucacuggaggcgccauguuguuccugaucucagggaaaggaauugguaagacauccaucggcuuaauuugugugguagcaaguucugggaugcuauggauggcugaugugccucugcaguggaucgccagcgccauaguccucgaauuuuucaugauggugcuucugauucccgagccagagaaacaacguacgccucaggacaaccaguuggcauauguugugaucggcauucugacccucgcugccaucgucgcggcuaaugaaaugggccugcuugagacuacaaagcgcgaucucgguauguccaaagaaccggggguagugucacccaccucuuaccuggacguugacuugcacccagccagcgcauggacccuguaugccguggcuacaacugucauaacgccuauguuacgacauaccaucgagaacaguacagcaaaugugucccuagccgcgauugcuaaccaagccgucgugcugaugggccucgauaagggauggcccaucagcaagauggaccuuggcguuccacuguuggcacuggggugcuacucucaggugaacccucucacucugaccgccgcuguacuuuuacuggugacacacuacgccauuaucggacccggccuccaggcaaaagcuaccagagaagcccagaagaggacugcggccgguauaaugaaaaauccgacggucgaugggauuaugacaaucgacuuggauccaguuaucuaugacucaaaguuugagaaacaacugggacaggugaugcuacugguccucugugcagugcagcuucuguugaugcggaccuccugggcuuucugcgaggcccugacucucgcaaccggcccuauuacaacucugugggaagguagucccggcaaguuuuggaacaccacaaucgcuguaagcauggccaauauauuccgcgggucguacuuagccggagcgggccuugcuuuuucuauuaugaaguccguggggacgggaaaaagaggcaccgguagccagggggagacucugggagaaaaguggaaaaagaaacucaaccaacuaucaaggaaggaguucgaucuguauaaaaagaguggcaucacagaaguugaccggaccgaggcaaaggaggguuugaaacgaggcgaaauuacucaucacgccgugucuagaggguccgcuaagcugcagugguucgucgagcgcaauauggugaucccagaaggaagggucauagaucucggcugugggcggggaggcuggagcuacuauugcgccggucuuaaaaaggugacagagguucguggguacaccaaaggaggccccggccaugaagaaccuguaccgaugucaacguauggguggaacaucgugaagcugaugaguggaaaggacgucuuuuacuugcccccagagaaaugugauacccugcucugcgacauuggugaaagcuccccuucucccacaguggaggaaagcagaacuaucaggguuuuaaagaugguggagccuuggcugaaaaauaaccaguucuguauuaagguccuuaauccauacaugcccaccgugaucgagcaccuggaacgccuacagcggaaacacggcgggaugcucguacgaaacccucuguccagaaauucaacacaugagauguauuggauuucuaacggaacuggcaauaucgugaguucgguuaacauggucagcagguugcugcucaaucgcuuuaccaugacacaccggagaccaaccauagaaaaggauguggaccuuggugcagggacucgucaugugaacgccgagcccgaaacgccgaacauggacgucauuggagagaggauccggcgcaucaaggaggaacacuccucuacauggcacuacgaugaggaaaauccuuauaaaaccugggcuuaccauggcucauaugagguuaaggcgacuggcagcgccuccaguaugauuaacggggugguaaaacuguuaaccaagccaugggacgugguccccacagugacgcaaauggcaaugaccgauacuacaccuuucggacagcagcgaguuuuuaaagaaaagguggacaccagaacuccaaggcccaugccggguacacggaaggcuauggagauaaccgccgaguggcuguggcgcacauugggcagaaauaaaaggccucgacucugcacucgggaagaguucaccaagaaaguccguacgaacgcagccaugggggcuguguuuaccgaagagaaucaaugggauucugccagagcggcaguagaagacgaggaguucuggaagcugguugaucgcgaaagggagcuacacaaacuuggaaaguguggcagcugcguguacaacaugauggguaaacgggaaaagaagcugggggaguuuggaaaagccaagggcucaagagcuaucugguauauguggcucggcgcccgcuaccuggaguucgaagcauugggguuucugaaugaggaccauugguucuccagggaaaacaguuuuagcggagucgagggugaaggccuccacaaacuuggguacauucugcgagauaucucuaagauucccggaggcgcuauguaugccgacgauacagcugguugggacacucggaucaccgaggacgauuuacauaaugaggagaaaauaacacagcagauggagccagaacacagacagcuggccaacgcaaucuucaaguugacuuaccaaaauaagguggugaaaguccagaggccuacccccaaggggacgguuauggacauuaucucccgcaaagaucagcguggaucaggccaggugggcacauaugggcucaacaccuucacuaauauggagguacaacugauucggcagauggaaggagagggugugcuaagcaaggcggaccuugagaacccacaucugcucgaaaaagagaucacacaguggcuggaaaccaagggcgucgagagauugaagaggauggccauaucgggggaugacugcgugguuaaacccauugaugaccgcuuugcugaugccuuacuggcacucaaugacaugggaaaggugcgaaaagauaucccucaguggcaaccaucuaagggcuggcaugacuggcagcaggucccguucuguagucaccauuuucacgaacuuaucaugaaagauggucggaagcuggugguacccugcagaccucaggacgagcuaauugggagggcucgcauaucccaaggagccggcuggagccugaaggagacugcaugucucggcaaagccuacgcgcagaugugggcuuugauguauuuccacagacgggaccugaggcuugccucaaacgcaaucugcuccgccguuccagugcauuggguccccaccucucguacaacguggagcauucacgcucaucaccaguggaugaccacugaagauaugcugacaguguggaaccgaguuuggaucgaggacaauccuuggauggaagauaagaccccagugacuacaugggaggacguccccuaccucgggaaacgcgaggaucaaugguguggaaguuuaauuggucuggccuccagagcaaccugggcucagaacaucuugacggccauacaacaggugcggagccugaucggcaaugaagaguuucucgacuauaugccuucuaugaagagguuccgcaaagaagaggaaucagagggggcgauuugguga

SEQ ID NO: 15619 - RNA, 9873 nt, Artificial Sequence
  derived and/or modified CDS sequence (opt3) from DENV-3__KC762687__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagaguuuaucgagggaaaagugguccagcacgaaaaucugaaguauacagugauaauuacuguucauaccggugaccagcaccaggugggcaacgagacacaaggggucaccgcagaaaucacuccccaggcuuccacgguggaggccauucucccugaauacggaacacuuggccuggagugcucuccacgaaccgguuuggacuucaaugagaugauccuacugacuaugaaaaacaaggcguggaugguacauagacagugguuuuucgaucucccgcugcccuggaccagcggggccacaaccgaaacuccuacauggaauaaaaaggagcuucugguuacguuuaaaaacgcacacgcuaagaagcaagaaguggucguguugggcucccaggagggagccaugcacaccgcucucacuggcgccacagaaauccagaccucagggggaacaaguauuuucgcaggucaucugaaauguagguuaaagauggacaaacuggagcuaaagggcaugagcuaugccaugugccucaaugcuuucguccugaaaaaggaggugucugaaacucagcacgggaccauacuuaucaagguugaguacaaaggagaagaugcgccauguaagauucccuuuuccacggaggacggccaagguaaagcacauaacgggcgguugaucaccgccaacccugugguagucaagaaagaggaaccagugaauauagaggcugaacccccguucggcgagucaaacauuguuaucggaaucggcgauaaggcccugaagauuaauugguacaaaaaggggagcaguaucggaaaaauguuugaagcaacagcccguggugcucgcagaauggccauucucggcgacacugcaugggauuucgggucugugggaggcguccugaacucccuugguaagauggugcaccagauauuugggagcgcguauaccgcucuguucucgggcguaucuuggaucaugaaaauuggaaucggcguguugcucacauggaucgggcugaauuccaagaacacuucaaugaguuuuagcugcauuguuauaggaaucauuaccuuauaccugggcgccgucgugcaggcagacauggguugugugaucaauuggaaggggaaagagcuaaagugcggauccggcauuuucgucacgaacgagguucauacauggaccgaacaguauaaauuucaagccgauucuccuaagaggcucgcuacugccaucgcaggugcuugggagaauggcgugugugggauacggagcacaacccgaauggaaaaccugcuuuggaaacagaucgccaaugaguugaacuacauucugugggaaaauaacaucaagcucacugugguagucggagacauuaucggcgugcuggagcaggggaaacgcaccuuaacaccccagccaauggagcugaaguauucauggaagacguggggaaaagcgaagauaguuaccgccgaaacucaaaauaguuccuucauuaucgauggcccuaacacacccgagugcccaagcgcuucuagagcauggaacgugugggaagucgaggacuacgguuuugggguguucaccacaaauauuuggcuuaaauugagggaaauguauacucagcucugugaccaccggcugaugucagccgcuguuaaggaugagcgcgccgugcacgcagacaugggauacuggaucgagagucagaaaaacggcagcuggaagcuagaaaaggcgucccugauagagguaaaaaccugcacguggcccaagucucauacacucuggucgaaugguguccuggaaagcgauaugaucauuccuaaaucccuugccggcccagugucacagcacaacuacagaccgggguaucauacccaaacugcuggacccuggcacuugggcaagcuggaguuagacuuuaauuacugcgaggggaccacaguggucaucacugaaaacuguggaaccaggggcccuagucuccguacaacgaccguuucugguaaacugauucacgaguggugcugucggagcugcacucuuccaccccugcgauauaugggggaagauggauguugguacggcauggagaucagaccuauaaaugaaaaggaggagaacauggugaaguccuugguaucagccgguagcggcaaaguggacaauuucacaauggggguccucugccuggcaauucuauucgaagaggugaugaggggaaaguuuggcaaaaagcauaugaucgcugggguucuguucaccuuugugcuccugcuuucuggacagaucacuuggcgcgauauggcccggacauugauuaugaucggcuccaacgcaagugacagaauggguaugggggucaccuaucuggccuuaauugcuacguucaaaauacagccauuucucgcgcugggauucuuucuuaggaagcugacuagccgcgaaaaucuacuccugggcgugggcuuggccauggcaaccacacugcaauuacccgaggauaucgaacagauggcuaacgggauugcccucggacugauggcccuuaagcugaucacccaguucgagacuuaccaguuguggacagcucucguuucucugauguguuccaauaccauuuuuacacuaacuguggcauggcgaaccgccacgcugauccuugcggguauaucacucuucccggucugccaaaguagcucgaugcggaaaacagacuggcugccuguaaccguggcugccaugggcguuccacccuugccucuguuuaucuucuccuuaaaggauacucucaaacguagaucuuggccccugaacgagggggugauggcagucggacuugugagcauucuggccucaaguuugcucaggaaugacguaccaauggcuggcccucugguggcaggugggcuacugaucgccuguuaugucauuaccggaacauccgcggaucuuacuguugaaaaggcugccgacgugaucugggaggaagaggcagaacagaccggcgugucucacaaccucaugauaacggucgacgaugacggcacaaugcgcauuaaagaugacgagaccgagaacauccugacuguguuguuaaagacagcccugcucaucguuagcgggauuuuucccuacuccauaccagcuacccugcuuguauggcauacuuggcagaaacagacacaacggucaggagugcugugggaugucccgagcccucccgaaacccagaaggccgaguuggaagaggguguguacagaaucaagcagcagggcauuuucgggaaaacgcaaguuggagugggcguccagaaggaggguguguuccacacuauguggcauguaaccaggggggcaguccuaacacacaauggaaaacgacuggaaccaaacugggcuagugugaagaaagaccucaucucuuauggcggcggguggcgccuguccgcccaguggcaaaagggagaggaaguucaggugauugcggucgagcccgguaagaauccuaaaaacuuucagaccaugccaggcacauuccagacuaccacgggggaaaucggagccauagcacuugauuuuaagcccggcacaagcgguucgccuaucauuaaucgggaggggaaagugguuggauuauacggcaacggcguggucacuaagaaugggggauaugugucagguaucgcucaaaccaacgccgagccggacggcccaacacccgaacuggaggaagagauguucaaaaagagaaaucucaccauuauggauuugcacccugggucuggaaagacuaggaaauaccugccagcuaucguacgugaagcaauaaagcgccggcucagaacccugauucuugcccccacaagggugguugccgcugagauggaggaagcgcugaaaggcuugccuauccgauaucagacgacugcaaccaagaguguccauacagguaaagagaucguggaccuaaugugccacgccaccuuuacuaugcggcugcucuccccggugcgcguccccaacuacaauuuaauuaucauggaugaagcucauuucacagacccagccagcauagcagccagaggguauauuucuaccaggguaggaaugggcgaggcugcggccaucuuuaugacggcaacuccucccggcacagcugaugccuucccacagagcaacgcaccuauucaggacgaagagcgggacauccccgagcgauccuggaauucagggaacgaauggauaaccgauuuugccggaaagaccgugugguucguuccaaguauuaaggcugguaaugacaucgccaacugucugagaaaaaacggcaagaaagugauccaacuuagccgcaagacuuuugauacagaguaccagaaaaccaagcugaaugacugggauuucgucgugacaacugacauuucugaaaugggggcgaacuucaaggcagauaggguuaucgacccgcgucggugccucaaaccugugauuuugacggauggacccgagagagucauacuggccggcccaaugcccgugaccguagcuuccgccgcucagaggcgcggucgaguggggagaaauccucagaaggagaacgaccaauacaucuuuacaggccagccacucaauaacgaugaagaccacgcacauuggacugaggccaaaaugcugcuugacaauauuaacacccccgaaggaaucaucccugcucuauucgagccggaacgggagaagucagccgcaauugauggcgaguauaggcugaaaggggaaagucgcaagacauuuguugaguugaugcguagaggagacuuaccagucuggcuggcgcacaaaguggccagcgaagguauaaaguacaccgaucggaaguggugcuucgacggcgagaggaauaaccagauccucgaagagaauauggauguggagauuuggacuaaagaaggggagaagaaaaagcugcgcccccgauggcuugacgcuagaacguauuccgauccucuggcccucaaagaauuuaaggacuucgcagcuggacggaagucuaucgccuuggaucuggucaccgagauuggcaggguucccucgcaccuagcacauaaaacacgcagcgcccuggacaaccucgugaugcuucacacuucagaacauggugggagagcuuacaggcacgcgguagaggagcugccagaaaccauggagacauuauugcugcucggccugaugauccuucugaccggaggcgccaugcucuuuuugauauccgggaagggaaucgguaaaacuaguauuggccugaucuguguggucgcaucuagcgggauguuauggauggcugaugugccucuacaguggauugccuccgccaucguucuggaauucuuuaugauggugcuccuuauacccgagccagagaagcaacggacaccucaggacaaucagcuggcauaugucguaauuggaaucuugacgcuggcugccauuguggcggcuaacgaaaugggccuccuggagaccacuaaacgugaucuugguaugucaaaggaaccggggguugugucucccacaagcuaccucgacgucgaccugcacccagccagugcauggaccuuguaugccguggcuaccacagucaucacuccuaugcugcgccauacgauagagaauuccaccgcaaacgugagcuuagccgcgaucgcuaaucaagccguugugcuaaugggccuggauaagggauggcccauuucuaaaauggaccucggcguaccacuucuggcauuggggugcuacucacaggugaacccucugacacucacugccgcuguccugcuuuuaguuacccacuacgccaucauuggacccggccugcaggcaaaggcuacacgagaagcccagaaaagaaccgcggccgguaucaugaagaacccgacuguggaugggauaaugacgauugaccucgauccagucaucuaugacuccaaauucgagaagcaauugggacaggugaugcugcuaguacugugugcagugcagcuccuucugaugaggacaaguugggcuuuuugcgaggccuugacccuggcaacuggcccuaucaccacacucugggaagguagccccggcaaguucuggaauacuaccauugcuguuucgauggccaacaucuuucgggggucuuaccuggccggagcgggcuuagcuuucuccauaaugaaaagcguggggacaggaaagcgcggcacggguucacagggggagacccuuggagaaaaauggaagaaaaagcugaaucaacucaguagaaaagaguucgaucuauauaagaagucuggcauuacugaagucgacaggacagaggcaaaagagggucugaagcggggcgaaaucacccaucacgccgugucccgagggagcgcuaaauugcagugguuugucgagagaaacauggugauuccagaaggacgcguuaucgaucugggcugugggaggggaggcuggucauacuauugcgccggucucaagaaaguaacugaggugcggggguacacaaagggaggccccggccaugaagagccugucccgaugaguaccuauggguggaauauagugaagcuuaugagcggaaaagacguuuucuaccugcccccagagaagugugauacguugcugugcgacaucggugaauccucuccuagccccaccguggaggaaucccguacaauuagaguccucaaaaugguggagccuugguuaaagaacaaucaguuuuguaucaaaguacugaacccauacaugcccacugugauugagcaccuugaaaggcugcagcgcaagcacggcgggaugcuaguucggaauccucucucacgaaacucuacccaugagauguauuggaucaguaauggaacaggcaacauugucucgagcgugaauaugguguccagacuguugcugaacagguucacuaugacccaccgccggccaacaaucgaaaaggaugucgaccucggugcagggaccagacauguuaaugccgagcccgaaacuccgaacauggacgugauaggagagcguauuaggcggaucaaagaggaacacucuucaacguggcacuacgaugaggaaaacccuuauaagacaugggcuuaccauggcagcuaugagguaaaagcgaccggcuccgccaguucuaugaucaaugggguggucaagcuucugacuaaaccaugggacgugguucccaccgugacacaaauggcaaugacggauaccacuccuuuuggacagcagcgcgucuucaaggaaaagguggacacacgaaccccaagacccaugccggguacuaggaaagcuauggagauuacagccgagugguuauggcggacccugggccgcaacaagagaccuagguugugcacacgagaagaguuuacuaaaaagguacggaccaaugcagccaugggggcuguuuucacggaagagaaccaaugggauagcgccaaagcggcaguggaagacgaggaguuuuggaagcucgucgaucgugaaagagagcugcacaaacuaggaaaguguggcucaugcguguacaauaugauggguaagcgcgaaaaaaagcuuggggaguucggaaaagccaagggcuccagggcuauaugguauauguggcugggcgcccgguaccucgaguuugaagcacugggguucuugaacgaggaccauugguuuaguagagaaaauagcuucucuggaguggagggugaaggccugcacaaacucggguacauccuucgcgauauuuccaagauccccggaggcgcuauguaugccgacgauaccgcugguugggacacaaggauuacugaggacgaucugcauaacgaggaaaagaucacccagcagauggacccagagcaccgacaguuagccaaugcaauauucaaacugacauaccaaaacaaggucguuaaagugcagcggccuacucccaaggggaccguaauggauaucauuucaagaaaagaccagaggggaagcggccaggugggcacguauggguugaauacauuuaccaacauggaaguccaacucauccgccagauggagggagaaggugugcugucgaaggcggaucuagagaauccacaccuucuggagaaggaaauuacucaguggcucgagacaaaaggcguugaacgucugaagcggauggccaucucuggggacgauugcguggucaaacccauagacgauagauucgcugacgccuuguuagcacugaacgauaugggaaaggugaggaaagacauuccucaguggcaaccaaguaagggcuggcaugauuggcagcagguaccguuuuguucccaccauuuccacgagcucaucaugaaggacggucgcaaacuuguugugcccugccgaccucaggacgaacugaucgggcgggcuagaauuagccaaggagccggcuggucacuaagggagaccgcaugucugggcaaggccuacgcgcagaugugggcucucauguauuuucaccgcagagauuugcggcuggccuccaaugcaauaugcucugccgucccagugcauuggguucccacuagcaggaccacauggaguauccacgcucaucaccaguggaugacgaccgaggacaugcuuacuguguggaaccgugucuggauugaagauaacccuuggauggaggacaaaacaccagugaccacuugggaagauguacccuaccuggggaagcgagaggaccaaugguguggaucccucaucgguuuagccagccgcgcaacaugggcucagaauauucugaccgccauccagcaggugagaucuuugauaggcaacgaggaauuccuggauuauaugccuucaaugaaacgguuuaggaaggaggaagagagugaaggggcgaucugguga

SEQ ID NO: 15620 - RNA, 9873 nt, Artificial Sequence
  derived and/or modified CDS sequence (opt3) from DENV-3__KC762688__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagaguuuaucgagggaaaagugguccagcacgaaaaucugaaguauacagugauaauuacuguucauaccggugaccagcaccaggugggcaacgagacacaaggggucaccgcagaaaucacuccccaggcuuccacgguggaggccauucucccugaauacggaacacuuggccuggagugcucuccacgaaccgguuuggacuucaaugagaugauccuacugacuaugaaaaacaaggcguggaugguacauagacagugguuuuucgaucucccgcugcccuggaccagcggggccacaaccgaaacuccuacauggaauaaaaaggagcuucugguuacguuuaaaaacgcacacgcuaagaagcaagaaguggucguguugggcucccaggagggagccaugcacaccgcucucacuggcgccacagaaauccagaccucagggggaacaaguauuuucgcaggucaucugaaauguagguuaaagauggacaaacuggagcuaaagggcaugagcuaugccaugugccucaaugcuuucguccugaaaaaggaggugucugaaacucagcacgggaccauacuuaucaagguugaguacaaaggagaagaugcgccauguaagauucccuuuuccacggaggacggccaagguaaagcacauaacgggcgguugaucaccgccaacccugugguaacaaagaaagaggaaccagucaauauagaggcugaacccccguucggcgagucaaacauugugaucggaaucggcgauaaggcccugaagauuaauugguacaaaaaggggagcaguaucggaaaaauguuugaagcaacugcccguggugcucgcagaauggccauucucggcgacaccgcaugggauuucgggucuguuggaggcgugcugaacucccuugguaagaugguccaccagauauuugggagcgcguauacagcucuguucucgggcgugucuuggaucaugaaaauuggaaucggcguauugcucacuuggaucgggcugaauuccaagaacaccucaaugaguuuuagcugcauugugauaggaaucauuacguuauaccugggcgccguuguccaggcagacauggguugugugaucaauuggaaggggaaagagcuaaagugcggauccggcauuuucgugacaaacgagguccauaccuggacugaacaguauaaauuucaagccgauucuccuaagaggcucgcuacagccaucgcaggugcuugggagaauggcguuugugggauacggagcaccacucgaauggaaaaccugcuuuggaaacagaucgccaaugaguugaacuacauucugugggaaaauaacaucaagcucaccguggugguaggagacauuaucggcguccuggagcaggggaaacgcacauuaacgccccagccaauggagcugaaguauucauggaagaccuggggaaaagcgaagauagugacugccgaaacacaaaauaguuccuucauuaucgauggcccuaacacccccgagugcccaagcgcuucuagagcauggaacguuugggaaguggaggacuacgguuuuggggucuucacaacuaauauuuggcuuaaauugagggaaauguauacccagcucugugaccaccggcugaugucagccgcugugaaggaugagcgcgccguucacgcagacaugggauacuggaucgagagucagaaaaacggcagcuggaagcuagaaaaggcgucccugauagaggugaaaacgugcacauggcccaagucucauacccucuggucgaaugguguacuggaaagcgauaugaucauuccuaaaucccuugccggcccagucucacagcacaacuacagaccgggguaucauacucaaaccgcuggacccuggcacuugggcaagcuggaguuagacuuuaauuacugcgaggggacaacuguggugaucaccgaaaacuguggaacaaggggcccuagucuccguacgaccacugucucugguaaacugauucacgaguggugcugucggagcugcacacuuccaccccugcgauauaugggggaagauggauguugguacggcauggagaucagaccuauaaaugaaaaggaggagaacaugguuaaguccuuggugucagccgguagcggcaaaguagacaauuucaccaugggggugcucugccuggcaauucuauucgaagaggucaugaggggaaaguuuggcaaaaagcauaugaucgcuggggugcuguucacuuuuguucuccugcuuucuggacagaucacauggcgcgauauggcccggaccuugauuaugaucggcuccaacgcaagugacagaauggguaugggggugacguaucuggccuuaauugcuacuuucaaaauacagccauuucucgcgcugggauucuuucuuaggaagcugaccagccgcgaaaaucuacuccugggcgucggcuuggccauggcaacaacccugcaauuacccgaggauaucgaacagauggcuaacgggauugcccucggacugauggcccuuaagcugaucacucaguucgagacauaccaguuguggaccgcucucgugucucugauguguuccaauacacuauuuacucugaccguugcauggcgaacggccacacuuauucucgcggguaucucacuguugccggugugccaaaguagcucgaugcggaaaaccgacuggcugccugucacuguagcugccaugggcgugccacccuuaccucucuucauauuuucccugaaggauacccuuaaacguagaucuuggccccugaacgaggggguuauggcagugggauuggucagcauccucgccucaagucugcuaaggaaugacgugccaauggcuggcccucugguagcaggugggcuucucauugccuguuaugugaucacaggaacuuccgcggaucugaccgucgaaaaggcugccgacguuauuugggaggaagaggcagaacagacgggcgugucucacaacuugaugaucacaguggacgaugacggcaccaugcgcauaaaagaugacgagacugagaacauuuuaacaguccugcucaagaccgcccugcuuaucgugagcgggaucuuccccuacuccauuccagcuacucuguugguuuggcauacauggcagaaacagacccaacggucaggaguacuaugggaugugccgagcccucccgaaacgcagaaggccgagcuggaagagggugucuacagaauaaagcagcagggcaucuuugggaaaacucaagugggaguuggcgugcagaaggagggugucuuccacaccauguggcaugugacaaggggggcaguacucacccacaauggaaaacgacuggaaccaaacugggcuagugucaagaaagaccuuauuucuuauggcggcggguggcgcuuauccgcccaguggcaaaagggagaggaagugcagguuaucgcgguggagcccgguaagaauccuaaaaacuuccagacaaugccaggcauuuuucagacuaccacgggggaaaucggagccauagcacuggauuucaagcccggcacaagcgguucgccuaucauuaaucgggaggggaaagucgugggacucuacggcaacggcguugugacuaagaaugggggauaugucucagguaucgcucaaaccaacgccgagccggacggcccaacacccgaauuggaggaagagauguuuaaaaagagaaaucugaccauuauggaucuccacccugggucuggaaagacuaggaaauaccugccagcuaucgugcgugaagcaauaaagcgccggcuuagaacccugauuuuggcccccacaaggguaguggccgcugagauggaggaagcgcuaaaaggccugccuauccgauaucagacgacugcaaccaagagugcccauacagguaaagagaucguugaccucaugugccacgcuaccuucacuaugcgguuacuguccccgguccgcgugcccaacuacaaucuuauuaucauggaugaagcccauuuuacagacccagcaagcauagccgcuagaggguauauuucuaccagggugggaaugggcgaggcggccgcaaucuucaugacggcuacuccucccggcacagccgaugcauuuccacagagcaacgccccuauucaggacgaagagcgggacauccccgagcgauccuggaauucagggaacgaauggauaaccgauuucgcuggaaagaccgucugguuuguaccaaguauuaaggccgguaaugacaucgcgaacugucugagaaaaaacggcaagaaagugauccaacucagccgcaagacuuucgauacagaguaccagaaaaccaaguugaaugacugggauuuuguugugacaacugacauuucugaaaugggggcaaacuucaaggccgauagggucaucgacccgcgucggugccugaaaccugugauucucacggauggacccgagagaguuauacuggcuggcccaaugcccgugaccgucgccuccgcugcacagaggcgcggucgaguggggagaaauccucagaaggagaacgaccaauacaucuucacaggccagccacuuaauaacgaugaagaccacgcccauuggacugaggcuaaaaugcuacuggacaauauuaacacccccgaaggaaucaucccugccuuguuugagccggaacgggagaagucagcagcgauugauggcgaguauagguuaaaaggggaaagucgcaagacauucguagagcugaugcguagaggagaccucccaguguggcuggcccacaaaguugcuagcgaagguauaaaguacaccgaucggaaguggugcuuugacggcgagaggaauaaccagauccuugaagagaauauggaugucgagauuuggacuaaagaaggggagaagaaaaagcugcgcccccgauggcucgacgccagaacguauuccgauccuuuggcacugaaagaauucaaggacuuugcugccggacggaagucuaucgcacuagaucuggugaccgagauuggcagggugcccucgcaccucgcccaucgcacaagaaacgcucuugacaaucuggucauguuacacacuagcgaacauggugggagggcguaccggcacgccguugaggaguucccagaaaccauggagacauugcugcuccugggccuuaugauccugcucaccggaggcgcaauguuguuucugauaucagggaaaggaaucgguaagacuuccauuggcuuaaucugugugguagcuaguucugggaugcuauggauggccgaugugccucugcaguggauugccagcgcaaucguccucgaauucuuuaugauggugcuucugauacccgagccagagaaacaacguacaccucaggacaaccaguuggcuuauguugugauuggaauccugacgcucgccgcgauugucgcugccaaugaaaugggccugcuugagaccacuaagcgcgaucucgguauguccaaagaaccggggguagugucacccacaucuuaccuggacguugacuugcacccagcaagcgccuggacccuguaugcuguggcaaccacagucaucacuccuauguuacgacauacgauagagaacaguaccgccaaugugucccuagcggcuaucgccaaccaagcagucgugcugaugggccucgauaagggauggcccauuagcaagauggaccuuggcguuccacuguuggcccuggggugcuacucucaggugaacccucucacacugacugcugccguacuuuuacuggugacccacuacgcaaucauuggacccggccuccaggcuaaagccacaagagaagcgcagaagaggaccgccgcagguaucaugaaaaauccgacugucgaugggauaaugacgauugacuuggauccaguuaucuaugacucaaaguucgagaaacaacugggacaggugaugcuacugguccucugugcugugcagcuucuguugaugcggacauccugggccuuuugcgaggcacugacccucgcuacuggcccuaucaccacacugugggaagguagucccggcaaguucuggaacacuaccauugccguaagcauggccaauaucuuucgcgggucguacuuagcgggagcuggccuugcauucucuauaaugaaguccguggggacaggaaaaagaggcacggguagccagggggagacccugggagaaaaguggaaaaagaaacucaaccaacuaucaaggaaggaguucgaucuguauaaaaagaguggcauuacugaaguugaccggacagaggccaaggaggguuugaaaaagggcgaaaucacccaucacgcugugucucgaggguccgccaaacugcagugguuugucgagagaaauauggugauuccagaaggacgcgucaucgaucucggcugugggaggggaggcuggagcuacuauugcgcaggucuuaagaaagugacugagguucggggguacacaaagggaggccccggccaugaagagccuguaccgaugucaaccuauggguggaacauagugaagcugaugaguggaaaagacgucuucuacuugcccccagagaagugugauacgcugcucugcgacaucggugaaagcuccccuucucccaccguggaggaaagccguacaauuagaguuuuaaaaaugguggagccuuggcugaagaauaaccaguuuuguaucaaaguccuuaauccauacaugcccacugugauugagcaccuggaaaggcuacagcgcaagcacggcgggaugcucguacggaacccucugucccgaaauucaacccaugagauguauuggaucucuaacggaacaggcaauauugugaguucgguuaacauggucagcagauugcugcucaauagguucacuaugacccaccgccggccaacaaucgaaaaggauguggaccuuggugccgggaccagacaugugaacgcugagcccgaaacuccgaacauggacgucauaggagagcguauuaggcggaucaaagaggaacacuccucuacguggcacuacgaugaggaaaauccuuauaagacaugggcguaccauggcucauaugagguuaaagccaccggcagcgcauccaguaugaucaacggggugguaaagcuguuaacuaaaccaugggacgugguccccaccgugacacaaauggcuaugacggauaccacuccuuuuggacagcagcgcguuuucaaggaaaagguggacacacgaaccccaagacccaugccggguacuaggaaagccauggagauuacagcagaguggcuguggcggaccuugggccgcaauaagagaccuaggcucugcacacgagaagaguuuacuaaaaagguccggaccaacgccgcuaugggggccguguucacggaagagaaucaaugggauucugcgcgugcagccguagaagacgaggaguuuuggaaacugguugauagagaacgcgagcuacacaagcuuggaaaauguggcagcugcguguacaacaugauggguaagagggaaaagaaacugggggaguucggaaaggcuaaaggcucacgggccauaugguauauguggcucggcgcaagauaccuggaguuugaagcuuugggguuccugaaugaggaccauugguuuucccgcgaaaacaguuucagcggagucgagggugaaggccuccacaagcuuggguacauccugagggauauuucuaaaauccccggaggcgccauguaugcugacgauaccgccgguugggacacacgaauuacugaggacgauuuacauaaugaggaaaagaucacccagcagauggacccagagcaccggcagcuggcaaacgcgauauucaaguugacauaccaaaauaaaguggugaagguccagagaccuacucccaaagggaccguuauggauaucauuuccaggaaggaccagcgcggaucaggccaggugggcacguaugggcucaacacauuuaccaauauggaaguacaacugauccgucagauggagggagaaggugugcuaagcaaagccgaucuugagaacccacaccugcucgagaaggaaauuacucaguggcuggagacaaagggcgucgaacgguugaaaagaauggcuaucucgggggacgauugcgugguuaagcccauagacgauagguucgccgacgcauuacuggcucucaaugauaugggaaaagugcgcaaggacauuccucaguggcaaccaucuaaaggcuggcaugauuggcagcaggucccguuuuguagucaccauuuccacgagcuuaucaugaaggacggucgaaagcuggugguacccugccggccucaggacgaacuaaucgggagagccaggauuucccaaggagcaggcuggagccugaaagagaccgccugucucggcaaggcguacgcucagaugugggccuugauguauuuucaccgcagagaucugcggcuugcaucaaacgccauaugcuccgcuguuccagugcauuggguccccacuucuaggaccacauggagcauccacgcccaucaccaguggaugacgaccgaggacaugcugacuguguggaaccguguuuggauugaagauaauccuuggaucgaggacaaaacaccagugaccacuugggaagauguccccuaccucgggaagcgagaggaccaaugguguggaaguuuaauuggucuggcaucccgcgcuacaugggcccagaacaucuugaccgcgauacagcaggugagaagccugaucggcaaugaggaauuccucgauuauaugccuucuaugaaacgguuuaggaaggaggaagagucagaaggggcuauuugguga

SEQ ID NO: 15621 - RNA, 9873 nt, Artificial Sequence
  derived and/or modified CDS sequence (opt3) from DENV-3__KC762689__SS-prME
accagccugugccucaugaugaugauccccgccacacuugcuuuccaccugacuuccagagacggcgagccuaggaugauuguggggaagaacgaacggggaaaaucuuuguuauuuaagacggcaucagguauaaauauguguacccugaucgccauggaucuaggcgagaugugcgacgauacagucacuuacaaauguccacucauuaccgaaguugagccggaagacaucgauugcugguguaaccugacaaguaccugggugacuuaugggacaugcaaucaggcgggagagcaucgccgagacaagcguagcguagcucuugccccccacgugggcaugggucuggauaccagagcacaaacguggauguccgccgagggggcuuggaggcaggucgaaaaaguggagacuugggcauuccggcauccuggauuuaccauuuuggcccucuuccuggcucacuacaucggcacaucucugacucagaagguugugauauuuauccucuuaaugcuggucaccccaucgaugacaaugcgcugugugggcguagggaacagagacuucguugaaggacuuucaggugccaccuggguggaugucguguuggagcauggcgggugcgugacgacuauggcgaagaauaaacccacacuggacauugagcuacagaagaccgaagcaacucaacucgccacacugaggaaacuuuguaucgagggaaagauuaccaacgucacgaccgauagccggugcccuacacagggcgaagcuauccugccagaggaacaggaccagaauuauguuuguaaacacacuuacguggaucgcgguugggggaacggaugcggcuuguuuggcaaggggagucucguaaccugcgccaaguuccaaugucuggaguuuauagagggaaaagugguccagcacgaaaauuuaaaguauacagugauuaucacuguucauaccggugaccagcaccaggugggcaacgagacacaaggggucaccgcagaaauuacuccccaggcuuccacgguggaggccauccugccugaauacggaacacucggccuugagugcucuccacgaaccggucuggacuucaaugagaugaucuugcuaacuaugaaaaacaaggcguggaugguacauagacagugguuuuucgaucugccgcuccccuggaccagcggggccacaaccgaaacuccuacauggaauaaaaaggagcugcuuguuacguuuaaaaacgcacacgcuaagaagcaagaaguggucgugcugggcucccaggagggagccaugcacaccgcuuugacuggcgccacagaaauucagaccucagggggaacaaguauauucgcaggucaucucaaauguaggcugaagauggacaaauuagagcugaagggcaugagcuaugccaugugccuaaaugcuuucguccucaaaaaggaggugucugaaacucagcacgggaccauccugauuaagguugaguacaaaggagaagaugcgccauguaagauccccuuuuccacggaggacggccaagguaaagcacauaacgggcggcuuauaaccgccaacccugugguaacaaagaaagaggaaccagucaauauugaggcugaacccccguucggcgagucaaacaucgugaucggaauuggcgauaaggccuugaagaucaauugguacaaaaaggggagcaguauuggaaaaauguuugaagcaacugcccguggugcucgcagaauggccauacugggcgacaccgcaugggauuucgggucuguuggaggcgugcucaacucccuggguaagaugguccaccagaucuuugggagcgcguauacagcucuuuucucgggcgugucuuggauuaugaaaaucggaaucggcguacuguugacuuggauugggcucaauuccaagaacaccucaaugaguuuuagcugcauagugaucggaauuaucacgcuguacuuaggcgccguuguccaggcagacauggguugugugauuaauuggaaggggaaagagcugaagugcggauccggcaucuucgugacaaacgagguccauaccuggacugaacaguauaaauuucaagccgauucuccuaagaggcuagcuacagccauagcaggugcuugggagaauggcguuugugggauccggagcaccacucgaauggaaaaccuccuguggaaacagauugccaaugagcuuaacuacaucuugugggaaaauaacauuaagcugaccguggugguaggagacaucauaggcguccucgagcaggggaaacgcacacugacgccccagccaauggaguuaaaguauucauggaagaccuggggaaaagcgaagauugugacugccgaaacacaaaauaguuccuucaucauugauggcccuaacacccccgagugcccaagcgcuucuagagcauggaacguuugggaaguggaggacuacgguuuuggggucuucacaacuaauaucuggcugaaacuuagggaaauguauacccaguugugugaccaccggcucaugucagccgcugugaaggaugagcgcgccguucacgcagacaugggauacuggauagagagucagaaaaacggcagcuggaagcuggaaaaggcgucccuaaucgaggugaaaacgugcacauggcccaagucucauacccuguggucgaaugguguacucgaaagcgauaugauuaucccuaaaucccuggccggcccagucucacagcacaacuacagaccgggguaucauacucaaaccgcuggacccuggcaccuuggcaaguuggagcuggacuuuaauuacugcgaggggacaacuguggugauuaccgaaaguuguggaacaaggggcccuucuuuacguacgaccacugucagcgguaaacucauccacgaguggugcugucgguccugcacacugccaccccuucgauauaugggggaagauggauguugguacggcauggagauaagaccuauuaacgaaaaggaggagaauaugguuaagucacuggugagcgccgguucuggcaaaguagacaacuucaccauggggguguugugccucgcaauccuguucgaagaggucaugaggggaaaguuuggcaaaaagcauaugaucgcuggggugcuauucacuuuuguucugcuccuguccggacagauuacauggcgcgauauggcccggacccuuaucaugauuggcaguaaugcaagcgacagaauggguaugggggugacguauuuggcccugauagcuacuuucaaaauccagccauuuuuagcgcucggauucuuucugaggaagcuuaccucucgcgaaaaccugcuacucggcgucggccuggccauggcaacaaccuugcaacugcccgaggauauugaacagauggcuaaugggaucgccuuaggacucauggcccugaagcuuauuacucaguucgagacauaccagcuguggaccgcuuuggugucccucauguguucaaacacaaucuuuacucugaccguugcauggcgaacggccacacuaauacuggcggguaucagucuucucccggugugccaaagcucguccaugcggaaaaccgacuggcugccugucacuguagcugccaugggcgugccacccuugccucuguucauuuuuucuuuaaaggauacccucaaacguagaagcuggccccugaaugaggggguuauggcagugggacuugucucaauccuggccaguuccuugcucaggaacgacgugccaauggcuggcccucugguagcaggugggcuacugauugccuguuaugugaucacaggaacuucugcggaucuuaccgucgaaaaggcugccgacguuauaugggaggaagaggcagaacagacgggcgugagccacaaucucaugauuacaguggacgaugacggcaccaugcgcaucaaagaugacgagacugagaacauccugacagucuuguuaaagaccgcccugcucauuguguccgggauauuccccuacucaaucccagcuacucugcuuguuuggcauacauggcagaaacagacccaacggagcggaguacugugggaugugccgaguccucccgaaacgcagaaggccgaguuggaagagggugucuacagaauuaagcagcagggcaucuuugggaaaacucaagugggaguuggcgugcagaaggagggugucuuccacaccauguggcaugugacaaggggggcaguacuaacccacaacggaaaacgacuggaaccaaauugggcuucugucaagaaagaccucauuuccuauggcggcggguggcgccugagcgcccaguggcaaaagggagaggaagugcagguuguggcggucgagcccgguaagaacccuaaaaauuuccagacaaugccaggcaucuuucagacuaccacgggggaaauaggagccaucgcacuugauuucaagcccggcacaucggguucaccuauuaucaaccgggaggggaaagugguuggauuauacggcaauggcguggucacuaagaacgggggauaugugucugguauugcucaaaccaaugccgagccggacggcccaacacccgaucuggaagaggaaauguuuaaaaagagaaaccucaccaucauggacuugcacccugggaguggaaagacuaggaaauaccugccagcuauaguacgugaggcaauuaagcgccggcucagaacccugauccuugcccccacaagggugguugccgcugaaauggaggaggcgcugaaaggcuugccuauccgauaucagacgacugcaaccaaguccguccauacagguaaagaaauuguggaucuaaugugccacgccaccuucacuaugcggcugcucagcccggugcgcguccccaauuacaacuuaaucauaauggacgaggcucauuuuacagauccagccucuauugcagccagaggguauaucagcaccaggguaggaaugggcgaagcugcggccauuuucaugacggcaacuccucccggcacagcugacgccuuuccacaguccaaugcaccuauccaggacgaggaacgggauauacccgagcgaucauggaacagugggaaugaguggauuaccgacuucgccggaaagaccgugugguuuguuccaagcaucaaggcugguaacgauaucgccaauugucugagaaaaaacggcaagaaagugauucaacuuucucgcaagacuuucgacacagaauaccagaaaaccaagcugaacgauugggacuuugucgugacaacugauaucuccgagaugggggcgaauuucaaggcagacaggguuauugauccgcgucggugccucaaaccugugauauugacggacggacccgaaagagucauccuggccggcccaaugcccgugaccguagcuucagccgcucagaggcgcggucgaguggggagaaacccucagaaggagaaugaucaauacauuuucacaggccagccacucaacaaugacgaggaccacgcacauuggacugaagccaaaaugcugcuugauaacaucaauacccccgagggaaucauuccugcucuauuugaaccggagcgggaaaagagugccgcaauagacggcgaguauaggcugaaaggggagagccgcaagacauucguugaauugaugcguagaggagauuuaccagucuggcuggcgcacaaaguggccuccgaggguaucaaguacaccgaccggaaguggugcuuugauggcgaaaggaacaaucagauucucgaggaaaacauggacguggagaucuggacuaaagagggggaaaagaaaaagcugcgcccccgauggcuugaugcuagaacguauucugacccucuggcccucaaagaguucaaggauuuugcagcuggacggaagucgauugccuuggaccuggucaccgaaaucggcaggguucccagccaccuagcauaccgcacaagaaaugcccuggauaaccucgugaugcuucauacuucagagcacggugggagggcuuaucggcaugcgguagaagagcugccagagaccauggaaacauuauugcugcucggccugaugauacuucugaccggaggcgccaugcucuucuugaucuccgggaaaggaauugguaagacuaguaucggccugauuuguguggucgcaucuagcgggauguuauggauggcugacgugccucuacaguggaucgccuccgccauaguucuggaguuuuucaugauggugcuccuuauucccgaaccagagaaacaacguacaccucaggauaaucagcuggcauacgucguaaucggaauuuugacgcuggcugccaucguggcggcuaacgagaugggccuccuggaaaccacuaagcgcgaccuugguaugucaaaagagccggggguugugucucccacaagcuaucucgacgucgaucugcacccagccagugcauggaccuuguacgccguggcuaccacagucauaacuccuaugcugcgacacacgaucgaaaauuccaccgcaaacgugagcuuagccgcgauugcuaaucaagccguugugcuaaugggccuggacaagggauggcccaucucuaagguagaucucggcgugccacuucuggcauuggggugcuacucacaggucaacccucugacacucacugccgcuguucugcuuuuagugacccauuaugccauuaucggacccggccugcaggcaaaagcuacaagagaggcccagaagaggaccgcggccgguauaaugaaaaacccgacugucgacgggauuaugacgaucgaucucgacccagugaucuacgauuccaaguuugaaaaacaauugggacagguaaugcugcuagugcugugugcaguucagcuccuucugaugcggacaaguugggcuuucugcgaggccuugacccuggcaacuggcccuauuaccacacucugggaggguagccccggcaaguuuuggaauacuaccaucgcugugucgauggccaacauauuccgcgggucuuaucuggccggagcgggcuuagcuuuuuccauuaugaagagcgucgggacaggaaaaagaggcacggguucacagggggaaacccuuggagagaaguggaaaaagaaacugaaucaacucaguaggaaggaauucgaccuauacaaaaagucuggcaucacugagguggaucggacagaagcaaaggagggucugaaacgaggcgagaccacucaccaugccgucuccagagggagcgcuaaguugcagugguucguggaacgcaacaugguuauuccagagggaaggguaaucgaccugggcugugggcggggaggcuggucauauuacugcgccggucucaaaaaggugacagaaguccguggguauaccaaaggaggccccggccacgaggaaccugugccgaugaguacguacggguggaauauaguuaagcuuaugagcggaaaggauguguuuuaccugcccccagagaaaugugacaccuugcugugcgauaucggugaguccucuccuagccccacagucgaagaguccagaacuauuagggugcucaagaugguagaaccuugguuaaaaaacaaucaguucuguaucaaggugcugaacccauauaugcccaccguuauugagcaucuugagcgccugcagcggaaacacggcgggaugcuaguccgaaauccucucucaagaaacucuacacacgaaauguacuggaucaguaauggaacuggcaacauugugucgagcgugaauauggucuccaggcuguugcugaaccgcuuuaccaugacacaucggagaccaaccaucgagaaggacguugaccucggugcagggacucgucacgugaaugccgaacccgagacgccgaacauggauguaauaggagaaaggauucggcgcaucaaggaggagcauucuucaacauggcacuaugacgaagagaacccuuacaaaaccugggcuuaucacggcagcuacgaagugaaggcgacuggcuccgccaguucuaugaucaauggggucgugaaacuucugaccaagccaugggauguugugcccacagucacgcaaauggcaaugaccgacacuacaccuuucggacagcagcgaguguuuaaagagaagguagauaccagaacuccaaggcccaugccggguacacggaaggcuauggaaauuaccgccgagugguuauggcgcacacugggcagaaacaaaaggccucgauugugcacucgggaggaauucaccaagaaaguucguacgaaugcagccaugggggcuguguuuaccgaggaaaaccaaugggacagcgccagagcggcagucgaggaugaagaguucuggaagcucguggaccgcgagagggaacugcauaaacuaggaaaguguggcucaugcguguauaauaugauggguaaacgggagaagaagcuuggggaauuuggaaaagccaagggcuccagagcuauaugguacauguggcugggcgcccgcuaccucgaguucgaggcacugggguuuuugaacgaagaucacugguucaguagggagaauagcuuuucuggagucgaaggugagggccugcauaaacucggguauauccuucgagacauuuccaagauccccggaggcgcuauguacgccgaugacacagcugguugggacacucggauuaccgaagaugaccugcacaacgaggagaaaaucacacagcagauggauccagaacauagacaguuagccaaugcaauauucaagcugacuuaucaaaacaagguugugaaaguacagaggccuacccccaaggggacggugauggacaucauuucacgcaaagaucagcguggaagcggccaggucggcacauacggguugaauaccuucacuaacauggaggugcaacucauccggcagauggaaggagaggguguucugucgaaggcggaccuagaaaauccacaccuucuggagaaagagauuacacaguggcucgaaaccaagggcguggagagacugaagaggauggccaucucuggggaugacugcgucgugaaacccauagaugaccgcuuugcugaugccuuguuagcacugaacgacaugggaaagguacgaaaagauauuccucaguggcaaccaaguaagggcuggcacgacuggcagcagguuccguucuguucccaucacuuucaugaacucaucaugaaagacggucggaagcuugugguccccugcagaccucaggaugagcugaucgggagggcucgcauuagccaaggagccggcuggucacuaaaggaaacugcaugucugggcaaagccuaugcgcagaugugggcucucauguacuuccacagacgggacuugaggcuggccuccaaugcaauaugcucugccgugccaguucacugggugcccaccagccguacaacguggaguauccaugcucaccaucaguggaugaccacugaggauaugcuuacagucuggaaccgaguguggauugaggacaacccuuggauggaagauaagaccccaguaacuacaugggaggacgugcccuaucuggggaaacgcgaagaucaaugguguggaucccucaucgguuuagccagcagagcaaccugggcucagaauauucugacggccauccagcagguccggucuuugauaggcaacgaggaguuucuggacuacaugccuucaaugaagagguuccgcaaagaagaggaaagugagggggcgaucugguga

SEQ ID NO: 15622 - RNA, 9873 nt, Artificial Sequence
  derived and/or modified CDS sequence (opt3) from DENV-3__KC762690__SS-prME
accagccugugccucaugaugaugcuucccgcaacacuggcuuuccacuugacuuccagagacggagaaccuaggaugaucguggggaagaacgaacggggaaaaucuuuacuguuuaagacggcaucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagaguuuaucgagggaaaagugguccagcacgaaaaucugaaguauacagugauaauuacuguucauaccggugaccagcaccaggugggcaacgagacacaaggggucaccgcagaaaucacuccccaggcuuccacgguggaggccauucucccugaauacggaacacuuggccuggagugcucuccacgaaccgguuuggacuucaaugagaugauccuacugacuaugaaaaacaaggcguggaugguacauagacagugguuuuucgaucucccgcugcccuggaccagcggggccacaaccgaaacuccuacauggaauaaaaaggagcuucugguuacguuuaaaaacgcacacgcuaagaagcaagaaguggucguguugggcucccaggagggagccaugcacaccgcucucacuggcgccacagaaauccagaccucagggggaacaaguauuuucgcaggucaucugaaauguagguuaaagauggacaaacuggagcuaaagggcaugagcuaugccaugugccucaaugcuuucguccugaaaaaggaggugucugaaacucagcacgggaccauacuuaucaagguugaguacaaaggagaagaugcgccauguaagauucccuuuuccacggaggacggccaagguaaagcacauaacgggcgguugaucaccgccaacccugugguaacaaagaaagaggaaccagucaauauagaggcugaacccccguucggcgagucaaacauugugaucggaaucggcgauaaggcccugaagauuaauugguacaaaaaggggagcaguaucggaaaaauguuugaagcaacugcccguggugcucgcagaauggccauucucggcgacaccgcaugggauuucgggucuguuggaggcgugcugaacucccuugguaagaugguccaccagauauuugggagcgcguauacagcucuguucucgggcgugucuuggaucaugaaaauuggaaucggcguauugcucacuuggaucgggcuaaauuccaagaacaccucaaugaguuuuagcugcauugugauaggaaucauuacguuauaccugggcgccguuguccaggcagacauggguugugugaucaauuggaaggggaaagagcuaaagugcggauccggcauuuucgugacaaacgagguccauaccuggacugaacaguauaaauuucaagccgauucuccuaagaggcucgcuacagccaucgccggugcuugggagaauggcguuugugggauacggagcaccacucgaauggaaaaccugcuuuggaaacagaucgccaaugaguugaacuacauucugugggaaaauaacaucaagcucaccguggugguaggagacauuaucggcguccuggagcaggggaaacgcacauuaacgccccagccaauggagcugaaguauucauggaagaccuggggaaaagcgaagauagugacugccgaaacacaaaauaguuccuucauuaucgauggcccuaacacccccgagugcccaagcgcuucuagagcauggaacguuugggaaguggaggacuacgguuuuggggucuucacaacuaauauuuggcuuaaauugagggaaauguauacccagcucugugaccaccggcugaugucagccgcugugaaggaugagcgcgccguucacgcagacaugggauacuggaucgagagucagaaaaacggcagcuggaagcuagaaaaggcgucccugauagaggugaaaacgugcacauggcccaagucucauacccucuggucgaaugguguacuggaaagcgauaugaucauuccuaaaucccuugccggcccagucucacagcacaacuacagaccgggguaucauacucaaaccgcuggacccuggcacuugggcaagcuggaguuagacuuuaauuacugcgaggggacaacuguggugaucaccgaaaacuguggaacaaggggcccuagucuccguacgaccacugucucugguaaacugauucacgaguggugcugucggagcugcacacuuccaccccugcgauauaugggggaagauggauguugguacggcauggagaucagaccuauaaaugaaaaggaggagaacaugguuaaguccuuggugucagccgguagcggcaaaguagacaauuucaccaugggggugcucugccuggcaauucuauucgaagaggucaugaggggaaaguuuggcaaaaagcauaugaucgcuggggugcuguucacuuuuguucuccugcuuucuggacagaucacauggcgcgauauggcccggaccuugauuaugaucggcuccaacgcaagugacagaauggguaugggggugacguaucuggccuuaauugcuacuuucaaaauacagccauuucucgcgcugggauucuuucuuaggaagcugaccagccgcgaaaaucuacuccugggcgucggcuuggccauggcaacaacccugcaauuacccgaggauaucgaacagauggcuaacgggauugcccucggacugauggcccuuaagcugaucacucaguucgagacauaccaguuguggaccgcucucgugucucugauguguuccaauacaauuuuuacucuaaccguugcauggcgaacggccacacugauccuugcggguauaucacuccugccggugugccaaaguagcucgaugcggaaaaccgacugguugccugucacuguagcugccaugggcgugccaccccugccuuuauucaucuuuucccucaaggauacccugaaacguagaucuuggccccuuaacgaggggguuauggcagugggacuggucagcauuuuggccucaagucuccugaggaaugacgugccaauggcuggcccucuaguagccggugggcugcuuaucgccuguuaugugauuacaggaacuuccgcggaucucaccgucgaaaaggcugccgacguuaucugggaggaagaggcagaacagacgggcgugucucacaaccugaugauaacaguggacgaugacggcaccaugcgcauuaaagaugacgagacugagaacaucuugacagucuuacugaagaccgcccuccugaucgugagcgggauuuuccccuacuccauaccagcuacucuucugguuuggcauacauggcagaaacagacccaacggucaggaguauugugggaugugccgagcccucccgaaacgcagaaggccgagcuagaagagggugucuacagaaucaagcagcagggcauuuuugggaaaacucaagugggaguuggcgugcagaaggagggugucuuccacaccauguggcaugugacaagaggggcaguacugacccacaauggaaaacgacucgaaccaaacugggcuagugucaagaaagaccugaucucuuauggcggcggguggcgccuuuccgcccaguggcaaaagggagaggaagugcagguuauugcgguggagcccgguaagaauccuaaaaacuuccagacaaugccaggcaucuuucagacuaccacgggggaaauaggagccaucgcauuagauuucaagcccggcacaagcgguucgccuauuaucaaucgggaggggaaagucgugggacuguacggcaacggcguugugacuaagaaugggggauaugucucagguauugcucaaaccaacgccgagccggacggcccaacacccgaacucgaggaagagauguuuaaaaagagaaauuugaccaucauggaucugcacccugggucuggaaagacuaggaaauaccucccagcuauagugcgugaagcaauuaagcgccggcugagaacccuuauccuggcccccacaaggguaguggccgcugagauggaggaagcguugaaaggccuaccuauccgauaucagacgacugcaaccaagagugcccauacagguaaagagauuguugaccugaugugccacgcuaccuucacuaugcggcucuuauccccgguccgcgugcccaacuacaaucugaucauaauggaugaagcccauuuuacagacccagcaagcauugccgcuagaggguauaucucuaccagggugggaaugggcgaggcggccgcaauuuucaugacggcuacuccucccggcacagccgaugcauuuccacagagcaacgccccuauccaggacgaagaacgggacauacccgagcgauccuggaacucagggaacgaauggauuaccgauuucgcuggaaagaccgucugguuuguaccaaguaucaaggccgguaaugacaucgcgaacugucuuaggaagaauggcaagaaagugauucaacugagccgcaagacuuucgauacagaguaccagaaaaccaagcucaaugacugggauuuuguugugacaacugacaucucugaaaugggggcaaacuucaaggccgauagggucauugacccgcgucggugcuugaaaccugugauacugacggauggacccgagagaguuauccucgcuggcccaaugcccgugaccgucgccuccgcugcacagaggcgcggucgaguggggagaaauccucagaaggagaacgaccaauacauuuucacaggccagccacugaauaacgaugaagaccacgcccauuggacugaggcuaaaaugcuucuagacaauaucaacacccccgaaggaaucauuccugcccuguuugagccggaacgggagaagucagcagcgauagauggcgaguauagguugaaaggggaaagucgcaagacauucguagaguuaaugcguagaggagaccugccaguguggcucgcccacaaaguugcuagcgaagguaucaaguacaccgaucggaaguggugcuuugacggcgagaggaauaaccagauucuggaagagaauauggaugucgagaucuggacuaaagaaggggagaagaagaaacuucgcccccgauggcuggacgccagaacguauuccgauccucucgcauugaaagaguucaaagacuuugcugccggacggaagucuauugcacuggaucuagugaccgagaucggcagggugcccucgcaccuggcccaucgcacaagaaacgcucucgacaaucuugucaugcugcacacuagcgaacauggugggagggcguaccggcacgccguugaggaguuaccagaaaccauggagacauugcugcuccugggccuuaugauacugcucaccggaggcgcaauguuguuccugaucucagggaaaggaauugguaagacuuccaucggcuuaauuugugugguagcuaguucugggaugcuauggauggccgaugugccucugcaguggaucgccagcgcaauaguccucgaauuuuucaugauggugcuucugauucccgagccagagaaacaacguacaccucaggacaaccaguuggcuuauguugugaucggcauucugacgcucgccgcgaucgucgcugccaaugaaaugggccugcuugagaccacuaagcgcgaucucgguauguccaaagaaccggggguagugucacccacaucuuaccuggacguugacuugcacccagcaagcgccuggacccuguaugcuguggcaaccacagucauaacuccuauguuacgacauacgaucgagaacaguaccgccaaugugucccuagcggcuauugccaaccaagcagucgugcugaugggccucgauaagggauggcccaucagcaagauggaccuuggcguuccacuguuggcccuggggugcuacucucaggugaacccucucacacugacugcugccguacuuuuacuggugacccacuacgcaauuaucggacccggccuccaggcuaaagccacaagagaagcgcagaagaggaccgccgcagguauaaugaaaaauccgacugucgaugggauuaugacgaucgacuuggauccaguuaucuaugacucaaaguuugagaaacaacugggacaggugaugcuacugguccucugugcugugcagcuucuguugaugcggacauccugggccuucugcgaggcacugacccucgcuacuggcccuauuaccacacugugggaagguagucccggcaaguuuuggaacacuaccaucgccguaagcauggccaauauauuccgcgggucguacuuagcgggagcuggccuugcauuuucuauuaugaaguccguggggacaggaaaaagaggcacggguagccagggggagacccugggagaaaaguggaaaaagaaacucaaccaacuaucaaggaaggaguucgaucuguauaaaaagaguggcaucacugaaguugaccggacagaggccaaggaggguuugaaacgaggcgaaauuacccaucacgcugugucuagaggguccgccaagcugcagugguucgucgagcgcaauauggugaucccagaaggaagggucauagaucucggcugugggcggggaggcuggagcuacuauugcgcaggucuuaaaaaggugacugagguucguggguacacaaaaggaggccccggccaugaagaaccuguaccgaugucaaccuauggguggaacaucgugaagcugaugaguggaaaggacgucuuuuacuugcccccagagaaaugugauacgcugcucugcgacauuggugaaagcuccccuucucccaccguggaggaaagcagaacaaucaggguuuuaaagaugguggagccuuggcugaaaaauaaccaguucuguauuaagguccuuaauccauacaugcccacugugaucgagcaccuggaacgccuacagcggaaacacggcgggaugcucguacgaaacccucuguccagaaauucaacccaugagauguauuggauuucuaacggaacaggcaauaucgugaguucgguuaacauggucagcagguugcugcucaaucgcuuuacuaugacccaccggagaccaacaauagaaaaggauguggaccuuggugccgggacccgucaugugaacgcugagcccgaaacuccgaacauggacgucauuggagagaggauccggcgcaucaaggaggaacacuccucuacguggcacuacgaugaggaaaauccuuauaaaacaugggcguaccauggcucauaugagguuaaggccaccggcagcgcauccaguaugauuaacggggugguaaaacuguuaacuaagccaugggacgugguccccaccgugacacaaauggcuaugacggauaccacuccuuucggacagcagcgaguuuuuaaagaaaagguggacacaagaaccccaaggcccaugccggguacucggaaggccauggagauaacagcagaguggcuguggcgcaccuugggcagaaauaaaaggccucgacucugcacacgggaagaguucacuaagaaaguccguaccaacgccgcuaugggggccguguuuacggaagagaaucaaugggauucugcgagagcagccguagaagacgaggaguucuggaagcugguugaucgcgaaagggagcuacacaaacuuggaaaguguggcagcugcguguacaacaugauggguaaacgggaaaagaagcugggggaguuuggaaaagcuaagggcucaagagccaucugguauauguggcucggcgcacgcuaccuggaguucgaggcuuugggguuucugaaugaggaccauugguucuccagggaaaacaguuuuagcggagucgagggugaaggccuccacaaacuuggguacauucugcgagauaucucuaagauucccggaggcgccauguaugcugacgauaccgccgguugggacacacggaucacugaggacgauuuacauaaugaggagaaaauaacccagcagauggagccagaacacagacagcuggcaaacgcgaucuucaaguugacauaccaaaauaagguggugaaaguccagaggccuacucccaaggggaccguuauggacauuaucucccgcaaagaucagcguggaucaggccaggugggcacguaugggcucaacacauucaccaauauggagguacaacugauucggcagauggaaggagagggugugcuaagcaaggccgaccuugagaacccacaucugcucgaaaaagagaucacucaguggcuggaaacaaagggcgucgagagauugaagaggauggcuauaucgggggaugacugcgugguuaaacccauugaugaccgcuuugccgaugcauuacuggcucucaaugacaugggaaaggugcgaaaagauaucccucaguggcaaccaucuaagggcuggcaugacuggcagcaggucccguucuguagucaccauuuucacgaacuuaucaugaaagauggucggaagcuggugguacccugcagaccucaggacgagcuaauugggagggcccgcauaucccaaggagcaggcuggagccugaaggagaccgccugucucggcaaagcguacgcucagaugugggccuugauguauuuccacagacgggaccugaggcuugcaucaaacgccaucugcuccgcuguuccagugcauuggguccccacuucucguaccacauggagcauucacgcccaucaccaguggaugacgaccgaagauaugcugacuguguggaaccgaguuuggaucgaggacaauccuuggauggaagauaagacaccagugaccacuugggaggacguccccuaccucgggaaacgcgaggaucaaugguguggaaguuuaauuggucuggcauccagagcuacaugggcccagaacaucuugaccgcgauacaacaggugcggagccugaucggcaaugaagaguuucucgacuauaugccuucuaugaagagguuccgcaaagaagaggaaucagagggggcuauuugguga

SEQ ID NO: 15623 - RNA, 9873 nt, Artificial Sequence
  derived and/or modified CDS sequence (opt3) from DENV-3__KC762691__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaagauaaggcguggaugguacauagacagugguucuuugaccugccgcuucccuggaccagcggggccacaaccgaaacuccuacauggaacaaaaaggagcuguugguuacguucaaaaaugcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggauaaacuagagcucaagggcaugagcuauacuaugugcucuaacgccuucguccugaaaaaggagguguccgaaacccagcacgggacgauacuuaucaagguugaguacaaaggagaagacgcuccauguaagauucccuucucaaccgaggauggccaagguaaagcgcauaaugggcgguugaucacagcaaacccugugguaacuaagaaagaggaaccagucaacauagaggccgaacccccguuuggcgagagcaauauuaucaucggaauuggcgacaaggcucugaagaucaacugguacaaaaaggggaguucuauuggaaaaauguucgaagccaccgcacguggugcccgcagaauggcuauacucggcgauacagccugggacuuuggguccgugggaggcguucugaauagccuugguaagauggugcaccagaucuucgggucggcauauacugcgcuguuuucuggcgucuccuggauuaugaaaaucggaaucggcguguugcucaccuggauugggcugaacucaaagaauacgaguaugagcuucuccugcauaguaaucggaauuaucacauuauaccugggcgcugugguucaggccgauauggguugugucauuaacuggaaggggaaagagcuaaagugcggaucuggcaucuuugugaccaaugaggugcauacuuggacagaacaguauaaauuccaagcagacagcccuaggcggcucgccaccgcuauagccggugcaugggagaacggcgucugugggauccgaucaacuacccgcauggaaaaucugcuuuggaagcagauugcuaacgaguugaauuacauccugugggaaaacaauauuaaacucacaguuguggugggagauacgaucggcguacuggagcaggggaagagaaccuuaacuccccagccaauggagcugaaauauaguuggaagacauggggaaaggccaaaauagucaccgcggaaacacaaaacuccagcuuuauuaucgacggcccuaauacucccgagugcccaaacgccucuagggcuuggaacgugugggaaguugaggacuacgguuucgggguguuuaccacgaauauuuggcuuaaguugcgggaaauguauacacagcucugugaucaccgccugaugucagcagccgucaaagacgagagagcugugcacgccgauaugggauacuggaucgagagucagaagaacggcagcuggaaacuagaaaaggcaucccugauagagguuaagaccugcacuuggcccaaaucucauacccucuggucgaauggugugcuggaaagcgacaugaucauuccuaagucccuugcgggcccaaucucacagcacaacuacaggccgggguaucauacacaaacugccggacccuggcacuugggcaaacuggaguuagauuucaauuacugcgaggggaccacaguagucauuacggaaaacuguggagcucguggcccuagucuccggaccacuacagugucugguaagcugauccacgaguggugcugucgaagcugcacccuuccaccccugagauauaugggggaagacggauguugguacggcauggagauaaggccuauuaaugaaaaagaggagaacauggugaaguccuuggucucagccgguagcggcaagguugauaauuuuacuaugggggugcucugccuggcaauccuauucgaagagguaaugcgcggaaaauucggcaagaaacauaugaucgcuggggugcuguuuacauucguccuccugcuuucuggacagauuaccuggcgggacauggccagaacguugaucaugauuggcuccaacgcaagugauaggauggguaugggggugacuuaucuggccuuaauagcuaccuuuaagauccagccauuccucgcgcugggauuuuuccuucgcaaacugacaagccgagaaaaucuacuccugggcguuggcuuggccauggcaaccacucugcaauuacccgaggacauugaacagauggcuaacgggaucgcccucggacugauggcccuuaagcugauuacacaguuugagaccuaccaguuguggacagcucucgugucucugauguguuccaauacuaucuucacccuaacggucgcauggcggacagccacccugauacuugcggguaucucacucuuuccggugugccaaaguagcucgaugcguaagacugauuggcugccuaugaccguugcugccaugggcgugccacccuugccucuguucauuuuuuccuuaaaagacacacucaagagaaggucuuggccccugaacgagggggucauggcaguaggacuugugagcauccuggccucaaguuugcuccgcaaugauguuccaauggcuggcccucugguggcaggugggcuacugauugccuguuaugucaucacuggaaccuccgcggaccuuacgguggaaaaagcugccgacguaacaugggaggaagaggcagaacagaccggcgugucucacaaccucaugauaacugucgaugacgauggcacaaugcggauuaaggacgaugagaccgagaacauccugacuguuuuguuaaaaacagcccugcucaucgugagcgggauuuuccccuacuccauaccagcuacccugcuuguguggcauacguggcagaagcagacucaaagaucaggaguccugugggacgugccgagcccucccgaaacccagaaagccgaguuggaagaggguguuuacaggaucaagcagcagggcauuuuugggaagacacaaguaggagugggcguccagaaagaggguguguuccacaccauguggcauguuacacgaggggcagugcuaacuuauaauggaaagcgccuggaaccaaacugggcuagugucaaaaaggaucucaucucuuacggcggcggguggcggcuguccgcccaguggcaaaaaggagaggaagugcagguaauugcggucgagcccgguaagaauccuaagaacuuccagaccaugccaggcaucuuucagacgacaacuggggaaauaggagccaucgcacuugacuucaaacccggcaccagcgguucgccuauuaucaauagagaggggaaggugguuggauuauauggcaacggcguggucacaaaaaaugggggauacgugucagguauugcucaaaccaacgccgagccggauggcccaacucccgaacuggaggaagagauguuuaagaaaaggaaucucaccaucauggacuugcacccugggucuggaaagacacguaaguaucugccagcuauaguucgcgaagcaauuaaacggagacucaggacgcugauccuugcccccacucgaguggucgccgcugagauggaggaagcgcugaagggcuugccuauccgguaccagaccacagcaaccaaaagugagcacacugguaaggaaauuguggaucuaaugugccaugccacauucaccaugcgccugcucuccccgguaagagugcccaacuauaauuuaaucauaauggacgaggcucacuuuacggauccagccagcauugcagccaggggguacaucucuacucggguuggaaugggcgaagcugcggccauuuucaugacagcaaccccucccggcaccgcugacgccuuuccacagagcaacgcaccuauccaggacgaggagcgagauauacccgaaagauccuggaauucagggaacgacuggauuacugauuucgccggaaaaacagucugguuugugccaaguaucaaggcugguaaugacaucgccaacugucugcgcaagaacggcaaaaaggugauucaacuuagcaggaaaaccuucgauacagaguaccagaagacuaaacugaaugacugggauuuugucguaacgaccgacaucucugaaaugggggcgaacuucaaggcagaucgugugauugacccgcggagaugccucaagccuguuauauugacagauggacccgagagggugauccuggccggcccaaugcccgucacuguggcuuccgccgcucagcgccgagguagaauugggcggaauccucagaaagagaacgaccaauauaucuucaccggccagccacucaauaacgacgaagaucaugcacacuggacagaggccaagaugcugcuugacaauaucaacacccccgaaggaauuauaccugcucuauuugagccggaaagggagaaaucagccgcaaucgauggcgaguaccgccugaagggggaaagucguaaaacuuucguugaguugaugagacggggagacuuaccaguguggcuggcgcauaaggucgccagcgaagguauuaaauauacggauaggaaguggugcuuugacggcgagcgcaauaaccagauccucgaagagaauauggauguggagauuuggaccaaggaaggggagaaaaagaaacugcgacccagauggcuugacgcucggacauacuccgauccucuggcccucaaggaauucaaagacuuugcagcuggaaggaagucuaucgccuuggaucugguaacugagauaggccgcgugcccucgcaccuagcacacagaaccaggaacgcccuggacaaucucguuaugcuucauacaagcgaacacggugggcgggcuuaucgucaugcggucgaggagcugccagaaaccauggagacuuuauugcugcucggccugaugauccuucugacaggaggcgccaugcucuucuugauuucagggaagggaguggguaaaacguccaucggccugauuuguguggucgcaaguucugggauguuauggauggcugauaucccucuacaguggauagccagcgccauuguucuggaauuuuucaugauggugcuccuuauccccgagccagagaagcaacgcaccccucaggacaaccagcuggcauacguagugauuggaaucuugacucuggcugccauagucgcggcuaaugaaaugggccuccuggagacaaccaaacgagaccuugguauguccaaggaaccgggggugguuucacccaccucuuaucucgauguggaccugcacccagccagcgcauggacauuguacgccgucgcuacuacgguaaucaccccuaugcugagacacacaauugagaacaguacugcaaauguguccuuagccgcgaucgcuaaccaagccguugugcuaaugggccuggauaaaggauggcccauuagcaagauggaccucggcgucccacuucuggcauuggggugcuacucucaggugaacccucugacccucacagccgcuguccugcuuuuagugacccauuaugccaucauaggacccggccugcaggcaaaggcuacuagggaagcccagaaacggacggcggccgguauuaugaagaauccgacaguugaugggaucaugaccaucgaccucgauccagugauuuacgacucaaaauuugagaagcaauugggacagguaaugcugcuagugcugugugcaguccagcuccuucugaugcgcacuuccugggcuuucugcgaggccuugacccuggcaacaggcccuaucacuacccucugggaagguagucccggcaaauuuuggaacacaacgauagcuguuagcauggccaauauuuucagagggucguaucuggccggagcgggcuuagcuuuuucuaucaugaaguccguggggaccggaaagaggggcacugguagccagggggagacacuuggagaaaaauggaagaaaaagcugaaccaacucucacggaaagaguucgaucuauacaagaaaaguggcauuaccgaagucgaccgaacugaggcaaaggagggucugaagagaggcgaaaucacacaccaugccgugucucgcggguccgcuaaauugcagugguucguagagaggaauauggugauaccagaaggacggguuaucgaucugggcugugggcguggaggcuggagcuauuacugcgccggucucaagaaagugaccgaggucagaggguauacgaagggaggccccggccacgaagagccugugccgaugucaaccuacggguggaacauugucaaacuuaugaguggaaaggacguguuuuaccugcccccagagaagugugauacauugcugugcgacaucggugaaagcuccccuucucccacuguugaggaaagcaggaccauucgcguacucaaaaugguggagccuugguuaaagaauaaccaguucuguaucaaaguccugaauccauauaugcccacagugauugagcaucuugaacggcugcagcgaaagcacggcgggaugcuaguuagaaacccucucuccaggaauucaacucacgagauguacuggaucucuaacggaaccggcaauauagugaguucggucaacauggugagccgccuguugcugaaucgguuuacaaugaccuauagacguccaacuauugaaaaagacguagaucucggugcagggacgaggcaugugaacgccgagcccgaaacaccgaacauggacguuaucggagagcggauccgccgaauuaaggaggaacacuccucuaccuggcauuacgaugacgagaauccuuauaagacuugggcuuaccacggcucauaugaagucaaagcgaccggcagcgccuccaguaugauaaacgggguggugaagcuucugacaaaaccaugggaugucguucccacggugacccaaauggcaaugacugacacaaccccuuucggacagcagagaguauuuaaggagaaaguggauacuaggacaccaaagcccaugccggguacccggaaggucauggaaaucacagcugagugguuauggcgcacucugggcagaaauaaaaggccucgauugugcacccgggaggaauucacgaagaaagugcguaccaacgccgcaaugggggccguuuuuacagaggaaaaucaaugggacucugcuagagccgcgguggaggaugaagaguucuggaagcucgucgaccgcgagagggaacugcacaaacuaggaaaguguggcagcugcguguacaacaugauggguaaacgggagaagaagcuuggggaauuuggaaaagcaaagggcucaagagccauuugguacauguggcugggcgcucgcuaucucgaguucgaggcccugggguuuuugaaugaagaucauugguucuccagggagaacaguuacagcggaguagaaggugagggccugcacaaacucggguauauccuucgagacauuucuaagauccccggaggcgcaauguacgcugacgauacugccgguugggacacccggauaacagaagaugaccugcauaaugaggagaaaaucacucagcagauggauccagaacacagacaguuagcuaacgccauuuuuaagcugaccuaucaaaauaagguugugaaaguccagaggccuacgcccaaggggacagugauggacaucauuucccgcaaagaucagcguggaucaggccaggugggcaccuacggguugaacacuuucacaaauauggaggcacaacucauccggcagauggaaggagaggguguccugagcaagaccgaccuagaaaacccacaucuucuggagaaaaagauaacucaguggcucgagaccaagggcguugaaagacugaaaaggauggcgauuucgggggaugacugcgugguaaagcccaucgaugaccgcuucgccaaugcuuuguuagcccugaacgauaugggaaaagugcgaaaggacaucccucaguggcaaccaucuaaaggcuggcacgacuggcagcaggucccguuuuguagucaccauuuccacgagcucauuaugaaggauggucggaagcuugugguucccugcagaccucaggacgaacugauagggagggcacgcaucucccaaggagcuggcuggagccuaaaagagacagccugucugggcaaggcauaugcccagaugugggcgcucauguacuuucauagacgggauuugaggcuggcuucaaacgccauuugcuccgcagugccaguccacugggugcccacgucucguaccacuuggagcauccacgcccaucaccaguggaugacaaccgaagacaugcuuacuguauggaaucgaguuuggauugaggauaacccuuggauggaggacaaaacaccagugaccacgugggaagauguccccuaccuggggaagcgcgaggaccaaugguguggaagucucaucgguuuaacauccagagcuaccugggcccagaauauacugacugcaauccagcaggugcggagcuugauuggcaacgaagaguuccuggauuauaugccuucuaugaaaagguuucgcaaggaggaagagucagaaggggcuaucugguga

SEQ ID NO: 15624 - RNA, 9873 nt, Artificial Sequence
  derived and/or modified CDS sequence (opt3) from DENV-3__KC762692__SS-prME
accagccugugccucaugaugaugcuucccgccacacuggcuuuccacuugacuuccagagacggagagccuagaaugaucguggggaagaacgaacggggaaaaucuuuacuguuuaagacggccucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcuaaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagucggugcaugggagaauggcguuugugggauccggucaaccacucgaauggaaaaccugcuuuggaaacagauugcuaaugaguugaacuacauccugugggaaaauaacauuaagcucaccguggugguaggagacaucauaggcguccuggagcaggggaaacgcacauuaacgccccagccaauggagcugaaguauaguuggaagaccuggggaaaagccaagauugugacugcggaaauccaaaauuccagcuuuauuaucgauggcccuaacacacccgagugcccaaacgccucuagagcuuggaauguuugggaaguggaggacuacgguuucggggucuuuaccacaaacauauggcuuaaauugagggaaauguauacucagcucugugaccaccggcugaugucagcagccgugaaggaugagcgcgcuguucacgccgacaugggauacuggaucgagagucagaaaaauggcagcuggaagcuagaaaaggcaucccugauugaggugaaaaccugcacguggcccaagucucauacacucuggucgaacgguguacuggaaagcgauaugaucauuccuaaaucccuugcgggcccaaucucacagcacaauuacagaccgggguaucauacccaaacugccggacccuggcacuugggcaagcuggaguuagacuucaacuacugcgaggggaccacagucgugauaacugaaaauuguggaaccaggggcccuagucuccguacaacgaccgugucugguaaacugauucacgaguggugcugucggagcugcacucuuccaccccugcgauauaugggggaagauggauguugguacggcauggagaucagaccuaucaacgaaaaggaggagaauauggucaaguccuugguuucagcugguagcggcaaaguggacaacuuuacaauggggguacucugccuggccauucuauucgaagaggugaugaggggaaaguucggcaaaaagcauaugaucgcagggguccuguuuauguucgugcuccugcuuucuggacagauuaccuggcgcgauauggcucggacuuugauaaugaucggcuccaaugccagugacagaauggguauggggguuacauaucuggcauuaauugccaccuuuaaaauccagccauuccucgcucugggauuuuuccuuaggaagcugacgagccgcgaaaaccuacuccugggcgugggcuuggcgauggccacuacccugcaauuacccgaggauauugaacagauggcaaaugggaucgcucucggacugaugguccuuaagcugauaacacaguuugagaccuaccaguuguggacugcccucgugucucugacauguuccaacaccaucuucacacuaacuguugccuggcgaaccgcuacgcugauucuugcagguacaucacuccugccggugugccaaaguagcucgaugcggaaaaccgacugguugccuaugacugucgccgcgaugggcguaccaccccugccuuuauuuaucuucucccucaaggauacccugaaacguagaucuuggccccuuaaugagggggugauggcuguuggacuggugagcauuuuggccucaagucuccugaggaacgacgucccaauggcaggcccucuaguggccggugggcugcuuaucgcuuguuauguaauaacaggaacuuccgcagaucucaccguggaaaaggccgcggacgucacgugggaggaagaggcugaacagacaggcguuucucacaaccugaugauuaccguggacgaugacggcacuaugcgcaucaaagaugacgagacagagaauaucuugaccguguuacugaagacugcccuccugauugucagcgggauauuucccuacuccaucccagcaacacuucugguguggcauaccuggcagaaacagacgcaacggucaggaguuuugugggauguaccgagcccucccgaaacucagaaggccgagcuagaagaggguguguacagaauuaagcagcagggcaucuucgggaaaacccaagucggagugggcguucagaaggaggguguguuucacacaauguggcaugucaccagaggggcugugcugacauauaacggaaaacgacucgaaccaaauugggccaguguaaagaaagaccugauuucuuacggcggcggguggcgccuuuccgcacaguggcaaaagggagaggaaguccaggugaucgcuguugagcccgguaagaacccuaaaaauuuccagacuaugccaggcauauuccagaccaucacgggggaaauuggagccaucgcguuagauuuuaagcccggcacaagcgguucgccuauuaucaaccgggaggggaaaguggucggacuguauggcaauggcgugguuacuaagaacgggggauacgugucagguauagcccaaaccaaugcagagccggacggcccaacacccgaacucgaggaagagauguucaaaaagagaaacuugaccauuauggaucugcacccugggucuggaaagacuaggaaauaucucccaaccaucguccgugaagcuaucaagcgccggcugagaacacuuauucuggcccccacgagggugguagcugcagagauggaggaagccuugaaaggccuaccuauccgauaccagacuaccgccacaaagagugagcacaccgguaaagaaauaguggaccugaugugccaugcuacuuuuacaaugcggcucuuauccccgguucgcguccccaauuauaaccugauuaucauggaugaggcgcacuucaccgacccagcaagcauugccgcuagaggguacaucucuacgagggugggaaugggcgaagccgcagccauauuuaugacugcuacaccucccggcaccgcggaugccuucccacagagcaaugcaccuauucaggacgaggagcgggacauccccgaacgauccuggaacucagggaaugauuggaucaccgacuuugcuggaaagacugugugguucgucccaaguauuaaggccgguaacgauaucgcaaacugucuuaggaagaauggcaagaaaguaauucaacugagccgcaagacauuugacaccgaguaccagaaaacaaagcucaacgauugggacuucgugguuacuacggauauaucugaaaugggggccaauuuuaaggcugacagggugaucgauccgcgucggugcuugaaaccugucauucugaccgacggacccgagagagugauccucgccggcccaaugcccguuacaguggcguccgcagcccagaggcgcggucgagucgggagaaacccucagaaggagaaugaucaauauaucuucacuggccagccacugaacaaugacgaagaccaugcucacuggaccgaggccaaaaugcuucuagauaacauuaauacacccgaaggaauaaucccugcucuguucgagccggaacgggagaagucagcagccauugacggcgaguacagguugaaaggggaaagucgcaagaccuuuguggaguuaaugcguagaggagaucugccaguauggcucgcucauaaaguggccagcgaagguaucaaguauacugaccggaaguggugcuucgauggcgagaggaacaaucagauucuggaagagaacauggacguugagaucuggacgaaagaaggggagaagaagaaacuucgcccccgauggcuggaugcaagaaccuacuccgacccucucgcguugaaagaauuuaaagauuucgccgcuggacggaagucuauagcccuggaccuagucacagagaucggcagggugcccucgcaccuggcacaccgcacuagaaaugcucucgauaaccuugugaugcugcauaccagcgaacacggugggagggccuaucggcaugcagucgaggaguuaccagaaacaauggagaccuugcugcuccugggccuuaugauucugcucacuggaggcgccauguuguuucugaucucagggaaaggaguugguaagacauccauuggcuuaaucugugugguagcuaguucugggaugcuauggauggcggacauaccucugcaguggauugccagcgcaaucgugcucgaguucuuuaugaugguccuucugauucccgagccagagaaacaacguacgccucaggauaaucaguuggcuuacgugguuaucggaauacugacccucgccgccaucguggcagcuaacgaaaugggccugcuugagacuacaaagcgcgaccucgguauguccaaagaaccgggggucguaucacccaccucuuaucuggacguggauuugcacccagccagcgcguggacccuguacgcuguugccacaacugugauuacgccuauguuacgacacaccaucgagaauaguacagcaaacgucucccuagccgcuauugcaaaccaagccgugguccugaugggccucgacaagggauggcccaucagcaagauggaucuuggcgugccacuguuggcgcuggggugcuacucucagguuaauccucucacucugaccgcugccgugcuuuuacugguaacacauuaugcaauaauuggacccggccuccaggccaaagcuaccagagaagcccagaagaggacugcagcugguaucaugaaaaacccgacgguggacgggaucaugacaauugauuuggacccagucaucuacgauucaaaguucgagaaacaacugggacagguuaugcuacuggugcucugugccguccagcuucuguugaugcggaccuccugggcguuuugcgaggcccugacucucgcaaccggcccuauaacaacucugugggaagguagucccggcaaguucuggaauaccacaauugcugugagcauggccaacaucuuucgcgggucguauuuagcaggagcuggccuugccuucucuauuaugaaguccguagggacgggaaaaagaggcaccgguagccagggggagacucugggagaaaaguggaaaaagaaacucaaucaacuaucaaggaaggaguuugaccuguacaaaaagaguggcaucacagaaguggaucggaccgaggccaaggaggguuugaaacgaggcgaaauaacucaccaugcgguuucuagaggguccgcuaagcugcagugguucguggagcgcaacauggucaucccagaaggaagggugauugaccucggcugugggcggggaggcuggagcuauuacugcgcaggucuuaaaaaggucacagaggugcguggguauaccaaaggaggccccggccacgaagaaccuguuccgaugucaacguacggguggaauaucguaaagcugaugaguggaaaggauguguucuacuugcccccagagaaaugugacacccugcucugcgauauuggugaaagcuccccuucucccacagucgaggaaagcagaacuaucaggguguuaaagaugguugagccuuggcugaaaaacaaucaguuuuguauuaaggugcuuaacccauauaugcccaccgucaucgagcaucuggaacgccuacagcggaaacacggcgggaugcucgugcgaaauccucuguccagaaacucaacacacgagauguacuggauaucuaauggaacuggcaacauuguaaguucggugaauaugguuagcagguugcugcucaaccgcuucaccaugacauaucggagaccaaccaucgaaaaggacgucgaccuuggugccgggacucgucaugugaacgcugagcccgaaacgccgaauauggaugugaucggagagaggauucggcgcauaaaggaggaacacuccucuacauggcauuacgacgaugagaacccuuauaaaaccugggccuaccacggcucauaugaagucaaggcaacuggcagcgccuccaguaugaucaaugggguugugaaacuguuaaccaagccaugggacguagugcccacagucacgcaaauggcuaugaccgauacuacaccuuuuggacagcagcgaguguucaaagagaagguugacaccagaacuccaaagcccaugccggguacaaggaaaauuauggaaaucaccgcgggcuggcuguggcggacauuggggcgcaacaagagaccuaggcucugcacucgagaggaguuuaccaaaaaggugcggacgaaugccgcaaugggagcugucuucaccgaagagaaccaaugggauucugcccgugcagccguggaagacgaggaauuuuggaaacugguagauagagagcgcgagcuacacaagcagggcaaaugugguagcugcguuuacaauaugauggggaagagggaaaagaaacuuggagaguucggcaaggcuaaaggcucacgggccauuugguacauguggcugggggcgagauaucucgaauuugaggcacugggauucuugaacgaggaccauugguuuucccgcgaaaauaguuacagcgguguggagggcgaagggcugcacaagcucggauauauccuuagggauauaucuaaaauccccggcggugccauguacgcugacgacacagccgggugggauacucgaauuaccgaggacgaucugcauaacgaagagaagaucacacagcagauggacccagagcaccggcaauuagcaaaugcuauuuucaagcugacuuaucagaacaaagucgugaaggugcagagaccuacccccaaaggaacggucauggauaucauauccaggaaggaccagcgcggcucaggccaaguugggacauacggauugaauaccuuuacuaacauggaagcccagcucauucgucagauggagggugaaggcgugcugagcaaaacagaucuagagaauccacaucuucuggaaaagaagaucacccaguggcucgagacuaaagggguagagcggcugaagagaauggcuaucucgggagacgauugcguggucaaacccauugacgauagguucgccaacgcauuguuagcgcugaacgacaugggcaaggugcgcaaagauauaccucaauggcagccaucuaaggguuggcacgacuggcagcagguuccguucuguagucaccauuuucacgaacucaucaugaaggacgggcgaaaucuugugguccccugccggccucaagaugagcugauuggcagagccaggaucucccagggcgcuggcuggagccuaaaagaaaccgccugucuggggaaggcauaugcucagaugugggcccucauguacuuccaucgcagagacuugcggcuggcaucaaacgccauuugcuccgcggugccaguacacuggguucccacaucuaggacgaccuggagcauccacgcucaucaccaauggaugacuacagagaauaugcuuaccguguggaaccgugucuggauagaagauaauccuuggauggaggacaaaacuccagugacaaccugggaggauguucccuaccugggaaagcgagaagaccaguggugugguagucucaucggcuuaacgucccgcgccacaugggcacagaacauucugaccgccauccagcaagugaggagcuugauugggaaugaggaauuucuggauuauaugccuucuaugaaacgguucaggaaggaggaggaaucagagggagcuaucugguga

SEQ ID NO: 15625 - RNA, 9873 nt, Artificial Sequence
  derived and/or modified CDS sequence (opt3) from DENV-3__JQ920481__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguugcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacagucguugugggagacgugaucggcguacuggagcaggggaaacgcacguuaacaccccagccaauggagcugaaguauaguuggaagacuuggggaaaagcgaagauagucacagccgaaacccaaaauuccagcuuuauuaucgauggcccuaacacacccgagugcccaucugcuucaagagcauggaacgugugggaaguugaggacuacgguuucgggguguuuacuaccaauauuuggcuuaaauugagggaaauguauacgcagcucugugaccaccggcugaugagugccgcugucaaggaugagcgcgccgugcacgcagacaugggauacuggaucgagagccagaaaaacggcuccuggaagcuagaaaaggcgucucugauagagguuaaaacaugcaccuggcccaagucgcauacucucuggagcaauggugugcuggaauccgauaugaucauuccuaaaucacuugccggcccaaucagucagcacaacuacagaccgggguaucauacccaaacagcuggacccuggcacuugggcaagcuggaguuagacuucaauuacugcgaggggacuaccguagucauuacagaaaacuguggaacgaggggcccuucucuccguaccacuacagugagcgguaaacugauccacgaguggugcugucgguccugcacccuuccaccccugcgauauaugggggaagauggauguugguacggcauggagauaagaccuauuaaugaaaaggaggagaacauggugaagucauuggucagcgccgguucuggcaaagcagacaauuuuacuauggggguucucugccuggcuauccuauucgaagaggugaugaggggaaaguucggcaaaaagcauaugaucgccggggcacuguuuacauucguacuccugcuuuccggacagauuaccuggcgcgauauggcccacacguugaucaugauuggcaguaacgcuagcgaccggauggguaugggggugacuuaucuggcguuaauagccaccuuuaaaauccagccauuccucgcacugggauuuuuccuuagaaagcugacaucuagggaaaaucuacuccugggcgucggcuuggcuauggccaccacucugcaauuacccgaggauauugaacagauggccaacgggaucgcucucggacugauggcacuuaagcugauuacacaguuugagaccuaccaguuguggacagcccucgugucccugauguguucaaauacuaucuucacccuaacgguugcguggcgcacagcuacccugauacuugccgugaucagucuccugccggucugccaaagcucguccaugcgaaaaacugacugguugccuaugaccguggcagccauggguguuccaccccugccuuuauuuauuuucucucucaaggauacacugaaacggcguagcuggccccuuaacgagggcgugauggcugucgggcugguaucaaucuuggcaaguuccuuucucagaaaugacgugccaauggccggaccucugguugcgggcggucuacugauugcuuguuaugugaucacugggaccucugccgaucuuacggucgaaaaggcagccgacgugacaugggaggaagaggcugaacagaccggaguaagccauaaccucaugauaacuguggacgaugacggcacaaugaggauuaaagaugacgagaccgagaacauccugacugucuuguuaaagacagcccugcucaucguuuccggcauuuuccccuacucaauaccagcaacccugcuuguguggcacacguggcagaaacagacucaacgcagcggggugcugugggaugucccgaguccucccgaaacccagaaggcugaguuggaagagggaguguaccggaucaagcagcaggguauuuuuggcaaaacacaaguugggguaggagugcagaaggagggcgucuuccauaccauguggcacgugacaagaggugccguucuaacucacaaugggaaaaggcuggaaccaaacugggcgaaugugaagaaagaccucaucucuuauggaggcggcuggaagcuguccgcccaguggcaaaagggggaggaaguccaggugauugcaguagagcccggcaagaacccuaagaauuuccagaccaugccagguaucuuucagacgacaacuggcgaaauaggggcuaucgcccuugauuucaaacccggaaccagcggcucgccuauuaucaaccgagaggguaaggucgugggguuauacggaaauggcguugugaccaagaacggcggguaugucucaggaauugcucaaaccaaugcagagccggacgguccaacucccgaacuggaggaagagauguuuaagaagcgcaaccucaccaucauggauuugcauccuggcucugggaaaacacggaaguaccugccagccauagugagagaagccauuaaaaggcgucuccgcacgcugauccuugcucccacucggguuguggcggcagagauggaggaagcccugaagggauugccuaucagauaucagaccacagcuaccaaaagugagcacacuggcagggaaauugucgaccuaaugugccaugccacauucaccaugcgacugcucuccccggugcggguacccaauuacaacuuaaucgugauggaugaggcacacuuuacggacccagccagcauagcugcgcgcgguuauauuucuacuagaguugggaugggagaagccgcagcuaucuucaugacagccaccccucccggcaccgcagaugccuuuccacagagcaaugcuccuauucaggacgaggagagggacauccccgaacgguccuggaacucaggcaaugaguggauaacugauuucgccgggaagacagucugguuugugccaaguauuaaggcgggaaacgacaucgcaaacugucugagaaagaaugguaagaaagugauccaacuuagcagaaagaccuucgauacagaauaccagaaaacuaagcugaacgacugggauuuugucguaacgaccgacauuucugagaugggcgccaauuucaaggcugaucgcgugaucgacccgaggcguugccucaaaccuguuauuuugacagaugggcccgagcgggugauacuggccggaccaaugcccgucacuguggcuuccgcagcccagagaaggggccgcguuggucgaaacccucagaaggaaaaugaccaauacaucuucaccgggcagccacucaacaaugaugaggaccaugcucacuggacagaagccaaaaugcugcuugacaacauuaauacccccgagggcaucaucccugcacuauuugaaccggagagagagaagucagcggccauugauggagaauaucggcugaaaggcgagaguaggaagacuuucguggaauugaugcgccguggggacuuaccagucuggcuggcucacaaaguggccagcgagggaauaaaguacacggauagaaaguggugcuuugacggugaacggaacaaucagauccucgaggagaacauggauguagaaauuuggaccaaagagggcgaaaagaaaaagcugaggccccgcuggcuugacgcacgaacauauuccgauccucuggcucucaaagaguucaaggacuuugccgcagggagaaagucuaucgccuuggaucuggugacugaaauuggacggguucccucgcaucuagcucacaggacccgcaaugcgcuggacaaccucgucaugcuucauacaagcgagcacggcgguagagccuacaggcacgcaguggaggaacugccagagaccauggaaacuuuauugcugcucgggcugaugauccuucugacaggcggagcuaugcuauucuugauaucaggcaaagggaucggaaagacguccauuggucugaucuguguggucgccaguucuggcauguuauggauggccgauguuccucuacaguggauugcaagcgcuaucgugcuggaguuuuucaugaugguacuccuuauacccgagccagaaaaacaacggaccccucaggacaaucagcuggccuauguggucauugggaucuugacucuggcggcuauuguggccgcaaacgagaugggacuccuggaaacaaccaagcgugaucuuggcauguccaaagagccggguguugugucacccaccucuuaccucgacgucgaccugcauccagccagcgcuuggacauuguaugcaguagccacuacggugaucaccccuaugcugcgccacacaauagaaaauaguacugcgaacguuuccuuagcugccaucgcaaaccaagccgugguccuaauggggcuggauaagggcuggcccauuagcaagauggaccucggagugccacuucuggcuuugggcugcuacucucaggucaauccucugacccucacagccgcagugcugcuuuuaguuacccauuacgcuaucauugggcccggacugcaggccaaagcgacucgagaggcccagaagagaacggcagcuggcaucaugaaaaacccgacaguggaugguauaaugaccauugaccucgauccaguaaucuaugacucaaaguuugagaaacaauugggacaggugaugcugcuaguccugugugccguucagcuccuucugaugaggacuuccugggcauucugcgaagcucuaacccuggccacaggaccuaucacuacccucugggagggcagucccgguaaguuuuggaauacaacgauugccgugagcauggcgaacaucuuccggggcucguaccuggcuggggcaggauuagccuuuucuauaaugaaguccgucggcaccgggaaacgcggaacuggcagccagggugaaacacuuggggagaaguggaaaaagaaacugaaucaacucucaagaaaggaguucgaucuauauaaaaagaguggaauuaccgagguggacaggacugaggcuaaggaaggccugaaacggggugagaucacacaccaugccguaucucgaggcuccgcaaaguugcagugguucguggaaagaaacaugguuauuccagaggggcgcgugaucgaucugggauguggcagaggcggguggagcuacuauugcgccgggcucaaaaaggucaccgaagugcgggguuacacgaaagggggacccggccacgaggagccugucccgaugucaaccuauggcuggaauauagugaaacuuaugagugggaaggacguauuuuaccugcccccagaaaaaugugauacauugcugugcgacaucggagagagcuccccuucucccacuguagaagagagccguaccauuagagugcucaagauggucgagccuugguugaaaaacaaucaguucuguaucaaggugcugaacccauacaugcccacaguuauugaacaccuugagaggcugcagcgcaaacaugguggcaugcuagugcggaauccucucucccgaaacucaacucacgaaauguauuggaucucuaaugggaccggaaacauugucaguucggugaauaugguaagcagacuguugcugaacagguuuacaaugacccaucgccggccaacuaucgagaaggauguggaccucggcgcugguacgagacacguuaacgcggaacccgagacaccgaauauggacgucauaggggagcguauuaggcggaucaaggaagaacacuccucuaccuggcauuacgaugacgaaaacccuuauaaaacuugggccuaccacggaucauaugaggugaaggcaaccggcagcgcuuccaguaugaucaauggcguggucaaacuucugacaaagccaugggauguugugcccaugguaacgcaaauggccaugaccgacacuacaccuuucgggcagcagcgcguguuuaaagaaaaggucgauacccgaacuccaagacccaugccgggaacaaggaaggugauggagauuaccgcagagugguuauggcggacacugggucgcaacaaaagaccuagguugugcacucgagaagaguucauaaagaaaguucggaccaaugccgcuaugggcgccguguuuacggaagagaaccaaugggacucugcgcgugcagccgucgaagaugaggaguucuggaagcucguggacagagaacgcgagcugcauaaacuagggaaguguggaagcugcguauacaauaugaugggcaaaagggaaaagaaacuuggugaguuugggaaagcuaagggaucacgggccaucugguauauguggcugggcgcaagauaccucgaguucgaagcucugggcuuuuugaacgaggaucacugguucucccgcgaaaauaguuacagcgggguugagggagaaggucugcauaaacucggcuauauucuuagggacaucucuaagauucccgggggagccauguacgcugaugacaccgccggcugggacacacgaaucacugaggaugaccugcacaacgaggagaaaauaacccagcagauggauccagagcaccggcaguuagcaaaugcgaucuuuaagcugacauaucaaaacaagguggucaaagugcagagaccuacucccaaggguaccgugauggacauuaucuccaggaaagaucagcgcgggucaggacaggucggcacguacggcuugaauacauucaccaacauggaagcccaacucauucgucagauggagggggaaggaguucugagcaaggcugaccuagagaauccacaucuucuggagaaaaaggugacucaguggcucgaaacaaaggguguagagcggcugaaaagaauggccaucucgggcgaugacugcguggucaagcccauagaugacagguucgcaaacgcuuuguuagcccugaacgauauggggaaagugcgcaaggacauuccucaguggcaaccaucuaaaggauggcacgauuggcagcagguuccguuuuguagucaucacuuccacgaacucaucaugaaggacggccgaaaacuugugguccccugccggccucaggacgagcugaucgguagagcaaggauuucccaaggggccggauggagccuacgcgaaaccgcgugucugggcaaggcuuaugcccagaugugggcacucauguacuuucauagacgggauuugaggcuggccucaaaugcuauaugcuccgccgugccaguacacuggguucccacuucucguaccacauggagcauccaugcacaccaucaguggaugacgaccgaggacaugcuuacuguguggaaccgagucuggauugaggauaauccuuggauggaagacaagacaccagugaccacuugggaggauguucccuaucugggcaaacgcgaagaccaauggugugggagucucaucggauuaacauccagagcuaccugggcccagaacauucugacggcgauccaacaggugcggagcuugauagguaaugaggaguuccuggauuacaugccuucuaugaagagguuucgcaaagaagaggaaucagagggcgcuaucugguga

SEQ ID NO: 15626 - RNA, 9873 nt, Artificial Sequence
  derived and/or modified CDS sequence (opt3) from DENV-3__JQ920483__SS-prME
accagccugugccucaugaugaugcuucccgccacccuggcuuuccacuugacuuccagagacggcgaaccuaggaugaucguggggaagaaugaacggggaaagucuuuacuguuuaagacggcaucagguauuaauauguguacccucauagccauggaucucggcgagaugugcgacgauacaguaacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccaggacgcagacuuggauguccgcagagggggccuggaggcaggucgaaaagguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacagaaucagaacuauguuuguaaacacaccuacguggaccgcgguugggggaauggaugcggccucuuuggcaaggggagucugguaacaugcgcuaaguuccaauguuuagaguccaucgagggaaaagccgugcagcacgaaaaccugaaguauacugucauaauuaccgugcauacaggugaucagcaccagguuggcaaugagacccaaggggugacugcagaaaucacgccccaggcuucuacagucgaggccauucucccugaauacggaacccuuggccuggagugcagcccacgaacugguuuggacuuuaacgagaugauccuacugaccaugaaaaauaaggcguggauggugcauagacagugguucuuugaccucccgcugcccuggacauccggggccaccacugaaacaccuacguggaacaaaaaggagcuucugguaaccuucaaaaaugcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggauaaacuggagcuaaagggcaugucuuaugccaugugccucaacgcuuucgugcugaaaaaggaggucuccgaaacccagcacgggacgauacuuaucaagguggaguacaaaggagaagacgcgccauguaagauucccuucucaaccgaggauggccaagguaaagcacauaacgggcgguugaucacagccaauccuauaguuacuaagaaagaggaaccagugaacauugaggcugaacccccguuuggcgagagcaauaucguaaucggaauuggcgacaaggcccugaagaucaacugguacaaaaaggggaguucuauuggaaaaauguucgaagcaaccgcccguggugcucgcagaauggccauacucggcgauacagcaugggacuuuggguccgucggaggcgugcugaauagccuugguaagaugguucaccagaucuucgggucggcguauacugcucuguuuucuggcguguccuggauuaugaaaaucggaaucggcgucuugcucaccuggauugggcugaacucaaagaauacgaguaugagcuucuccugcauagugaucggaauuaucacauuauaccugggcgccguagugcaggcagauauggguuguguuauuaacuggaaggggaaagagcuaaagugcggaucuggcaucuuugucaccaaugaggugcauacuuggacagaacaguauaaauuccaagccgacagcccuaagaggcucgcuaccgccauagccggugcuugggagaacggcgugugugggauccggucaacuacccgaauggaaaaucugcuuuggaaacagauugccaacgaguugaauuacauccugugggaaaacaauauuaagcucacaaucgucguuggagaugugauaggcgugcuggagcaggggaaacgcacguuaacaccccagccaauggagcugaaguauaguuggaagacuuggggaaaagcgaagauuguaacagccgaaacccaaaacuccagcuuuaucauugacggcccuaacacacccgagugcccaucugcuucaagagcauggaaugucugggaaguggaggauuacgguuucgggguuuuuacuaccaacaucuggcuuaaauugagggaaaaguauacgcagcucugugaccaccggcugaugagugccgcugugaaagacgagcgcgccguccacgcagauaugggauacuggauagagagccagaagaauggcuccuggaagcuagaaaaagcgucucugaucgaggugaagacaugcaccuggcccaaaucgcauacucucuggagcaacgguguucuggaauccgacaugauuaucccuaagucacuugccggcccaauuagucagcacaauuacagaccgggguaucauacccaaacagcuggacccuggcacuugggcaaacuggaguuagauuucaacuacugcgaggggacuaccgugguaaucacagaaaauuguggaauaaggggcccuucucuccguacgaccacugucagcgguaagcugauucacgaguggugcugucgguccugcacacuuccaccccugcgauauaugggggaagacggauguugguacggcauggagaucagaccuaucaacgaaaaggaggagaauauggugaaaucauuggugagcgccgguucuggcaagaccgauaacuuuacuauggggguccucugccuggcaauucuauucgaagagguuaugaggggaaaauucggcaagaaacauaugaucgcuggggcccuguuuacauucgugcuccugcuuuccggacagauuaccuggcgcgacauggcacacacguugauaaugaucggcaguaaugccagcgaucggauggguauggggguaacuuaucuggcuuuaauugcgaccuuuaagauccagccauuccucgcccugggauuuuuccuuagaaagcugacaucuagggaaaaccuacuccugggcgugggcuuggcaauggcuaccacucugcaauuacccgaggacauugaacagauggccaaugggaucgcccucggacugauggcucuuaaacugauaacacaguuugagaccuaccaguuguggacagcacucaucucccugauguguucaaacacuauuuucacccuaacggucgccuggcgcacagcgacccugauccuugcugugauuagucuccugccgguuugccaaagcucguccaugcgaaagacugauugguugccuaugaccguggccgcaaugggugucccaccccugccuuuauuuaucuucucucucaaagacacacugaagcggcguagcuggccccuuaaugagggcgugauggccguugggcuggugucaauauuggcuaguuccuuucucagaaacgaugucccaauggcaggaccucugguagccggcggucuacugauugcguguuaugugaucacugggaccucugcugaccuuacgguugaaaaagccgcagaugugacaugggaggaagaggccgaacagaccggagucagccauaaccucaugaucacuguggacgacgauggcacaaugaggauuaaggacgaugagaccgagaauauacugacuguauuguuaaaaacagcucugcucaucguguccggcauuuuccccuacucaaucccagccacccugcuugucuggcacacguggcagaagcagacucaacgcagcgggguucugugggacgugccgaguccucccgaaacccagaaggcagaguuggaagagggaguguaccggauuaaacagcaggguaucuuuggcaagacacaagucggggugggaguucagaaagagggcguauuccauaccauguggcacgugacaagaggugcuguccuaacucacaacgggaagaggcuggaaccaaauugggccaacgugaaaaaggaucucauaucuuauggaggcggcuggaagcuguccgcgcaguggcaaaaaggggaggaaguucaggugaucgccgucgagcccggaaagaauccuaaaaacuuccagaccaugccagguauuuuucagacgacaacuggcgaaaucggggcaauugcucuugacuucaagcccggaaccagcggcucgccuaucauaaaucgagaggguaaagugguaggguuauacggaaacggcgucgugacaaagaauggcggguauguuucaggaauugcccaaaccaacgcugagccggaugguccaacucccgaacuggaggaagagauguuuaagaaacgcaaucucaccaucauggacuugcauccuggcucugggaagacacggaaauaccugccagcaaucgugagagaagccauuaagaggcgucuccgcacgcugauccuugcccccacucgggucguggcugcggagauggaggaagcacugaaaggauugccuauaagauaucagaccacagccaccaagagugagcacacuggcagggaaauuguugaucuaaugugccaugcuacauucaccaugcgacugcucuccccggugcggguccccaacuacaauuuaaucgugauggacgaggcccacuuuacggauccagcaagcauugccgcucgcgguuauaucucuacuagaguagggaugggagaagcggccgcaauauucaugacagcuaccccucccggcaccgccgacgcauuuccacagagcaacgccccuauucaggaugaggagagggacauccccgaacgguccuggaacucaggcaacgaguggaucacugacuucgcugggaagacagugugguuuguuccaaguauuaaagccggaaacgauaucgcgaauugucugcgaaagaacgguaaaaaggucauucaacuuagcagaaaaaccuucgacacagaauaccagaagacuaagcugaaugauugggacuuuguggugacgaccgauauaucugagaugggcgcaaacuucaaagccgaccgcgucaucgauccgaggcguugccucaagccuguaauuuugacagacgggcccgagcgggugauccuggcuggaccaaugcccguuacuguggccuccgcugcacagagaaggggccgcgucggucgaaauucacagaaagaaaacgaucaauacaucuucaccgggcagccucucaauaacgacgaggaucaugcccacuggacagaagcuaagaugcugcuugacaauauuaacaccccagagggcauaauccccgcccuauuugaaccugagagagagaaaagugcagcgauugacggagaauaucggcugaagggcgagagcaggaaaacuuucguggaauugaugcgccguggggauuuaccgguuuggcuggcccacaagguggcuuccgagggaaucaaguacacggacagaaaauggugcuuugauggugaacggaauaaccagauucucgaggagaauauggacgucgaaaucuggaccaaggagggcgagaagaagaaacugaggccacgcuggcuugaugcccgaacauauucugacccccuggcacucaaggaguucaaggauuuugcugccgggagaaaaucgauagcauuggaccuggugacugaaaucggacggguaccuagccaucuagcccacaggacccgcaacgcucuggauaaucucgugaugcuucauacaucagagcacggcgguagagcguacaggcacgccguugaggaacugcccgagaccauggaaacuuuauugcugcucgggcugaugauucuucugacaggcggagcaaugcuauucuugaucuccggcaaggggauuggaaaaacgaguaucggucugauaugugucguggcuucuagcggcauguuauggauggccgacgugccacuacaguggauugccuccgcaaucguccuggaguuuuucaugaugguucuccuuauuccugagcccgaaaagcaacggaccccacaggauaaccagcuggcuuaugugguaaucgggauauugacucuggccgcgaucguggcugccaaugagaugggacuccuggaaacaaccaaacgugaccuuggcaugucaaaggagccuggugucgugucuccgaccagcuaccucgauguugaccugcaucccgcaagugccuggacauuguaugcuguggcaacuacggucauuaccccaaugcugcgccacacaaucgaaaacuccacugccaacgucagcuuagcggcuauugccaaucaagcagugguucuaauggggcuggacaagggcuggccuaucucuaaaauggaucucggagugccccuucuggccuugggcugcuacucacaggucaacccacugacccucacagcugccgugcugcuuuuagucacccauuacgcaauaauugggccuggacugcaggcuaaggccacucgagaggcgcagaaaagaacggccgcaggcaucaugaagaaucccacaguggacgguaucaugaccauugaucucgacccgguuaucuaugauuccaaauuugagaagcaauugggacaggugaugcugcuaguacugugugcugugcagcuccuucugaugaggaccaguugggccuucugcgaagcauugacucuggcuacaggaccaauaacuacccucugggagggcagcccugguaaguuuuggaacacaacgauugccgucucgauggccaauaucuuccggggcucuuaccuggcgggggcuggauuagcauuuuccauuaugaaaagcguuggcaccgggaagcgcggaacuggcucacagggugaaacacuuggggagaaauggaagaaaaagcugaaccaacucaguagaaaagaguucgaccuauauaagaagucuggaaucaccgagguggauaggacugaggccaaagaaggccugaagcggggugagauaacacaccaugcugucucccgaggcagcgccaaauugcagugguucguggaaagaaauaugguaauccccgaggggcgcgugauugaccugggauguggcagaggcggguggucauacuauugcgcagggcucaagaaaguuaccgaagugcgggguuacacgaaagggggaccaggccacgaggagcccgucccuaugaguaccuauggcuggaacaucgugaaacuuaugagcgggaaagaugucuuuuaccugccgcccgaaaagugugacacauugcugugcgauauuggagaguccucuccaagcccuacuguggaagagucccguaccaucagaguucucaaaaugguagagcccugguuaaagaauaaccaguucuguauuaaagugcugaauccuuacaugccaacagucaucgaacaccuugagaggcugcagcgcaagcaugguggcaugcuagugcggaacccccucucacgaaauucuacucacgaaauguauuggauaaguaacgggaccggaaauauuguuucgagcgugaacauggucuccagacuguugcugaacagguuuacaaugacccaucgccggccuacuaucgagaaggacguggaucucggcgccgguacgagacacguaaaugcugaaccagagacacccaacauggacgugaucggggagcguauuaggcggauaaaagaagaacacucuucaaccuggcauuacgacgaugaaaauccguauaagacuugggcguaccacggaagcuaugagguuaaagccaccggcuccgcaaguucuaugaucaacggcgucgugaaacuucugacaaaaccuugggacguggucccaaugguuacgcaaauggcuaugaccgauacuacacccuucgggcagcagcgcguguuuaaggaaaagguagacacccgaacuccuagaccaaugcccggaacaaggaaagugauggagauuaccgccgagugguuauggcggacacugggucgcaauaagagaccgagguugugcacucgagaagaguucaucaaaaagguccggaccaacgcagccaugggcgcuguguuuacggaagagaaucaaugggauagcgcccgugcggcaguugaagacgaggaguucuggaaacucguggauagagaacgcgagcugcauaagcuagggaaauguggaucaugcgucuacaacaugaugggcaagagggaaaagaaacuuggugaguuugggaaggccaaaggaucccgggcuauuugguauauguggcugggcgccagauaccucgaguucgaagcacugggcuuuuugaaugaggaccacugguucagucgcgaaaacagccauucugggguggagggagaaggucugcacaagcucggcuacauccuuagggauauauccaaaaucccugggggagcuauguaugccgacgauaccgcuggcugggacacacgaauuacugaggacgaucugcacaaugaggaaaagaucacccagcagauggaccccgagcaucggcaguuagccaacgcaauuuuuaagcugacauaccaaaauaaaguaguuaaggugcagagaccaacuccuaaagguaccgucauggauaucauaucaaggaaggaccagcgcgggagcggacaggugggcacguauggcuugaacacauucaccaauauggaagcgcaacucauucgucagauggagggggaaggagugcugucgaaagccgaucuagagaacccccaccuucuggagcggaaggucacucaguggcucgaaacaaaggguguugagagacugaaaaggauggcuaucucuggcgacgauugcgugguaaagccaaucgacgaucgcuucgccaacgcauuguuagcucugaaugacauggggaaagugcgaaaggauauuccccaguggcaaccuaguaaaggauggcaugacuggcagcaggucccauuuuguucccaccacuuccaugaacucauaaugaaggauggccggaaacuugugguuccgugcagaccccaggacgagcugaucgguagggcccgcauuagccaaggggcaggauggucacuaagagaaaccgccugucugggcaaagcguacgcucagaugugggcccucauguauuuucaccggagggacuugcgucuggcauccaacgccaucugcucugcugugccuguccauugggugccaacuagccgaaccacauggaguauucacgcccaucaccaguggaugacgaccgaggauaugcuuacuguauggaaucgcguuuggaucgaggacaaccccuggauggaagauaagacaccugugaccacuugggaggacgucccauaccugggcaaaagagaagaucaauggugugggucccucauaggauuaacaagccgggcaaccugggcucagaauauccugacggccauucaacaggugaggucuuugaucgguaacgaggaguuccuggacuauaugcccucaaugaagcgcuuuagaaaagaagaggaaagugagggcgcgauuugguga

SEQ ID NO: 15627 - RNA, 9873 nt, Artificial Sequence
  derived and/or modified CDS sequence (opt3) from DENV-3__JQ920482__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgagaugugcgacgauacaguaacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccaggacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaaaguauacgcagcucugugaccaccggcugaugagugccgcugugaaagaugagcgcgccguccacgcagacaugggauacuggauagagagccagaagaacggcuccuggaagcuagaaaaagcgucucugaucgaggugaagacaugcaccuggcccaaaucgcauacucucuggagcaaugguguucuggaauccgauaugauuaucccuaagucacuugccggcccaauuagucagcacaacuacagaccgggguaucauacccaaacagcuggacccuggcacuugggcaaacuggaguuagacuucaauuacugcgaggggacuaccgugguaaucacagaaaacuguggaauaaggggcccuucucuccguacgaccacugucagcgguaagcugauucacgaguggugcugucgguccugcacacuuccaccccugcgauauaugggggaagauggauguugguacggcauggagaucagaccuaucaaugaaaaggaggagaacauggugaaaucauuggugagcgccgguucuggcaagaccgacaauuuuacuauggggguccucugccuggcaauucuauucgaagagguuaugaggggaaaauucggcaagaaacauaugaucgcuggggcccuguuuacauucgugcuccugcuuuccggacagauuaccuggcgcgauauggcacacacguugauaaugaucggcaguaacgccagcgaccggauggguauggggguaacuuaucuggcuuuaauugcgaccuuuaagauccagccauuccucgcccugggauuuuuccuuagaaagcugacaucuagggaaaaucuacuccugggcgugggcuuggcaauggcuaccacucugcaauuacccgaggauauugaacagauggccaacgggaucgcccucggacugauggcucuuaaacugauaacacaguuugagaccuaccaguuguggacagcacucaucucccugauguguucaaauacuauuuucacccuaacggucgccuggcgcacagcgacccugauccuugcugugauuagucuccugccgguuugccaaagcucguccaugcgaaagacugacugguugccuaugaccguggccgcaaugggugucccaccccugccuuuauuuaucuucucucucaaagauacacugaagcggcguagcuggccccuuaacgagggcgugauggccguugggcuggugucaauauuggcuaguuccuuucucagaaaugacgucccaauggcaggaccucugguagccggcggucuacugauugcguguuaugugaucacugggaccucugcugaucuuacgguugaaaaagccgcagacgugacaugggaggaagaggccgaacagaccggagucagccauaaccucaugaucacuguggacgaugacggcacaaugaggauuaaggaugacgagaccgagaacauacugacuguauuguuaaaaacagcucugcucaucguguccggcauuuuccccuacucaaucccagccacccugcuugucuggcacacguggcagaagcagacucaacgcagcgggguucugugggaugugccgaguccucccgaaacccagaaggcagaguuggaagagggaguguaccggauuaaacagcaggguaucuuuggcaagacacaagucggggugggaguucagaaagagggcguauuccauaccauguggcacgugacaagaggugcuguccuaacucacaaugggaagaggcuggaaccaaacugggccaaugugaaaaaggaccucauaucuuauggaggcggcuggaagcuguccgcgcaguggcaaaaaggggaggaaguucaggugaucgccgucgagcccggaaagaacccuaaaaauuuccagaccaugccagguauuuuucagacgacaacuggcgaaaucggggcaauugcucuugauuucaagcccggaaccagcggcucgccuaucauaaaccgagaggguaaagugguaggguuauacggaaauggcgucgugacaaagaacggcggguauguuucaggaauugcccaaaccaaugcugagccggacgguccaacucccgaacuggaggaagagauguuuaagaaacgcaaccucaccaucauggauuugcauccuggcucugggaagacacggaaauaccugccagcaaucgugagagaagccauuaagaggcgucuccgcacgcugauccuugcccccacucgggucguggcugcggagauggaggaagcacugaaaggauugccuauaagauaucagaccacagccaccaagagugagcacacuggcagggaaauuguugaccuaaugugccaugcuacauucaccaugcgacugcucuccccggugcggguccccaauuacaacuuaaucgugauggaugaggcccacuuuacggacccagcaagcauugccgcucgcgguuauaucucuacuagaguagggaugggagaagcggccgcaauauucaugacagcuaccccucccggcaccgccgaugcauuuccacagagcaaugccccuauucaggacgaggagagggacauccccgaacgguccuggaacucaggcaaugaguggaucacugauuucgcugggaagacagugugguuuguuccaaguauuaaagccggaaacgacaucgcgaacugucugcgaaagaaugguaaaaaggucauucaacuuagcagaaaaaccuucgauacagaauaccagaagacuaagcugaacgacugggauuuuguggugacgaccgacauaucugagaugggcgcaaauuucaaagccgaucgcgucaucgacccgaggcguugccucaagccuguaauuuugacagaugggcccgagcgggugauccuggcuggaccaaugcccguuacuguggccuccgcugcacagagaaggggccgcgucggucgaaacucacagaaagaaaaugaccaauacaucuucaccgggcagccucucaacaaugaugaggaccaugcccacuggacagaagcuaagaugcugcuugacaacauuaauaccccagagggcauaauccccgcccuauuugaaccugagagagagaaaagugcagcgauugauggagaauaucggcugaagggcgagagcaggaaaacuuucguggaauugaugcgccguggggacuuaccgguuuggcuggcccacaagguggcuuccgagggaaucaaguacacggauagaaaauggugcuuugacggugaacggaacaaucagauucucgaggagaacauggaugucgaaaucuggaccaaggagggcgagaagaagaaacugaggccacgcuggcuugacgcccgaacauauucugauccccuggcacucaaggaguucaaggacuuugcugccgggagaaaaucgauagcauuggaucuggugacugaaaucggacggguaccuagccaucuagcccacaggacccgcaaugcucuggacaaccucgugaugcuucauacaucagagcacggcgguagagcguacaggcacgccguugaggaacugcccgagaccauggaaacuuuauugcugcucgggcugaugauucuucugacaggcggagcaaugcuauucuugaucuccggcaaggggauuggaaaaacgaguaucggucugauaugugucguggcuucuagcggcauguuauggauggccgaugugccacuacaguggauugccuccgcaaucguccuggaguuuuucaugaugguucuccuuauuccugagcccgaaaagcaacggaccccacaggacaaucagcuggcuuaugugguaaucgggauauugacucuggccgcgaucguggcugccaacgagaugggacuccuggaaacaaccaaacgugaucuuggcaugucaaaggagccuggugucgugucuccgaccagcuaccucgacguugaccugcaucccgcaagugccuggacauuguaugcuguggcaacuacggucauuaccccaaugcugcgccacacaaucgaaaauuccacugccaacgucagcuuagcggcuauugccaaccaagcagugguucuaauggggcuggauaagggcuggccuaucucuaaaauggaccucggagugccccuucuggccuugggcugcuacucacaggucaauccacugacccucacagcugccgugcugcuuuuagucacccauuacgcaauaauugggccuggacugcaggcuaaggccacucgagaggcgcagaaaagaacggccgcaggcaucaugaagaaccccacaguggaugguaucaugaccauugaccucgauccgguuaucuaugacuccaaauuugagaagcaauugggacaggugaugcugcuaguacugugugcugugcagcuccuucugaugaggaccaguugggccuucugcgaagcauugacucuggcuacaggaccaauaacuacccucugggagggcagcccugguaaguuuuggaauacaacgauugccgucucgauggccaacaucuuccggggcucuuaccuggcgggggcuggauuagcauuuuccauuaugaaaagcguuggcaccgggaagcgcggaacuggcucacagggugaaacacuuggggagaaauggaagaaaaagcugaaucaacucaguagaaaagaguucgaucuauauaagaagucuggaaucaccgagguggacaggacugaggccaaagaaggccugaagcggggugagauaacacaccaugcugucucccgaggcagcgccaaauugcagugguucguggaaagaaacaugguaauccccgaggggcgcgugauugaucugggauguggcagaggcggguggucauacuauugcgcagggcucaagaaaguuaccgaagugcgggguuacacgaaagggggaccaggccacgaggagcccgucccuaugaguaccuauggcuggaauaucgugaaacuuaugagcgggaaagacgucuuuuaccugccgcccgaaaagugugauacauugcugugcgacauuggagaguccucuccaagcccuacuguggaagagucccguaccaucagaguucucaaaaugguagagcccugguuaaagaacaaucaguucuguauuaaagugcugaacccuuacaugccaacagucaucgaacaccuugagaggcugcagcgcaagcaugguggcaugcuagugcggaauccccucucacgaaacucuacucacgaaauguauuggauaaguaaugggaccggaaacauuguuucgagcgugaauauggucuccagacuguugcugaacagguuuacaaugacccaucgccggccuacuaucgagaaggauguggaccucggcgccgguacgagacacguaaacgcugaaccagagacacccaauauggacgugaucggggagcguauuaggcggauaaaagaagaacacucuucaaccuggcauuacgaugacgaaaacccguauaagacuugggcguaccacggaagcuaugagguuaaagccaccggcuccgcaaguucuaugaucaauggcgucgugaaacuucugacaaaaccuugggauguggucccaaugguuacgcaaauggcuaugaccgacacuacacccuucgggcagcagcgcguguuuaaggaaaagguagauacccgaacuccuagaccaaugcccggaacaaggaaagugauggagauuaccgccgagugguuauggcggacacugggucgcaacaagagaccgagguugugcacucgagaagaguucaucaaaaagguccggaccaaugcagccaugggcgcuguguuuacggaagagaaccaaugggacagcgcccgugcggcaguugaagaugaggaguucuggaaacucguggacagagaacgcgagcugcauaagcuagggaaauguggaucaugcgucuacaauaugaugggcaagagggaaaagaaacuuggugaguuugggaaggccaaaggaucccgggcuauuugguauauguggcugggcgccagauaccucgaguucgaagcacugggcuuuuugaacgaggaucacugguucagucgcgaaaauagccauucugggguggagggagaaggucugcacaagcucggcuacauccuuagggacauauccaaaaucccugggggagcuauguaugccgaugacaccgcuggcugggacacacgaauuacugaggaugaccugcacaacgaggaaaagaucacccagcagauggaucccgagcaucggcaguuagccaaugcaauuuuuaagcugacauaccaaaacaaaguaguuaaggugcagagaccaacuccuaaagguaccgucauggacaucauaucaaggaaggaucagcgcgggagcggacaggugggcacguauggcuugaauacauucaccaacauggaagcgcaacucauucgucagauggagggggaaggagugcugucgaaagccgaccuagagaauccccaccuucuggagaagaaggucacucaguggcucgaaacaaaagguguugagcggcugaagagaauggcuaucucuggcgaugacugcgugguaaaaccaaucgaugacagguucgccaacgcauuguuagcucugaacgauauggggaaggugcgcaaagacauuccccaguggcaaccuaguaagggauggcaugauuggcagcaggucccauuuuguucccaccacuuccaugaacucauaaugaaggacggccgaaaacuugugguuccgugccggccccaggacgagcugaucgguagagccaggauuagccaaggggcaggauggucacuacgcgaaaccgccugucugggcaaggcguacgcucagaugugggcccucauguauuuucacagacgggauuugaggcuggcauccaaugccaucugcucugcugugccuguccauugggugccaacuagccguaccacauggaguauucacgcccaucaccaguggaugacgaccgaggacaugcuuacuguauggaaccgaguuuggaucgaggauaaucccuggauggaagacaaaacaccugugaccacuugggaggaugucccauaccugggcaagcgcgaagaccaauggugugggucccucauaggauuaacaagcagagcaaccugggcucagaacauccugacggccauucaacaggugcggucuuugaucgguaaugaggaguuccuggauuauaugcccucaaugaaaagguuucgcaaggaagaggaaagugagggcgcgauuugguga

SEQ ID NO: 15628 - RNA, 9873 nt, Artificial Sequence
  derived and/or modified CDS sequence (opt3) from DENV-3__JQ920484__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccaggacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgcgauaggcgugcuggagcaggggaaacgcacguuaacaccccagccaauggagcugaaguauaguuggaagacuuggggaaaagccaagauugugacagcugaaacccaaaauuccagcuuuaucauugauggcccuaacacacccgagugcccaucugcaucaagagccuggaacguaugggaagucgaggacuacgguuucgggguguuuacuaccaauaucuggcuuaaauugagggaaaaguauacgcagcucugugaccaccggcugaugagugcugccguuaaagaugagcgcgcagugcacgcggacaugggauacuggauagagagccagaagaacggcuccuggaagcuagaaaaagccucucugaucgaggucaagacaugcaccuggcccaaaucgcauacucucuggagcaauggugugcuggaauccgauaugauuaucccuaagucacuugcuggcccaauuagucagcacaacuacagaccgggguaucauacccaaacagccggacccuggcacuugggcaaacuggaguuagacuucaauuacugcgaggggacuaccguugugaucacagaaaacuguggaauaaggggcccuucucuccguacgaccacuguaagcgguaagcugauucacgaguggugcugucgguccugcacacuuccaccccugcgauauaugggggaagauggauguugguacggcauggagaucagaccuaucaaugaaaaggaggagaacauggucaaaucauuggugagcgcagguucuggcaagaccgacaauuuuacuaugggggugcucugccuggcuauucuauucgaagaggucaugaggggaaaauucggcaagaaacauaugaucgccggggcacuguuuacauucguucuccugcuuuccggacagauuaccuggcgcgauauggcccacacguugauaaugaucggcaguaacgcuagcgaccggauggguaugggggugacuuaucuggcguuaauugccaccuuuaagauccagccauuccucgcacugggauuuuuccuuagaaagcugacaucuagggaaaaucuacuccugggcguaggcuuggcuauggccaccacucugcaauuacccgaggauauugaacagauggccaacgggaucgcucucggacugauggcacuuaaacugauaacacaguuugagaccuaccaguuguggacagcccucaucucccugauguguucaaauacuauuuucacccuaacgguggcguggcgcacagcuacccugauccuugccgucauuagucuccugccggugugccaaagcucguccaugcgaaagacugacugguugccuaugaccguugcagccaugggugugccaccccugccuuuauuuaucuucucucucaaagauacacugaagcggcguagcuggccccuuaacgagggcgucauggcuguggggcugguuucaauauuggcaaguuccuuucucagaaaugacgugccaauggccggaccucuggucgcgggcggucuacugauugcuuguuauguaaucacugggaccucugccgaucuuacgguggaaaaagcagccgacguuacaugggaggaagaggcugaacagaccggagugagccauaaccucaugaucacugucgacgaugacggcacaaugaggauuaaggaugacgagaccgagaacauacugacuguguuguuaaaaacagcccugcucaucguauccggcauuuuccccuacucaaucccagcaacccugcuuguguggcacacguggcagaagcagacucaacgcagcgggguccugugggauguuccgaguccucccgaaacccagaaggcugaguuggaagagggaguguaccggauuaaacagcaggguaucuuuggcaagacacaagugggggucggagugcagaaagagggcguuuuccauaccauguggcacguaacaagaggugccgugcuaacuuauaaugggaagaggcuggaaccaaacugggcgaaugucaaaaaggaccucauaucuuacggaggcggcuggaagcuguccgcccaguggcaaaaaggggaggaagugcagguuaucgcaguggagcccggaaagaacccuaaaaauuuccagaccaugccagguauuuuucagacgacaacuggcgaaaucggggcuauugcccuugauuucaagcccggaaccagcggcucgccuaucauaaaccgagaggguaaagucgugggguuauauggaaauggcguagucacaaagaacggcggguacgugucaggaauugcucaaaccaaugcagagccggacgguccaacucccgaacuggaggaagagauguuuaagaaacgcaaccucaccaucauggauuugcacccuggcucugggaagacacggaaauaucugccagccaucguuagagaagccauuaagaggcgucuccgcacgcugauccuugcucccacucggguggucgcggcagagauggaggaagcccugaaaggauugccuauaagauaccagaccacagcuaccaagagugagcauacuggcagggaaauuguggaccuaaugugccacgccacauucaccaugcgacugcucuccccgguucgggugcccaauuauaacuuaaucgucauggaugaggcacauuuuacggacccagccagcauugcugcgcgcgguuacaucucuacuagaguggggaugggagaagccgcagcuauauucaugacagccaccccucccggcaccgcagaugccuuuccacagagcaaugcuccuauucaggacgaggagagggacauccccgaacgguccuggaacucaggcaaugaguggaucacugauuucgccgggaagacaguaugguuugugccaaguauuaaagcgggaaacgacaucgcaaacugucugcgaaagaaugguaaaaagguuauucaacuuagcagaaaaaccuucgauacagaauaccagaagacuaagcugaacgacugggauuuugucgugacgaccgacauaucugagaugggcgccaauuucaaagcugaucgcgugaucgacccgaggcguugccucaagccugucauuuugacagaugggcccgagcggguaauccuggccggaccaaugcccgugacuguugcuuccgcagcccagagaaggggccgcgugggucgaaacucacagaaagaaaaugaccaauauaucuucaccgggcagccucucaacaaugaugaggaccacgcucauuggacagaagccaagaugcugcuugacaacauuaauaccccagagggcauaauccccgcacuauuugaaccugagagagagaaaagugcggccauugauggagaauaccggcugaagggcgagagcaggaaaacuuucgucgaauugaugcgccguggggacuuaccgguguggcuggcucacaagguugccuccgagggaaucaaguauacggauagaaaauggugcuuugacggugaacggaacaaucagauucucgaggagaacauggauguggaaaucuggaccaaggagggcgagaagaagaaacugaggccacgcuggcuugacgcacgaacauacucugauccccuggcucucaaggaguucaaggacuuugccgcagggagaaaaucgauagccuuggaucuggucacugaaaucggacgggugccuagccaccuagcucauaggacccgcaaugcgcuggacaaccucguaaugcuucacacaucagagcauggcgguagagccuauaggcacgcaguggaggaacugcccgagaccauggaaacuuuauugcugcucgggcugaugauucuucugacaggcggagcuaugcuauucuugaucuccggcaaggggauuggaaaaacgaguaucggucugauauguguugucgccucuagcggcauguuauggauggccgaugugccacuacaguggauugcauccgcuaucgugcuggaguuuuucaugaugguccuccuuauuccugagcccgaaaagcaacggaccccacaggacaaucagcuggccuacguugugaucgggauauugacucuggcggcuaucguagccgcaaacgagaugggacuccuggaaacaaccaaacgugaucuuggcaugucaaaggagccugguguggucucuccgaccagcuaucucgacguggaccugcaccccgccagugcuuggacauuguacgcaguugccacuacggugauuaccccaaugcugcgccauacaaucgaaaauuccacugcgaacgucagcuuagcugccauugcaaaccaagccguagugcuaauggggcuggauaagggcuggccuaucucuaaaauggaccucggaguuccccuucuggcuuugggcugcuacucacaggugaauccacugacccucacagccgcaguccugcuuuuagugacccacuaugcuauaauugggccuggacugcaggccaaggcgacucgagaggcccagaaaagaacggcagcuggcaucaugaagaaccccacagucgaugguaucaugaccauugaccucgauccggugaucuacgacuccaaauuugagaagcaauuggggcagguuaugcugcuagugcugugugccguacagcuccuucugaugaggaccaguugggcauucugcgaggcuuugacucuggccacaggaccaauaacuacccucugggaaggcagcccugguaaguuuuggaauacaacgauugccgugucgauggcgaacaucuuccggggcucuuaucuggcuggggcaggauuagccuuuuccauuaugaaaagcgucggcaccgggaagcgcggaacuggcucacagggugaaacacuuggggagaaauggaagaaaaagcugaaucaacucaguagaaaagaguucgaucuauacaagaagucuggaaucaccgagguugacaggacugaggcuaaagaaggccugaagcggggugagauaacacaucacgccgugucccgaggcagcgcaaaauugcagugguucgucgaaagaaacauggugauccccgaggggcgcguaauugaucugggauguggcagagggggauggucauauuacugcgccggccucaagaaagugaccgaaguucgggguuauacgaaagggggaccaggccaugaggagcccgugccuaugaguaccuacggcuggaauaucgucaaacuuaugagcgggaaagacguguuuuaccugccgcccgaaaagugugauacauugcugugcgacauuggagaguccucuccaagcccuacugucgaagagucccguaccaucagagugcucaaaaugguugagcccugguuaaagaacaaucaguucuguauuaaaguacugaacccuuauaugccaacagugaucgaacaccuugagaggcugcagcgcaagcacgguggcaugcuaguccggaauccccucucacgaaacucuacucaugaaauguacuggauaaguaaugggaccggaaacauugugucgagcguuaauaugguguccagacuguugcugaacagguuuacaaugacccaccgccggccuacuaucgagaaggaugucgaccucggcgcugguacgagacaugugaacgcggaaccagagacacccaauauggacguaaucggggagcguauuaggcggauaaaagaagaacacucuucaaccuggcacuaugaugacgaaaacccguacaagacuugggccuaucauggaagcuacgaggugaaagcaaccggcuccgcuaguucuaugaucaauggcguugucaaacuucugacaaaaccuugggauguggugccaauggucacgcaaauggccaugaccgacacuacacccuucgggcagcagcgcguuuuuaaggaaaagguggauacccgaacuccuagaccaaugcccggaacaaggaaaguaauggagauuaccgcagagugguuauggcggacacugggucgcaacaagagaccgagguugugcacucgagaagaguucaucaaaaaggugcggaccaaugccgcuaugggcgccgucuuuacggaagagaaccaaugggacagcgcgcgugcagccguggaagaugaggaguucuggaaacucguugacagagaacgcgagcugcacaagcuagggaaauguggaucaugcguguauaauaugaugggcaagagggaaaagaaacuuggugaguuugggaaggcuaaaggaucccgggccauuugguacauguggcugggcgcaagauaccucgaguucgaagcucugggcuuuuugaacgaggaucauugguucagucgcgaaaauagccacucuggggucgagggagaaggucugcauaagcucggcuauauccuuagggacauauccaaaaucccugggggagccauguacgcugaugacaccgccggcugggacacacgaauuacugaggaugaccugcacaacgaggaaaagaucacccagcagauggaucccgagcaccggcaguuagcaaaugcgauuuuuaagcugacauaucaaaacaaagugguaaagguucagagaccaacuccuaaagguaccgugauggacaucauaucaaggaaggaucagcgcgggagcggacaggucggcacguacggcuugaauacauucaccaacauggaagcccaacucauucgucagauggagggggaaggagugcugucgaaagcugaccuagagaauccccaucuucuggagaagaaggugacucaguggcucgaaacaaaaggugucgagcggcugaagagaauggccaucucuggcgaugacugcguugugaaaccaaucgaugacagguucgcaaacgcuuuguuagcccugaacgauauggggaagguacgcaaagacauuccccaguggcaaccuaguaagggauggcacgauuggcaacaggugccauuuuguucccaucacuuccacgaacucauaaugaaggacggccgaaaacuugucgugccgugccggccccaggacgagcugaucgguagagcaaggauuagccaaggggccggauggucacuacgcgaaaccgcgugucugggcaaggcuuaugcccagaugugggcacucauguacuuucauagacgggauuugaggcuggccuccaaugcuaucugcucugccguuccugugcacugggucccaacuagccguaccacauggaguauucaugcacaccaucaguggaugacgaccgaggacaugcuuacuguguggaaccgaguauggaucgaggauaaucccuggauggaagacaaaacaccuguuaccacuugggaggaugugccauaucugggcaagcgcgaagaccaauggugugggucccucauaggauuaacaagcagagcuaccugggcccagaacauccugacggcgauucagcagguccggucuuugaucgguaaugaggaguuccuggauuacaugcccucaaugaaaagguuucgcaaggaagaggaaagugagggcgcuauuugguga

SEQ ID NO: 15629 - RNA, 9873 nt, Artificial Sequence
  derived and/or modified CDS sequence (opt3) from DENV-3__JQ920486__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgagaugugcgacgauacaguaacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccaggacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgcgauaggcgugcuggagcaggggaaacgcacguuaacaccccagccaauggagcugaaguauaguuggaagacuuggggaaaagccaagauugugacagcugaaacccaaaauuccagcuuuaucauugauggcccuaacacacccgagugcccaucugcaucaagagccuggaacguaugggaagucgaggacuacgguuucgggguguuuacuaccaauaucuggcuuaaauugagggaaaaguauacgcagcucugugaccaccggcugaugagugcugccguuaaagaugagcgcgcagugcacgucgacaugggauacuggauagagagccagaagaacggcuccuggaagcuagaaaaagcgucucugaucgaggugaagacaugcaccuggcccaaaucgcauacucucuggagcaaugguguucuggaauccgauaugauuaucccuaagucacuugccggcccaauuagucagcacaacuacagaccgggguaucauacccaaacagcuggacccuggcacuugggcaaacuggaguuagacuucaauuacugcgaggggacuaccgugguaaucacagaaaacuguggaauaaggggcccuucucuccguacgaccacugucagcgguaagcugauucacgaguggugcugucgguccugcacacuuccaccccugcgauauaugggggaagauggauguugguacggcauggagaucagaccuaucaaugaaaaggaggagaacauggugaaaucauuggugagcgccgguucuggcaagaccgacaauuuuacuauggggguccucugccuggcaauucuauucgaagagguuaugaggggaaaauucggcaagaaacauaugaucgcuggggcccuguuuacauucgugcuccugcuuuccggacagauuaccuggcgcgauauggcacacacguugauaaugaucggcaguaacgccagcgaccggauggguauggggguaacuuaucuggcuuuaauugcgaccuuuaagauccagccauuccucgcccugggauuuuuccuuagaaagcugacaucuagggaaaaucuacuccugggcgugggcuuggcaauggcuaccacucugcaauuacccgaggauauugaacagauggccaacgggaucgcccucggacugauggcucuuaaacugauaacacaguuugagaccuaccaguuguggacagcacucaucucccugauguguucaaauacuauuuucacccuaacggucgccuggcgcacagcgacccugauccuugcugugauuagucuccugccgguuugccaaagcucguccaugcgaaagacugacugguugccuaugaccguggccgcaaugggugucccaccccugccuuuauuuaucuucucucucaaagauacacugaagcggcguagcuggccccuuaacgagggcgugauggccguugggcuggugucaauauuggcuaguuccuuucucagaaaugacgucccaauggcaggaccucugguagccggcggucuacugauugcguguuaugugaucacugggaccucugcugaucuuacgguugaaaaagccgcagacgugacaugggaggaagaggccgaacagaccggagucagccauaaccucaugaucacuguggacgaugacggcacaaugaggauuaaggaugacgagaccgagaacauacugacuguauuguuaaaaacagcucugcucaucguguccggcauuuuccccuacucaaucccagccacccugcuugucuggcacacguggcagaagcagacucaacgcagcgggguucugugggaugugccgaguccucccgaaacccagaaggcagaguuggaagagggaguguaccggauuaaacagcaggguaucuuuggcaagacacaagucggggugggaguucagaaagagggcguauuccauaccauguggcacgugacaagaggugcuguccuaacucacaaugggaagaggcuggaaccaaacugggccaaugugaaaaaggaccucauaucuuauggaggcggcuggaagcuguccgcgcaguggcaaaaaggggaggaaguucaggugaucgccgucgagcccggaaagaacccuaaaaauuuccagaccaugccagguauuuuucagacgacaacuggcgaaaucggggcaauugcucuugauuucaagcccggaaccagcggcucgccuaucauaaaccgagaggguaaagugguaggguuauacggaaauggcgucgugacaaagaacggcggguauguuucaggaauugcccaaaccaaugcugagccggacgguccaacucccgaacuggaggaagagauguuuaagaaacgcaaccucaccaucauggauuugcauccuggcucugggaagacacggaaauaccugccagcaaucgugagagaagccauuaagaggcgucuccgcacgcugauccuugcccccacucgggucguggcugcggagauggaggaagcacugaaaggauugccuauaagauaucagaccacagccaccaagagugagcacacuggcagggaaauuguugaccuaaugugccaugcuacauucaccaugcgacugcucuccccggugcggguccccaauuacaacuuaaucgugauggaugaggcccacuuuacggacccagcaagcauugccgcucgcgguuauaucucuacuagaguagggaugggagaagcggccgcaauauucaugacagcuaccccucccggcaccgccgaugcauuuccacagagcaaugccccuauucaggacgaggagagggacauccccgaacgguccuggaacucaggcaaugaguggaucacugauuucgcugggaagacagugugguuuguuccaaguauuaaagccggaaacgacaucgcgaacugucugcgaaagaaugguaaaaaggucauucaacuuagcagaaaaaccuucgauacagaauaccagaagacuaagcugaacgacugggauuuuguggugacgaccgacauaucugagaugggcgcaaauuucaaagccgaucgcgucaucgacccgaggcguugccucaagccuguaauuuugacagaugggcccgagcgggugauccuggcuggaccaaugcccguuacuguggccuccgcugcacagagaaggggccgcgucggucgaaacucacagaaagaaaaugaccaauacaucuucaccgggcagccucucaacaaugaugaggaccaugcccacuggacagaagcuaagaugcugcuugacaacauuaauaccccagagggcauaauccccgcccuauuugaaccugagagagagaaaagugcagcgauugauggagaauaucggcugaagggcgagagcaggaaaacuuucguggaauugaugcgccguggggacuuaccgguuuggcuggcccacaagguggcuuccgagggaaucaaguacacggauagaaaauggugcuuugacggugaacggaacaaucagauucucgaggagaacauggaugucgaaaucuggaccaaggagggcgagaagaagaaacugaggccacgcuggcuugacgcccgaacauauucugauccccuggcacucaaggaguucaaggacuuugcugccgggagaaaaucgauagcauuggaucuggugacugaaaucggacggguaccuagccaucuagcccacaggacccgcaaugcucuggacaaccucgugaugcuucauacaucagagcacggcgguagagcguacaggcacgccguugaggaacugcccgagaccauggaaacuuuauugcugcucgggcugaugauucuucugacaggcggagcaaugcuauucuugaucuccggcaaggggauuggaaaaacgaguaucggucugauaugugucguggcuucuagcggcauguuauggauggccgaugugccacuacaguggauugccuccgcaaucguccuggaguuuuucaugaugguucuccuuauuccugagcccgaaaagcaacggaccccacaggacaaucagcuggcuuaugugguaaucgggauauugacucuggccgcgaucguggcugccaacgagaugggacuccuggaaacaaccaaacgugaucuuggcaugucaaaggagccuggugucgugucuccgaccagcuaccucgacguugaccugcaucccgcaagugccuggacauuguaugcuguggcaacuacggucauuaccccaaugcugcgccacacaaucgaaaauuccacugccaacgucagcuuagcggcuauugccaaccaagcagugguucuaauggggcuggauaagggcuggccuaucucuaaaauggaccucggagugccccuucuggccuugggcugcuacucacaggucaauccacugacccucacagcugccgugcugcuuuuagucacccauuacgcaauaauugggccuggacugcaggcuaaggccacucgagaggcgcagaaaagaacggccgcaggcaucaugaagaaccccacaguggaugguaucaugaccauugaccucgauccgguuaucuaugacuccaaauuugagaagcaauugggacaggugaugcugcuaguacugugugcugugcagcuccuucugaugaggaccaguugggccuucugcgaagcauugacucuggcuacaggaccaauaacuacccucugggagggcagcccugguaaguuuuggaauacaacgauugccgucucgauggccaacaucuuccggggcucuuaccuggcgggggcuggauuagcauuuuccauuaugaaaagcguuggcaccgggaagcgcggaacuggcucacagggugaaacacuuggggagaaauggaagaaaaagcugaaucaacucaguagaaaagaguucgaucuauauaagaagucuggaaucaccgagguggacaggauagaggccaaagaaggccugaagcggggugagaucacucaccaugcugucucccgaggcagcgccaaauugcagugguucguggaaagaaacaugguaauucccgaggggcgcgugaucgaucugggauguggcagaggcggguggucauacuauugcgcagggcucaagaaaguuacagaagugcgggguuacaccaaagggggaccaggccacgaggagcccgucccuaugaguacguauggcuggaauauugugaaacuuaugagcgggaaagacgucuuuuaccugccgcccgaaaagugugauaccuugcugugcgacaucggagaguccucuccaagcccuacaguggaagagucccguacuauuagaguucucaaaaugguagagcccugguuaaagaacaaucaguucuguaucaaagugcugaacccuuacaugccaaccgucauagaacaccuugagaggcugcagcgcaagcaugguggcaugcuagugcggaauccccucucacgaaacucuacacacgaaauguauuggauuaguaaugggacuggaaacaucguuucgagcgugaauauggucuccagacuguugcugaacagguuuaccaugacacaucgccggccuaccaucgagaaggauguggaccucggcgccgguacuagacacguaaacgcugaaccagagacgcccaauauggacgugauuggggagcguauaaggcggaucaaagaagaacacucuucaacauggcauuacgaugacgaaaacccguauaagaccugggcguaccacggaagcuaugagguuaaagccacuggcuccgcaaguucuaugauuaauggcgucgugaaacuucugaccaaaccuugggauguggucccaaugguuacacaaauggcuaugacggacaccacucccuucgggcagcagcgcguguuuaaggaaaagguagauacacgaaccccuagaccaaugcccggaacuaggaaagugauggagaucacagccgagugguuauggcggacccugggucgcaacaagagaccgagguugugcacacgagaagaguucauuaaaaagguccggacuaaugcagccaugggcgcuguguuuaccgaagagaaccaaugggacagcgcccgugcggcaguugaagaugaggaguucuggaaacucguggacagagaacgcgagcugcauaagcuagggaaauguggaucaugcgucuacaauaugaugggcaagagggaaaagaaacuuggugaguuugggaaggccaaaggaucccgggcuaucugguauauguggcugggcgccagauaccucgaguucgaagcacugggcuuuuugaacgaggaucacugguucagucgcgaaaauagccauucugggguggagggagaaggucugcacaagcucggcuacauacuuagggacaucuccaaaauuccugggggagcuauguaugccgaugacacggcuggcugggacacccgaaucacagaggaugaccugcacaacgaggaaaagauuacucagcagauggaucccgagcaucggcaguuagccaaugcaaucuuuaagcugaccuaccaaaacaaaguaguuaaggugcagagaccaacaccuaaagguacugucauggacauaauuucaaggaaggaucagcgcgggagcggacaggugggcaccuauggcuugaauacguucacaaacauggaagcgcaacucauccgucagauggagggggaaggagugcugucgaaagccgaccuagagaauccccaccuucuggagaagaaggucacccaguggcucgaaacuaaagguguugagcggcugaagagaauggcuaucucuggcgaugacugcgugguaaaaccaauugaugacagguucgccaacgcauuguuagcucugaacgauauggggaaggugcgcaaagacauaccccaguggcaaccuaguaagggauggcaugauuggcagcaggucccauuuuguucccaccacuuccaugaacucaucaugaaggacggccgaaaacuugugguuccgugccggccccaggacgagcugauugguagagccaggaucagccaaggggcaggauggucacuacgcgaaacagccugucugggcaaggcguacgcucagaugugggcccucauguauuuucacagacgggauuugaggcuggcauccaaugccauuugcucugcugugccuguccauugggugccaaccagccguacuaccuggaguauccacgcccaucaccaguggaugacaacggaggacaugcuuaccguauggaaccgaguuuggauagaggauaaucccuggauggaagacaaaacuccugugacaaccugggaggaugucccauaccugggcaagcgcgaagaccaauggugugggucccucaucggauuaacuagcagagcaacaugggcucagaacauucugaccgccauccaacaggugcggucuuugauugguaaugaggaguuccuggauuauaugcccucaaugaaaagguuucgcaaggaagaggaaagugagggcgcgaucugguga

SEQ ID NO: 15630 - RNA, 9873 nt, Artificial Sequence
  derived and/or modified CDS sequence (opt3) from DENV-3__JQ920485__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacauuaccacagauagccggugcccuacucagggcgaagccaucuugccagaggaacaggaccagaauuaugucuguaaacacaccuacguugaucgcgguugggggaacggaugcggccucuuuggcaaggggagucuggugacaugcgcuaaguuccaauguuuagaguccauagagggaaaagccguacagcacgaaaaucugaaguauacugugauuaucaccguccauacaggugaccagcaccaggugggcaacgagacccaagggguuacugcagaaauuacgccccaggcuucuacaguggaggccauccucccugaauacggaacccuuggccuggagugcagcccacgaacugguuuggacuuuaaugagaugauccuacugaccaugaaaaacaaggcguggaugguccauagacagugguucuuugaucucccgcugcccuggacauccggggccaccacugaaacaccuacguggaauaaaaaggagcuucuggugaccuucaaaaacgcacacgcuaagaagcaagaaguaguuguguugggcucacaggagggagccaugcacacugcucucacaggcgccaccgaaauucagacaagugggggaacuagcauauuugcaggucaucugaaauguagguuaaagauggacaaacuggagcuaaagggcaugucuuaugccaugugccucaaugcuuucguccugaaaaaggagguguccgaaacccagcacgggacgauccuuauuaaggucgaguacaaaggagaagaugcgccauguaagauccccuucucaaccgaggacggccaagguaaagcacauaacgggcgguugauaacagccaacccuauugugacuaagaaagaggaaccaguuaauaucgaggcugaacccccguuuggcgagagcaacaucgugauuggaaucggcgauaaggcccugaagauuaauugguacaaaaaggggaguucuauaggaaaaauguucgaagcaaccgcccguggugcucgcagaauggccauccucggcgacacagcaugggauuuuggguccguaggaggcguccugaacagccuugguaagauggugcaccagauuuucgggucggcguauacugcucuguuuucuggcguuuccuggaucaugaaaaucggaauuggcguguugcucaccuggauagggcugaauucaaagaacacgaguaugagcuucuccugcaucgucauuggaaucauuacauuauaccugggcgccgugguacaggcagacauggguugugugaucaauuggaaggggaaagagcuaaagugcggaucuggcauauuuguuaccaacgagguccauacuuggacagaacaguauaaauuccaagccgauagcccuaagaggcucgcuaccgccaucgcaggugcuugggagaauggcgugugugggauucggucaacuacccgaauggaaaaccugcuuuggaaacagaucgccaaugaguugaacuacauucugugggaaaauaacaucaagcucacaauaguggucggagacguuauuggcgugcuggagcaggggaaacgcacguuaaccccccagccaauggagcugaaguauaguuggaagacuuggggaaaagcgaagaucgugacagccgaaacccaaaauuccagcuuuauuaucgauggcccuaacacacccgagugcccaucugcuucaagagcauggaacguaugggaagucgaggacuacgguuucgggguguuuacuaccaauauauggcuuaaauugagggaaaagcacacgcagcucugugaccaccggcugaugagugccgcuguuaaagaugagcgcgccgugcaugcagacaugggauauuggaucgagagccagaagaacggcuccuggaagcuagaaaaagcgucucugauugaggucaagacaugcaccuggcccaaaucgcacacucucuggagcaauggugugcuggaauccgauaugaucauuccuaagucacuugccggcccaaucagucagcauaacuacagaccgggguaccacacccaaacagcuggacccuggcacuugggcaaacuggaguuagacuucaauuauugcgaggggacuaccguugugauaacagaaaacuguggaauuaggggcccuucucuccguacgaccacuguaagcgguaagcugauccaugaguggugcugucgguccugcacacuuccaccccugcgauacaugggggaagauggauguugguauggcauggagaucagaccuauuaaugaaaaggaggagaacauggucaaaucauuggugagcgccgguucuggcaagaccgacaauuuuacuaugggggugcucugccuggcaauccuauucgaagaggucaugaggggaaaauucggcaagaaacacaugauugcuggggcccuguuuacauucguucuccugcuuuccggacagauaaccuggcgcgauauggcacauacguugaucaugauuggcaguaacgccagcgaccggauggguaugggggugacuuaccuggcuuuaaucgcgaccuuuaagauucagccauuccucgcccugggauuuuuccuuagaaagcugacaucuagggaaaaucuacuccugggcguaggcuuggcaauggcuaccacucugcaauuacccgaggauaucgaacagauggccaacgggauagcccucggacugauggcucuuaaacugaucacacaguuugagaccuaucaguuguggacagcacucauuucccugauguguucaaauacuaucuucacccuaacgguggccuggcgcacagcgacccugauucuugcugucaucagucuccugccggugugccaaagcucguccaugcgaaagacugacugguugccuaugaccguugccgcaaugggugugccaccccugccuuuauuuauauucucucucaaagauacacugaagcggcguagcuggccccuuaacgagggcgucauggccguggggcugguuucaauuuuggcuaguuccuuucucagaaaugacgugccaauggcaggaccucuggucgccggcggucuacugaucgcguguuacguaaucacugggaccucugcugaucuuacgguggaaaaagccgcagacguuacaugggaggaagaggccgaacagaccggagugagccacaaccucaugauuacugucgacgaugacggcacaaugaggauaaaggaugacgagaccgagaacauccugacuguguuguuaaaaacagcucugcucauuguauccggcaucuuccccuauucaauuccagccacccugcuuguguggcauacguggcagaagcagacucaacgcagcgggguccugugggauguuccgaguccucccgaaacccagaaggcagaguuggaagagggaguguaccggaucaaacagcaggguauauuuggcaagacacaagugggggucggagugcagaaagagggcguuuuccacaccauguggcacguaacaagaggugcugugcuaacucauaaugggaagaggcuggaaccaaacugggccaaugucaaaaaggaccucaucucuuacggaggcggcuggaagcuguccgcgcaguggcaaaaaggggaggaagugcagguuauugccguggagcccggaaagaacccuaaaaauuuccagaccaugccagguaucuuucagacgacaacuggcgaaauuggggcaaucgcucuugauuucaagcccggaaccagcggcucgccuauaauuaaccgagaggguaaagucgugggguuauauggaaauggcguagucacaaagaacggcggguacgugucaggaaucgcccaaaccaaugcugagccggacgguccaauccccgaacuggaggaagagauguuuaagaaacgcaaccucacuauuauggauuugcacccuggcucugggaagacccggaaauaucugccagcaaucguuagagaagccauaaagaggcgucuccgcacacugauucuugcccccacgcggguggucgcugcggagauggaggaagcacugaaaggauugccuaucagauaccagacuaccgccacaaagagugagcauaccggcagggaaauuguggaccuaaugugccacgcuacuuucacaaugcgacugcucuccccgguucgggugcccaauuauaacuuaaucgucauggaugaggcccauuuuaccgacccagcaagcauagccgcucgcgguuacauuucuacgagaguggggaugggagaagcggccgcaaucuucaugacugcuacaccucccggcaccgccgaugcauuuccacagagcaaugccccuauccaggacgaggagagggacauucccgaacgguccuggaacucaggcaaugaguggaucaccgauuucgcugggaagacuguaugguuugugccaaguauuaaagccggaaacgacauagcgaacugucugcgaaagaaugguaaaaagguuauccaacuuagcagaaaaacauucgauaccgaauaucagaagacaaagcugaacgacugggauuuugucgugacuacggacauuucugagaugggcgcaaauuucaaagccgaucgcgugaucgacccgaggcguugccucaagccugucaucuugaccgaugggcccgagcggguaauucuggcuggaccaaugcccgugacaguugccuccgcugcacagagaaggggccgcgugggucgaaacucacagaaagaaaaugaccaauacauauucacugggcagccucucaacaaugaugaggaccacgcccacuggaccgaagcuaagaugcugcuugacaacaucaauacaccagagggcauuauccccgcccuauuugaaccugagagagagaaaagugcagcgauugauggagaauaccggcugaagggcgagagcaggaaaaccuucgucgaauugaugcgccguggggacuuaccgguguggcuggcccauaagguugcuuccgagggaaucaaguauacugauagaaaauggugcuuugacggugaacggaacaaucagauacucgaggagaacauggauguggaaaucuggacgaaggagggcgaaaaaaagaaacugaggccacgcuggcuugacgcccgaaccuacucugauccccuggcacucaaggaguucaaggacuuugcugccgggagaaaaucgauugcauuggaucuggucacagaaaucggacgggugccuagccaccuagcccauaggacucgcaaugcucuggacaaccucguaaugcuucacaccucagagcacggcgguagagcguauaggcaugccguggaggaacugcccgagacaauggaaaccuuauugcugcucgggcugaugauucuucugacuggcggagcaaugcucuucuugaucuccggcaaggggauaggaaaaacaaguauuggucugaucuguguugucgcuucuagcggcauguuauggauggccgaugugccacuacaguggauugccuccgcaaucgugcuggaguuuuucaugaugguccuccuuauaccugagcccgaaaagcaacggacgccacaggacaaucagcuggcuuacguugugaucgggauuuugacccuggccgcgaucguagcugccaacgagaugggacuccuggaaacuacaaaacgugaucuuggcaugucaaaggagccugguguggucucuccgaccagcuaucucgacguggaccugcaccccgcaagugccuggaccuuguacgcuguugcaacaacugugauuacgccaaugcugcgccauaccaucgaaaauuccacagccaacgucagcuuagcggcuauagccaaccaagcaguagugcuaauggggcuggauaagggcuggccuauuucuaaaauggaccucggaguuccccuucuggccuugggcugcuauucacaggugaauccacugacucucaccgcugccguccugcuuuuagugacacacuacgcaaucaucgggccuggacugcaggcuaaggccacccgagaggcgcagaaaagaacugccgcaggcauuaugaagaaccccacggucgaugguaucaugacaauagaccucgauccggugauuuacgacuccaaauuugagaagcaauuggggcagguuaugcugcuagugcugugugcuguacagcuccuucugaugaggaccaguugggccuucugcgaagcauugacucuggcuaccggaccaaucacaacucucugggagggcagcccugguaaguuuuggaauaccacaauugccgugucgauggccaacaucuuccggggcucuuaucuggcgggggcuggauuagcauuuuccauaaugaaaagcgucggcacggggaagcgcggaaccggcucacagggugaaacucuuggggagaaauggaagaaaaagcugaaucaacucaguagaaaagaauucgaucuauacaagaagucuggaaucacagagguugacaggauugaggccaaagaaggccugaagcggggugagaucacccaucacgcugugucccgaggcagcgccaaauugcagugguucgucgaaagaaacauggugauucccgaggggcgcguaaucgaucugggauguggcagggggggauggucauauuacugcgcaggccucaagaaagugacugaaguucgggguuauacaaaggggggaccaggccacgaggagcccgugccuaugaguaccuacggcuggaauauugucaagcuuaugagcgggaaagacguguuuuaucugccgcccgaaaagugugauacguugcugugcgacaucggagaguccucuccaagcccuaccgucgaagagucccguacaauaagagugcucaaaaugguugagcccugguuaaagaacaaucaguucuguauuaaaguacugaacccuuacaugccaacugugaucgaacaucuugagaggcugcagcgcaagcacgguggcaugcuaguccggaauccccucucacgaaacucuacccaugaaauguacuggaucaguaaugggacaggaaacauugugucgagcguuaauaugguguccagacuguugcugaacagguuuacuaugacccaccgccggccuacaauagagaaggaugucgaccucggcgccgguaccagacacgugaacgcugaaccagagacucccaauaugaacguaaucggggagcguauuaggcggaucaaagaagagcauucuucaacguggcacuaugacgaugaaaauccguacaagacaugggcguaucauggaagcuacgaggugaaagccaccggcuccgcaaguucuaugauuaacggcguugucaagcuucugacuaaaccuugggacguggugccaauggucacccaaauggcuaugacagauacgacccccuucgggcagcagcgcguuuuuaaggaaaagguggacacucgaacaccuagaccaaugcccggaaccaggaaaguaauggagaucacugccgagugguuauggcggacacugggucgcaauaagagaccgagguugugcacccgagaagaguucauaaaaaaggugcggacaaacgcagccaugggcgcugucuuuacugaagagaaucaaugggauagcgcccgugcggcaguggaagacgaggaguucuggaaacucguugauagagaacgcgagcugcacaagcuagggaaauguggaucaugcguguauaacaugaugggcaagagggaaaagaaacuuggugaguuugggaaggccaaaggaucccgggcuaucugguacauguggcugggcgccagauaucucgaguucgaagcacugggcuuuuugaaugaggaccauugguucagucgcgaaaacagccacucuggggucgagggagaaggucugcacaagcucggcuacauucuuagggauaucuccaaaauuccugggggagcuauguacgccgacgauaccgcuggcugggacacgcgaaucaccgaggacgaucugcauaaugaggaaaagauaacacagcagauggaccccgagcaccggcaguuagccaacgcaauuuuuaagcugacuuaucaaaauaaagugguaaagguucagagaccaaccccuaaagguacagugauggauaucaucucaaggaaggaccagcgcgggagcggacaggucggcacuuacggcuugaacaccuucacgaauauggaagcgcaacucauucgucagauggagggggaaggagugcugucgaaagccgaucuagagaacccccaucuucuggagaagaaggugacacaguggcucgaaaccaaaggugucgagcggcugaagagaauggcuauaucuggcgacgauugcguugugaaaccaaucgacgauagguucgccaacgcauuguuagcucugaaugacauggggaagguacgcaaagauauuccccaguggcaaccuaguaagggauggcacgacuggcagcaggugccauuuuguucccaccauuuccacgaacucaucaugaaggauggccgaaaacuugucgugccgugccggccccaggacgagcugauugguagagccaggaucagccaaggggcaggauggucacuacgcgaaacugccugucugggcaaggcguaugcucagaugugggcccucauguacuuucauagacgggacuugaggcuggcauccaacgccauaugcucugcuguuccugugcacugggucccaacaagccguaccacuuggaguauccaugcccaccaccaguggaugaccacagaggauaugcuuacgguguggaaucgaguauggauugaggacaaccccuggauggaagauaaaaccccuguuacuacaugggaggacgugccauaucugggcaagcgcgaagaucaauggugugggucccucaucggauuaaccagcagagcaacuugggcucagaauauucugacagccauccagcagguccggucuuugauugguaacgaggaguuccuggacuacaugcccucaaugaaaagguuucgcaaggaagaggaaccugagggcgcgauaugguga

SEQ ID NO: 15631 - RNA, 9873 nt, Artificial Sequence
  derived and/or modified CDS sequence (opt3) from DENV-3__FJ644564__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugccaucgcaggugcuugggagaauggcgucugugggauacgaagcaccacacgcauggaaaaccuccuguggaaacagaucgccaaugagcuuaacuauauuuugugggaaaauaacaucaagcugacgguuguggugggagacaccauuggcguacucgagcaggggaaaagaacucugacaccacagccuauggaguuaaaguacucauggaaaaccuggggaaaggcgaagaucgucacagccgaaacucaaaacaguuccuucauaauugauggccccaauaccccagagugccccagcgcuucuagggcauggaacgugugggaaguugaggacuaugguuuugggguguucacgacaaauaucuggcugaaacuucgggaagucuacacccagaugugugaccaccgcuugaugucagccgcugugaaggaugagagagccguucacgcagacaugggauacuggauugagagucagaaaaacggcagcuggaagcucgaaaaagcgucccugaucgaggugaagacuugcaccuggccuaagucucauacacuauggucgaaugguguacuggaaagcgauaugauaaucccaaaaucccucgccggcccgauuucacagcacaaccauaggcccggguaucacacucaaaccgcuggaccuuggcaccuggagaaucuugaguuggacuuuacauacugcgaaggcacgaccgucgugaucacugagaacugugggacacguggaccaagucugcggaccacuacagugucuggcaaguuaauucaugaauggugcugucgaagcugcacccuccccccucugagauauaugggugaggauggguguugguacggaauggaaaucaggccaauauccgagaaagaggaaaauauggucaagucacuuguuagcgccggcucugguaaaguggacaacuucacgaugggcauucugugcuuggcaauccucuuugaggaaguaaugcgcgggaaguucggaaagaaacacaugaucgcuggcguguucuuuacuuucguccugcuacuguccgggcagauuaccuggcgggauauggcccauacacucaucaugauuggaaguaaugcaagcgacagaaugggcaugggugugaccuaucuggcccuuauagcuacuuuuaagauccagcccuucuuggcgcugggguuuuucuuaaggaaacucacaucucgcgagaaccugcuucugggaguuggccuagccauggcaaccacacuccaacugccggaagauauugagcagauggcuaauggcaucgccuuggggcugauggccuuaaagcucauuacucaguuugagaccuaccagcuguggacggcucuuaucucccugacauguucaaacaccauauucacuuugaccguggcauggcgaacagccacucucauccuggcgggagucagucuacugccugugugccaaagcucguccaugcggaaaaccgacuggcuuccaaugacgguugcugccaugggugugcccccucucccccuguuuauuuucucuuugaaggauacacugaagcguagaagcuggccauuaaaugaaggcgucauggcaguagggcucgugucaauccuggccaguucccuucugaggaacgacguuccuauggcuggacccuugguggcaggcggucuccugauugccuguuaugucaucaccgggacuucugcggaucuaacaguggagaaagcugccgacguaaccugggaagaggaagcagagcagacuggagugagccacaaccugaugauaacagucgacgaugacggcaccaugcgcauuaaggaugacgagacggaaaauauccuuacuguucuccugaaaaccgccuuguuaaucguguccggcauuuuuccauacucaauaccggcuacacugcucguguggcauaccuggcagaagcagacacaacggagcgggguccugugggaugugccuagucccccagagacucagaaagccgaacuugaggagggaguuuacagaaucaagcagcaggguauucugggcaaaacccaaguaggggugggaguccagaaggaaggcguguuccacacgauguggcacguuacaaggggugcaguguugacucauaacgggaagcgacuagagcccaauugggcuucugucaaaaaggaccugaucuccuauggaggcggcuggcgccucagcgcccaguggcaaaaaggggaagaggugcagguaauugcggucgaaccuggaaagaacccaaaaaauuuucagaccaugcccgguacauuccagaccacuaccggcgagaucggggccauagcacuggauuucaagccuggaacaucgggcucaccgaucauuaaccgggaggguaaggugguugggcuuuacggaaauggcguggucacgaaaaacggcggguaugugucuggaaucgcucaaacuaaugccgaaccagacggucccaccccugaguuagaagaggaaauguuuaagaaaagaaaccugacaauuauggaucuccacccaggcagugggaagaccaggaaauacuugcccgcuaucguucgugaggcaauaaagcgccggcugagaacucucauucuggccccuacaaggguggucgccgcugagauggaagaggcgcuuaagggacugccgauccgauaucagaccacggcaacuaaauccgaacauacaggccgggagaucguggacuugaugugccacgccaccuucaccaugcgccuacugagccccguaagagugccaaauuacaaccucauuaucauggaugaagcucauuuuacugacccugccucuauagcagccagggguuauauuagcacacggguugggaugggagaggcugcggccaucuucauguccgcaacccccccaggcacagcugaugccuuuccucagucaaaugcacccauucaggacgaggaacgagacaucccagagagaaguuggaacagcggcaaugaauggauaacugauuucgccgggaagacggucugguuugugccgucuauuaaagcuggaaacgacaucgccaacuguuuacgcaagaaugguaaaaaggugauccaacuguccaggaagaccuucgauacagaguaccagaaaacuaagcuuaacgacugggauuuugucguaaccacagacauuucagagaugggcgcgaauuucaaagcagaucgugugaucgacccucggagaugccugaagcccguuauucucaccgaugggccagaaagggugauauuggccggacccaugccugucacugcugccagugcugcacagcgccgaggcagagugggucggaacccacagaaagagaaugaccaauacaucuuuacggggcagccccugaacaaugaugaagaccacgcccacuggaccgaggcuaagaugcuccuggacaacauuaauacaccugaaggcaucaucccggcccuuuucgagccagagagggaaaagagcgcagcgauugauggagaguaucgccuaaaaggcgaaucccguaagacuuucguugagcugaugagacggggggacuugcccgugugguuagcccauaaagucgcuucugaaggaauaaaguacaccgauaggaaauggugcuuugacggucagcgcaacaaucagauccuggaggagaacauggauguggaaauuuggacaaaggagggcgaaaaaaagaagcuccgaccuagauggcuggacgcccggaccuauucggauccccuugcacugaaagaguucaaggacuuugcugccgggaggaaaagcaucgcacucgauuugguaacugaaauuggacgcgugccaucacaccuggcccauagaacaaggaaugcucuagacaaccugguuaugcuccacacguccgagcacggcggucgggcguaccgucaugccgucgaggaacuuccugagaccauggaaacucuguuauugcuggggcucaugauccugcuuacaggcggagcaaugcuguuccucauaaguggcaaggggaucggaaaaaccucuauugguuugaucugugugauugcuagcuccggcaugcuguggauggccgagauccccuuacaauggauagccucagcaauugugcuagaguuuuucaugaugguccugcucaucccagaaccugagaagcagcgcaccccgcaggauaaucaacuugcuuauguugugauugggauccugacauuggccgcgauaaucgcugccaacgaaaugggacugcucgagacuacgaagcgagaccugggcaugucuaaagaacccgguguagugagcccaaccaguuaccuugaugucgaccuccacccugcauccgccuggacacuguaugcuguggcaacuaccguuauuacacccauguugagacauaccaucgagaauagcacugccaacgugucucuggcggcuauugccaaccaggcagucguauuaauggggcuagacaagggcuggccaaucucaaaaauggaucugggagugccucuccuugcccugggcugcuacucccagguuaaucccuugacgcugacagcugccgugcuccugcuuauaacccacuacgcaauuaucgggccgggauuacaggcuaaggccacuagggaggcgcaaaaacggaccgccgcaggcaucaugaagaacccaacagucgacgguauuaucacuauagaucuggacccugugauuuaugauaguaaguuugaaaaacagcucgggcaggucauguugcuggugcuaugugcuguucagcugcuccuuaugcgcaccagcugggcccugugcgaggcauugacacuggcuacgggacccaucaccacucucugggaaggcucgccagguaaguucuggaauacaaccauugccgugucuauggccaacaucuuuagaggcuccuaccuggcgggggcuggauuagcauucagcauaaugaaaucaguaggcacugggaagaggggaacaggcagucaaggugagacccuuggggaaaaauggaagaagaaacugaaucagcucucucggaaggaguuugaccuauauaaaaaguccggaaucacggagguggaucgaaccgaagccaaagagggccugaagagaggugaaacaacucaucacgcugucagccgcggcucagccaaauugcaguggcugguugagaggaacauggugauucccgaagggcgggucaucgaccucggauguggccgugggggauggaguuacuauugcgcaggccuuaagaaggugaccgagguaagagguuacacaaaagggggaccuggccacgaggaaccggugcccaugagcacuuauggcuggaauauuguuaagcugauguccgggaaagauguguucuacuugccaccugagaagugugacacccugcucugcgauaucggagaaucuagccccuccccuacagucgaggagucaaggaccauucgcguguuaaaaauggucgaaccauggcugaagaacaaucaguuuuguaucaaggugcuuaaccccuacaugccugccguuauagagcaucuggaacggcuacaacgaaaacacgguggcaugcucguaagaaauccacugucuaggaacaguacucaugagauguauuggauuucgaaugggacgggaaacaucgugagcuccgucaauauggugucucgcuugcugcucaaccgguucacaaugacccacagacgucccacuaucgaaaaggacguugaucuuggcgcugguaccaggcacgugaacgcggagccggagacaccuaauauggacgucauuggggaacggauaaaacgcaucaaggaggaacauaacucaacguggcacuacgacgaugagaauccauauaaaaccugggccuaccauggaagcuaugaagugaaggcaacuggcuccgcuaguucuaugauuaacggcguagugaagcuguuaacaaaacccugggacguugucccuauggugacccagauggccaugacugauacaaccccauucgggcagcaacgaguguuuaaggagaaagucgacacaagaacucccaggccgaugccuggaacccggaagguuauggagaucacggcagaauggcuguggcgcaccuuggguagaaauaaaaggccccgacucugcacacgggaggaauucacuaagaaggugcguaccaacgccgcuaugggcgccguauuuacagaggaaaaucagugggauagcgcgaaagcagccguggaggacgaggaauucuggaagcuggucgauagagagcgcgaacuacacaaacuugggaaguguggaucaugcguguacaacaugaugggcaaaagggagaagaaacugggugaguuugggaaggcuaagggaucccgggccauuugguauauguggcucggcaguagauaccuggaauucgaggcauugggcuuucugaaugaagaccauugguucagccgcgagaacucuuacuccgggguugaaggagagggucuccacaaacuuggcuauauccugagggauauaucaaagaucccagggggagcuauguacgccgacgauacugcuggcugggacacccgaauuacggaggacgauuuacacaaugaagagaaaaucacacagcagauggacccugaacaucggcuguuggccaacgcaauuuuuaagcucaccuaucaaaauaaaguggucaaggugcagagacccacuccaacagguaccguaauggauaucauaagcaggaaggaccagcgcgggucgggacagguuggcacuuacggccugaacaccuucacaaauauggaggcgcaacuagugcgucagauggaaggggagggaguccuuucuaaagccgaucuggagaacccccaccucccugaaaagaaaauuacgcaguggcuggagaccaaggguguggaacgguugaaaagaauggcuaucaguggcgacgauugcguggucaagccaaucgacgauagguuugccaacgcauuacuggcucucaaugacauggggaagguucgcaaagauauuccgcaguggcaacccuccaagggauggcaugacuggcagcaggugccuuucuguagccaccacuuucaugagcuuauaaugaaagauggccgaaagcugguagugccaugccggccccaggacgaacuaaucgguagagccaggauuucacaaggggcaggauggucccugcgcgagacugccugucucggcaaagcguaugcucagauguggucuuugauguacuuccacagacgggaccugaggcuugccagcaacgcaaucugcagugccgucccugugcauuggguuccaacaucccguaccacuuggagcauucacgcucaucaccaguggaugacaaccgaggauaugcugacgguguggaaucgagucuggaucgaagacaaccccuggauggaggauaagacaccugugaccacuugggaaaauguaccguaucucggcaagcgcgaggaccaauggugugggucuuuaauaggacugaccucaagagccacaugggcacagaacaucccaacugcuauucagcagguucggaguuugaucgguaaugaggaauuccuggauuacaugcccuccaugaaaagguuucgcaaggaggaagagagcgaaggcgccauuugguga

SEQ ID NO: 15632 - RNA, 9873 nt, Artificial Sequence
  derived and/or modified CDS sequence (opt3) from DENV-3__HQ235027__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccauugaaauacagaauucagggggaaccaguaucuucgcaggucaucugaagugucgguuaaaaauggacaagcuggagcuaaaaggcaugagcuacgccaugugcacaaagacuuuugugcucaaaaaggaggucucugaaacccagcacgggacgauucugaucaagguggaguacaaaggagaagaugcucccuguaagauaccuuucuccaccgaggacggccaagguaaagcguauaacgggcgucuuauuacagcaaacccaguugugacuaagaaagaugagcccguaaauaucgaagccgagccgccuuucggcgaaucaaacaucgucauuggaaucggcgacaaugcuuugaagauuaacugguacaagaaagggagcaguauaggaaagauguuugaggccaccgcacgcggugccagaaggauggcuauccugggcgauacagccugggacuucgggucugugggaggcguucucaauucccuggguaaaauggugcaucagauuuuugggagcgcauauacugcgcuuuucucgggcgucucuugggugaugaagaucggaaucggcguacuguugaccuggauugggcucaacuccaaaaauauaucaaugaguuuuagcugcaucgcuauuggaaucauuacgcuguacuuaggcgccgugguucaggcagauauggguugugucaucaacuggaaggggaaggaacugaaaugcggauccggcauauucgugacaaaugaggugcacaccuggacugagcaguauaaguuucaagccgacucucccaaacggcuagcuacagccaucgcaggugcuugggaaaacggcgucugugggauucgaagcaccacucgcauggagaaucuccuguggaagcagaucgccaacgaacuuaauuacauuuugugggagaacaauaucaaacugaccguuguggugggagauacaauaggcguacucgaacaggggaagagaacgcugaccccacagccuauggaguuaaaauauucauggaagacuuggggaaaggcgaaaauugucacagccgagacccaaaacaguuccuucaucauugacggccccaacacaccagaaugccccagcgcuucuagggcauggaaugugugggagguugaagacuacgguuuugggguguucacuaccaacaucuggcugaagcuucgggaggucuacacgcaguugugugaucaucgccucaugucagccgcugugaaagacgaaagagccguucacgcagauaugggauauuggauagagagucagaagaauggcagcuggaaacuggagaaggcgucccuaaucgaagugaagacaugcaccuggccuaaaucucacacucuguggucgaacgguguacucgagagcgacaugauuaucccaaagucccuggccggcccgauuucacagcauaaucacaggcccggguaccauacccaaacagcuggaccuuggcaccuuggcaaauuggaacuggauuuuaacuauugcgaggggacuaccgucgugaucacagagaauuguggaacgcguggcccaaguuuacggaccacuacagugucugguaagcucauacacgaauggugcugucgaagcugcacccugcccccucuuagauacaugggggaggacggauguugguauggcauggaaauuaggccaaucuccgagaaagaagagaacauggucaagucacugguuagcgccgguucuggcaagguggauaauuucacuauggggguauugugccucgcaauccuguuugaggaagugaugcgcggaaaauucggcaagaaacauaugauugcuggggucuucuuuacauucgugcuacugcucuccggacagaucaccuggcgggacauggcccacacgcugauuaugauaggcaguaacgcaagcgauagaauggguauggggguuacuuaccuugccuugaucgcuaccuuuaagauucagcccuuccuggcguuaggauuuuuccucaggaaacugacaucucgcgagaaucuucugcuaggcgugggccucgccauggcaaccacucugcaauugccggaagacaucgagcagauggcuaacgggauugcccugggauuaauggcccucaagcugaucacacaguuugaaaccuaucagcuuuggacagcucugauauccuugacuuguucaaauaccauguucacgcucacagucgcauggcgaaccgccacucugauccuagcgggugugagucugcuuccuguuugccaaagcucguccaugcggaagaccgauuggcucccaauggcuguggccgcaaugggcguccccccucugcccuuguuuauuuucucucugaaagacacauuaaagcguagaagcuggccacucaacgaggggguaauggccgugggacugguuucaauccuugcuaguucccuguugaggaaugaugugccuauggcaggcccccucgucgccggugggcugcuaauugcguguuacgugaucacuggaaccucugcugaccugacgguagagaaagccgcagacauaacaugggaagaggaagccgagcagaccggcgugagccauaaccuuaugauuacugucgaugacgauggcacaaugcgcaucaaggacgaugaaaccgagaacauccucacuguucuguugaaaacagcuuuacuggugguguccggggucuuuccauacucaauuccggccacccuccugguguggcacacguggcagaagcagacucaacggagcggaguucuuugggacguaccuagucccccagagacccagaaagcagaacuggaggaagguguguauagaauaaagcagcagggcaucuucgggaagacacaagucggagugggcguucagaaagaggguguguuucauaccauguggcacgucacaaggggggcuguguugacuuacaauggaaagcgacuagagcccaacugggccucuguaaaaaaggaucugauuuccuauggcggcggguggcgccucagcgcgcaguggcaaaaaggagaagagguccaggugaucgccguugaaccugguaagaauccaaagaacuuccagaccaugcccggcacguuccagacaacuaccggggagauuggagcaaucgcucuggacuuuaaaccuggcacaucggguucaccgauaaucaaucgggaagggaagguggucggacuuuacggcaacggcgugguuaccaaaaaugggggauaugugucugguauugcccaaacuaacgcugagccagauggccccaccccugaguuagaagaggaaauguucaagaaaagaaaucugacaaucauggaccuccacccagggaguggaaagacgaggaaguacuugcccgcaauuguccgugaggccaucaaacgccggcugagaacucucauacuggccccuaccagggugguagcugcggaaauggaggaggcacuuaagggccugccgauucgauaucagacaaccgccacuaaauccgaacauacaggucgggagaucguggauuugaugugccacgcuaccuuuacgaugcgccuacugagccccguuagagucccaaacuacaaucucaucauuauggacgaagcccauuucacugauccugcaucuaucgccgcuaggggguacauaagcacacgggugggaaugggcgaggcggccgcaauuuuuaugaccgcuacccccccaggcacugccgacgcauucccucaguccaacgcccccauccaggacgaagagcgagauauuccagagagaucauggaauagugggaacgaauggaucacagacuuugcuggaaagaccgugugguucgucccgagcauaaaagccgguaaugauauugcgaacuguuuacgcaagaacggcaagaaaguaauccaacugucuaggaagacauuugacacugaguaucagaaaacgaagcuuaaugauugggacuucgugguuaccacagauaucuccgaaaugggggcaaacuuuaaagccgaccgugugauugauccucggagaugccugaagcccgucauccucacugacggaccagagagggugauuuuggcuggccccaugccuguuaccgccgcuucagcagcccagcgccgagguagaguggggcggaauccacagaaggagaacgaucaauacauauucacaggccagccccugaauaacgacgaagaccacgcucauuggaccgaggccaaaaugcuccuggauaauaucaacacuccugaaggaauuaucccggcacuuuucgagccagaaagggagaagagugcggccaucgacggcgaguaucgccuaaaaggggaaagccguaagacguuugucgagcugaugagacggggagauuugcccgugugguuagcucacaaaguagccuccgaagguauuaaguacaccgacaggaaauggugcuucgauggccagcgcaauaaccagauacuggaggaaaauauggacguggagaucuggacaaaggagggggaaaagaaaaagcuccgaccuagauggcuggaugcacggacuuauucugacccccuugcucugaaagaguuuaaggauuucgccgcaggaaggaaaucgauugcccucgacuugguuaccgaaaucggccgcgucccaagccaccuggcucauagaacaaggaacgcgcuagauaaucuggugaugcuccacaccucagagcauggugggcgggccuaccgucacgcaguggaagagcuuccugagacuauggaaacacuguuauugcugggccucaugauucugcuuacgggaggcgcuaugcuguuucucaucuccgggaagggaauagguaagaccaguaucggcuugauuugugucaucgccucuagcgggaugcuguggauggccgagauucccuuacaauggaucgcauccgcuauaguucuagaauucuuuaugauggugcugcucauuccagagccugagaaacagcgcacuccgcaggacaaccaacuugccuauguagugaucggaauucugacauuggcggcuaucauagccgcaaaugaaaugggccugcucgagaccaccaagcgagaucuggguaugucaaaagaacccggggucgugucuccaacaagcuaccuugacguugaccuccacccugccagugcuuggacucuguacgcaguggccacgaccgucaucacacccauguugagacauacuauugagaacuccaccgcgaauguaagccuggcugccaucgcaaaccaggccgugguuuuaaugggccuagauaagggauggccaauuucuaaaauggaccugggcgugccucuccuugcucuggggugcuauucacaggucaaccccuugacacugaccgccgcagugcuccugcuuaucacucacuacgcuauaauuggaccgggcuuacaggccaaggcgacgagggaagcccaaaagcggacagcagcugguaucaugaaaaauccaaccgucgaugggaucaugacuauugaccuggauccugugaucuaugacuccaaguucgagaaacagcucggacagguuauguugcuggugcuaugugccguacagcugcuccuuaugcgcaccaguugggcacugugcgaggcuuugacacuggccacuggccccauaaccacacucugggaagguagcccaggcaaguuuuggaacacgaccauugccgugucgauggcgaauaucuucagagggucuuaccuggcuggagcaggcuuagccuuuuccauuaugaaaagcgucgggacuggaaagaggggcacagguucacaaggggagacccuuggagaaaaguggaaaaagaaacugaaccagcucagucggaaggaguucgaucgauauaaaaagucuggcaucacugaaguugacagaacagaggcuaaagagggucuaaagcgcggcgaaaccacgcaucacgccguguccagggggagcgcaaagcugcagugguuugucgagcggaauauggugauacccgaaggacguguaaucgauuugggcugugggagaggaggcuggucauacuauugcgccggucugaaaaaggugaccgagguuaggggguacacaaaaggaggcccuggccaugaagagccggugcccaugaguacuuacggguggaacauugucaagcucaugagcggaaaagacguguucuaucuuccaccugagaagugugauacccuguugugcgacaucggugaauccucucccagcccuacagucgaggaaucccgcacuauucgggugcugaagaugguugagccauggcucaaaaauaaccaguucuguaucaagauuuuaaaucccuacaugccuaccguaaucgagcaccuggaacgacuucaaagaaaacacggcgggaugcuggugaggaacccacuaucacgcaauucuacacaugagauguauuggauaaguaacggaaccggcaauauugucgcuucggugaacaugguuagccggcuccuguugaauagauuuacuaugacgcaccguaggcccacaaucgaaaaggauguggaccugggugcggggacccggcaugucaacgccgagccggaaacuccuaacauggacgugaucggagagcgcauuaaacgaauaaaggaggaacacaauuccaccuggcacuacgaugacgagaacccauauaagacaugggcauaccauggcucuuaugaaguaaaagcuacgggcucagccagcuccaugaucaauggggugguuaagcuccuuaccaaacccugggaugucgugccuauggugacucagauggcaaugacagacaccacuccauucggacagcaaagagucuuuaaggagaaaguugauacaaggaccccccggaguaugccggguacacgcagagugaugggcauuacugccgaauggcuguggaggaccuuagggcgaaacaagaagccucggcugugcacgcgugaggaguucaccaaaaagguaagaacaaaugcugccaugggagcgguguuuacugaagagaaccagugggacucugcaaaagccgcugucgaagaugaggacuucuggaaguugguggaucgcgaaagggagcuccacaaacugggcaagugugguagcugcguuuacaauaugauggggaaacgggagaagaagcuaggagaauuuggcaaagccaagggcucaagagcaaucugguacauguggcuuggggcucgcuaucuggaguucgaagcccucggauuucugaacgaggaccauugguucuccagggagaauaguuacagcgguguggaaggcgagggguugcacaaacugggauauauucuccgagauaucucuaagauacccggcggugcuauguacgccgacgacaccgcagggugggauacacggaucacugaagacgaucuucauaacgaggaaaaaauuacccagcagauggacccagagcacagacaacuggcgaaugccaucuuuaaguuaacguaucagaacaaggucgugaaaguacagaggccuacacccaccggaacuguuauggauauuaucucccgcaaggaccagcguggcucaggccaaguggggacauacggacugaauaccuucacuaacauggaggcucaguugauacggcagauggaaggugagggcguccucagcaaagccgaucuggaaaauccacaccuacccgagaagaaaauuacccaguggcuugaaacaaaggggguggagagacugaagaggauggcaaucucgggagacgauugcguggucaaaccuaucgacgaucgcuuugcuaacgcccuccuggcauugaacgacaugggcaagguucgaaaagauauuccacaauggcagccgucuaaggguuggcaugacuggcagcaggugcccuucuguagucaccauuuccacgaguuaauaaugaaagacgggcggaagcugguagugccuugcagaccacaagaugaacucaucggaagggcccgcauuucccagggcgcgggcuggagccuuagagagacggcuugucuggggaaggccuaugcacagauguggucacuaauguacuuucaccggagggaccugcgucucgccuccaaugcuaucugcucugccguccccgugcauuggguuccuaccagccgaacuacauggaguauucacgcacaucaccaauggaugaccacugaagauauguugacaguguggaaccgcgucuggaucgaggacaauccauggauggaagauaaaacccccgugacgacaugggaggacguaccuuaccugggaaagagagaggaucaguggugugguucccuuauaggccugaccagccgggcuacuugggcccagaacaucccgaccgcgauucagcaaguuaggucucucaucgggaaugaagaguucuuagacuauaugccaucaaugaaacgcuuuagaaaggaagaggagagugaaggagcuauuugguga

SEQ ID NO: 15633 - RNA, 9873 nt, Artificial Sequence
  derived and/or modified CDS sequence (opt3) from DENV-3__JQ920476__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaaacgcuucuagagcauggaaugucugggaaguggaggacuacgguuucgggguuuuuacuaccaacaucuggcuuaaauugagggaaauguauacgcagcucugugaccaccggcugaugucagccgcugugaaggaugagcgcgccguccacgcagacaugggauacuggauagagagucagaaaaauggcagcuggaagcuagaaaaggcgucccugaucgaggugaaaacaugcaccuggcccaagucucauacucucuggucgaacgguguucuggaaagcgauaugauuaucccuaaaucccuugccggcccaauuucacagcacaauuacagaccgggguaucauacccaaacagcuggacccuggcacuugggcaagcuggaguuagacuucaacuacugcgaggggacuaccgugguaaucacagaaaauuguggaacgaggggcccuagucuccguaccacuacagucucugguaaacugauacacgaguggugcugucggagcugcacccuuccaccccugcgauauaugggggaagauggauguugguacggcauggagauuagaccuaucaacgaaaaggaggagaauauggugaaguccuuggugucagccgguagcggcaaagcagacaacuuuacuauggggguccucugccuggcuauccuauucgaagagguuaugaggggaaaguucggcaaaaagcauaugauugccggggcacuguuuacauucgugcuccugcuuucuggacagaucaccuggcgcgauauggcccacacguugauuaugauaggcuccaaugcuagugaccggauggguauggggguaacuuaucuggcguuaaucgccaccuuuaaaauucagccauuccucgcacugggauuuuuccuuagaaagcugacaagcagggaaaaccuacuccugggcgugggcuuggcuauggccaccacucugcaauuacccgaggauaucgaacagauggccaaugggauugcucucggacugauggcacuuaagcugaucacacaguuugagaccuaccaguuguggacagcccucgucucucugauguguuccaacacuauauucacccuaacgguggcguggcgcacagcuacccugauccuugccguuauuucacuccugccggugugccaaaguagcucgaugcgaaaaacugacugguugccuaugaccgucgcagccaugggugugccaccccugccuuuauuuaucuucucccucaaggauacacugaaacggcguucuuggccccuuaaugagggcguuauggcuguggggcuggucagcauuuuggcaucaaguuuucucagaaacgacguaccaauggccggaccucugguggcgggcggucuacugaucgcuuguuauguuauaacugggaccuccgccgaucuuacgguggaaaaggcagccgacgucacaugggaggaagaggcugaacagaccggagugucucauaaccucaugauuacuguagacgaugacggcacaaugaggaucaaagaugacgagaccgagaauauccugacuguguuguuaaagacagcccugcucauugucagcggcauauuccccuacuccaucccagcaacccugcuuguuuggcacacguggcagaaacagacucaacgcucaggggugcugugggaugugccgagcccucccgaaacccagaaggcugaguuggaagagggagucuaccggauuaagcagcaggguaucuuuggcaaaacacaaguggggguuggaguacagaaggagggcguguuccauaccauguggcacgucacaagaggugccgugcuaacucacaacgggaaaaggcuggaaccaaauugggcgaacguuaagaaagaccucauuaguuauggaggcggcuggaagcugucugcccaguggcaaaagggggaggaagugcaggucaucgcaguggagcccggcaagaauccuaagaacuuccagaccaugccagguauauuucagacgacaacuggcgaaaucggggcuauugcccuugauuucaaacccggaaccuccggcagcccuaucauuaaucgagaggguaagguagucggguuauacggaaacggcgugguuaccaagaauggcggguaugugucgggaaucgcucaaaccaacgcagagccggacgguccaacucccgaacuggaggaagagauguuuaagaagcgcaaucucaccauaauggauuugcauccuggcucagggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaaucugagcacacuggcagggaaaucguggaccuaaugugccaugccacauucaccaugcgacugcucaguccgguccgggugcccaacuacaauuuaauaguaauggaugaggcacacuuuacggacccagccuccauugcugcgcgcgguuauaucagcacuagaguggggaugggagaagccgcagcuauuuucaugacagccaccccucccggcaccgcagaugccuuuccacagucuaacgcuccuauccaggacgaggagagggacauacccgaacggagcuggaacuccggcaacgaguggauuacugauuucgccgggaagacaguuugguuugucccaucaaucaaggcgggaaacgacaucgcaaauugucugagaaagaaugguaagaaagugauucaacuuaguagaaagaccuucgauacagaauaccagaaaacuaagcugaaugacugggauuuuguggucacgaccgacaucagcgagaugggcgccaacuucaaggcugaucgcguaauugacccgaggcguugccucaaaccugugauauugacagaugggcccgagcggguuauccuggccggaccaaugcccgugacugucgcuucugcagcccagagaaggggccgcgugggucgaaauccucagaaggaaaacgaccaauacauuuucaccgggcagccacucaauaacgaugaggaccaugcucacuggacagaagccaaaaugcugcuugacaauaucaacacccccgagggcaucauuccugcacuauuugaaccggagagagagaaguccgcggccauagauggagaauaucggcugaaaggcgagucaaggaagacuuucguugaauugaugcgccguggggacuuaccaguguggcuggcucacaaagucgccagugagggaaucaaguacacggauagaaaguggugcuuugacggugaacggaauaaccagauucucgaggagaauauggauguggaaaucuggaccaaagagggcgaaaagaaaaagcugaggccccgcuggcuugacgcacgaacauauagcgauccucuggcucucaaagaguucaaggacuuugccgcagggagaaaguccauugccuuggaucugguaacugaaaucggacgggugcccucucaucuagcucacaggacccgcaacgcgcuggacaaucucguuaugcuucauacaucggagcacggcgguagagccuacaggcacgcagucgaggaacugccagagaccauggaaacuuuauugcugcucgggcugaugauacuucugacaggcggagcuaugcuauucuugaucagcggcaaagggauuggaaagacgucaaucggucugauuugugugguggccuccaguggcauguuauggauggccgaugucccucuacaguggaucgcaucugcuauaguucuggaguuuuucaugauggugcuccuuauucccgagccagaaaaacaacggaccccucaggacaaccagcuggccuauguagugaucgggauuuugacucuggcggcuaucgucgccgcaaaugagaugggacuccuggaaacaaccaagcgugaucuuggcaugagcaaagaguccggugugguuucaccgaccucuuaccucgacguggaccugcaucccgccagcgcuuggacauuguaugcagucgccacuacgguaauaaccccaaugcugcgccacacaaucgaaaacaguacugcgaacguguccuuagcugccauugcaaaucaagccguugugcuaauggggcuggauaagggcuggccuaucagcaagauggaccucggagucccccuucuggcuuugggcugcuacucucaggugaacccacugacccucacagccgcaguccugcuuuuagugacccauuacgcuauuaucgggccuggacugcaggccaaagcgacucgagaggcccagaagagaacggcagcuggcauaaugaaaaaucccacaguugaugguauuaugaccaucgaccucgauccggugaucuaugacucaaaguuugagaaacaauuggggcagguaaugcugcuagugcugugugccguccagcuccuucugaugaggacuuccugggcauucugcgaagcucuaacccuggccacaggaccaauuacuacccucugggagggcaguccugguaaguuuuggaacacaacgaucgccguuagcauggcgaauauauuccggggcucguaccuggcuggggcaggauuagccuuuucuauuaugaaguccgugggcaccgggaaacgcggaacuggcagccagggugaaacacuuggggagaaguggaaaaagaaacugaaccaacucucaagaaaggaguucgaucuauauaaaaagaguggaaucaccgaggucgacaggacugaggcuaaggaaggccugaaacggggugagauuacacaccaugccgugucucgaggcuccgcaaaguugcagugguucguagaaagaaauauggugauccccgaggggcgcguuauagaucugggauguggcagagggggauggagcuacuauugcgccggccucaaaaaggugaccgaaguccgggguuacacgaaagggggaccaggccacgaggagcccgugccuaugucaaccuauggcuggaacaucgucaaacuuaugagugggaaggacguguuuuaccugccgcccgaaaaaugugauacauugcugugcgacauuggagagagcuccccaucuccuacuguugaagagagccguaccaucagaguacucaagaugguggagcccugguugaaaaauaaccaguucuguauuaagguccugaauccuuacaugccaacagugaucgaacaccuugagaggcugcagcgcaaacaugguggcaugcuaguucggaacccccucucccgaaauucaacucacgaaauguauuggauuucuaacgggaccggaaauaucgugaguucggucaacauggugagcagacuguugcugaacagguuuacaaugacccaucgccggccuacuauagagaaggauguagaccucggcgcugguacgagacacgugaaugcggaaccagagacacccaacauggacguuauuggggagcguaucaggcggaucaaggaagaacacuccucuaccuggcauuacgaugacgaaaauccguauaaaacuugggccuaccacggaucauaugaggucaaggcaaccggcagcgcuuccaguaugauuaacggcguggugaaacuucugacaaagccuugggaugucguuccaauggugacgcaaauggccaugaccgacacuacacccuucgggcagcagcgcguauuuaaagaaaagguggauacccgaacuccuagaccaaugcccggaacaaggaaggucauggagauaaccgcagagugguuauggcggacacugggucgcaauaaaagaccgagguugugcacucgagaagaguucaucaagaaagugcggaccaacgccgcuaugggcgccguuuuuacggaagagaaucaaugggacucugcgcgugcagccguggaagaugaggaguucuggaagcucgucgacagagaacgcgagcugcauaaacuagggaaguguggaagcugcguguacaacaugaugggcaaaagggaaaagaaacuuggugaguuugggaaagcuaagggaucacgggccauuugguauauguggcugggcgcaagauaccucgaguucgaagcucugggcuuuuugaaugaggaucacugguucucccgcgaaaacagucauagcgggguagagggagaaggucugcacaaacucggcuacauccuuagggacauuucuaagaucccugggggagccauguaugcugaugacaccgccggcugggacacacgaauaacugaggaugaccugcacaaugaggagaaaaucacccagcagauggaucccgagcaucggcaguuagcaaacgcgauuuuuaagcugacauaccaaaauaagguugugaaaguccagagaccaacuccuaaggguaccgugauggacaucauuuccaggaaagaucagcgcgggucaggacaggugggcacguauggcuugaacacauucaccaauauggaagcccaacucauccgucagauggagggggaaggaguccugagcaaggcugaccuagagaacccccaccuucuggagaaaaagguuacucaguggcucgaaacaaaggguguggagcggcugaaaagaauggccauaucgggcgaugacugcguagugaagccaauugaugacagguucgcaaacgcuuuguuagcccugaaugauauggggaaaguccgcaaggacaucccccaguggcaaccuucuaaaggauggcaugauuggcaacaggugccauuuuguagucaccacuuccaugaacucaucaugaaggacggccgaaaacuuguugugccgugccggccccaggacgagcugauugguagagcaaggauaucccaaggggccggauggagccuacgcgaaaccgcgugucugggcaaggcuuacgcccagaugugggcacucauguauuuucacagacgggauuugaggcuggccucaaacgcuaucugcuccgccgucccugugcauuggguaccaacuucucguaccacauggagcauucacgcacaucaccaguggaugacgaccgaggacaugcuuacuguuuggaaucgaguguggaucgaggauaaccccuggauggaagacaagacaccugucaccacuugggaggaugugccauaccugggcaaacgcgaagaccaauggugugggagucucauuggauuaacauccagagcuaccugggcccagaauauccugacggcgauacagcagguucggagcuugaucgguaacgaggaguuccuggauuauaugcccucuaugaagagguuucgcaaagaagaggaaucagagggcgcuauuugguga

SEQ ID NO: 15634 - RNA, 9873 nt, Artificial Sequence
  derived and/or modified CDS sequence (opt3) from DENV-3__JQ920477__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccaggacgcagacuuggauguccgcagagggggccuggaggcaggucgaaaagguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaagcccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcucuuagagcauggaacgucugggaaguggaggacuacgguuucgggguuuuuacuaccaauaucugguugaaacucagggaaaaguauacgcagcugugugaccaccggcuaaugucagccgcugugaaagaugagcgcgccguccacgcagacaugggauacuggauagagagucagaagaacggcagcuggaagcuggaaaaagcgucccucaucgaggugaagacaugcaccuggcccaaaucucauacucuguggucgaaugguguucuugaaagcgauaugauuaucccuaaguccuuggccggcccaauuucacagcacaacuacagaccgggguaucauacccaaacagcuggacccuggcaccugggcaaauuagagcucgacuucaauuacugcgaggggacuaccgugguaaucacagaaaacuguggaacgaggggcccuagucugcguaccacuacagucucugguaaacuuauacacgaguggugcugucggagcugcacccugccacccuugcgauauaugggggaagauggauguugguacggcauggagauuagaccuaucaaugaaaaggaggagaacauggugaaaucccucgugucagccgguagcggcaagacugacaauuuuacaauggggguccugugccuagcaauccuguucgaagagguuaugaggggaaaauucggcaagaaacauaugauugcuggggcccucuuuaccuucgugcugcuuuugucuggacagaucacguggcgcgauauggcacacacucugauuaugauaggcuccaacgccagugaccggauggguauggggguaaccuauuuagcucucaucgcgacauuuaagauucagccauuccuggcccuuggauuuuuccugagaaagcuaaccagcagggaaaaucuccuguugggcgugggccuggcaauggcuacuacauuacaacuccccgaggauaucgaacagauggccaacgggauugcccugggacuuauggcucugaaauugaucacccaguuugagacauaccagcucuggacugcacuggucucucuaauguguuccaauaccauauucacgcugacaguggccuggcgcaccgcgacucuuauccucgcuguuauuucacuguugccggugugccaaaguagcucgaugcgaaagaccgacuggcugccuaugacagucgccgcaaugggugugccacccuuaccucucuuuaucuucucccugaaagauacucuuaagcggcguucuuggccccugaacgagggcguuauggccgugggguuggucagcauucucgcuucaaguuuucugagaaaugacguaccaauggcaggaccucuaguggccggcggucugcuuaucgcguguuauguuauaaccgggacguccgcugaucucacaguggaaaaagccgcagacgucaccugggaggaagaggccgaacagacuggagugucucauaaccugaugauuacaguagacgaugacggcaccaugaggaucaaggaugacgagacugagaacaucuugacaguguuacugaaaaccgcucuccugauugucagcggcauauuccccuacuccaucccagccacgcuucugguuuggcacacuuggcagaagcagacccaacgcucagggguguugugggaugugccgagcccucccgaaacacagaaggcagagcuagaagagggagucuaccggauuaaacagcaggguaucuuuggcaagacccaaguggggguuggaguacagaaagagggcguguuccauacaauguggcacgucacuagaggugcugugcugacccacaaugggaagaggcucgaaccaaacugggccaauguuaaaaaggaccugauuaguuauggaggcggcuggaaacuuucugcgcaguggcaaaaaggggaggaagugcaggucaucgccguggagcccggaaagaacccuaaaaauuuccagacgaugccagguauauuucagacaacuaccggcgaaaucggggcaauugcuuuagauuucaagcccggaacauccggcagcccuaucauuaaccgagaggguaaaguagucgggcuguacggaaauggcgugguuaccaagaacggcggguaugugucgggaaucgcccaaacuaaugcugagccggacgguccaacccccgaacucgaggaagagauguuuaagaaacgcaacuugacaauaauggaucugcauccuggcucagggaagacgcggaaauaccucccagcaauugucagagaagccaucaagaggcgucugcgcacucuuauccuggcccccacccgggugguugcugcggagauggaggaagcauugaaaggacuaccuauuagauaucagacaaccgccacuaagucugagcacacaggcagggaaaucguggaccugaugugccaugcuaccuucacgaugcgacucuuaaguccgguccgggugcccaauuacaaccugauaguaauggaugaggcccacuuuacugacccagcauccauugccgcucgcgguuauaucagcacaagaguggggaugggagaagcggccgcaauuucuaugaccgcuaccccucccggcacugccgaugcauucccacagagcaaugccccuauccaggacgaggagagggacauacccgaacgguccuggaacucaggcaaugaguggauuacagauuuugcugggaagaccguuugguucgucccaaguaucaaagccggaaacgacaucgcgaacugucuucgaaagaaugguaaaaaggugauucaacugagcagaaaaacauuugauacugaauaccagaagacgaagcucaacgacugggauuucguggucaccacagacaucucugagaugggcgcaaauuuuaaagccgaucgcguaauugacccgaggcguugcuugaagccugugauacugacugaugggcccgagcggguuauccucgcuggaccaaugcccgugaccgucgccuccgcugcacagagaaggggccgcgugggucgaaacucacagaaagaaaaugaccaauacauuuucacagggcagccucugaacaaugaugaggaccaugcccacuggaccgaagcuaagaugcuucuagacaacaucaauacuccagagggcaucauucccgcccuguucgaaccugagagagagaaaagugcagcgauagauggagaauaucgguugaagggcgagagcaggaaaacguuuguugaauuaaugcgccguggggaccugccgguguggcucgcccacaaggucgcuuccgagggaaucaaguacaccgauagaaaauggugcuucgacggugaacggaacaaucagauucuggaggagaacauggauguggaaaucuggacaaaggagggcgagaagaagaaacuuaggccacgcuggcuggacgcccgaacuuauucugauccccucgcauugaaggaguuuaaggacuucgcugccgggagaaaaucgauugcacuggaucuaguaaccgaaaucggacgggugccuagccaucuggcccacaggacacgcaaugcucucgacaaccuuguuaugcugcauaccucagagcacggcgguagagcguacaggcacgccgucgaggaauuacccgagacuauggaaacauugcugcuccuggggcuuaugauacugcucacgggcggagcaauguuguuucugaucuccggcaaggggauuggaaaaaccaguaucgguuuaauuugugugguggcuucuagcggcaugcuauggauggccgaugucccacugcaguggaucgccuccgcaauaguucucgaguucuuuaugauggugcuucugauuccugagcccgaaaagcaacggacuccacaggacaaucaguuggcuuauguagugaucgggauucugacacucgccgcgaucgucgcugccaacgagaugggacugcuugaaaccaccaaacgugaucucggcaugucaaaggagccuggugugguuucuccgacaagcuaccuggacguggacuugcaucccgcaagugccuggacucuguaugcugucgcaacgaccguaauaacaccaauguuacgccacacuaucgaaaauuccaccgccaacgugagccuagcggcuauugccaaccaagcaguugugcugauggggcucgauaagggcuggccuaucucuaaaauggaccuuggagucccccuguuggcccugggcugcuacucacaggugaauccacucacacugaccgcugccguccuuuuacuggugacucauuacgcaauuaucgggccuggacuccaggcuaaggccacgcgagaggcgcagaaaagaacagccgcaggcauaaugaagaaccccaccguugaugguauuaugacuaucgacuuggauccggugaucuaugacuccaaauucgagaagcaacuggggcagguaaugcuacuggugcucugugcuguccagcuucuguugaugaggaccaguugggccuuuugcgaagcacugacacucgcuacuggaccaauuaccacacugugggagggcagcccugguaaguucuggaauacgaccaucgccguuucgauggccaacauauuucggggcucuuacuuagcgggggcuggacuugcauucuccauuaugaaaagcgugggcacugggaagcgcggaacaggcucacagggugaaacccugggggagaaauggaagaaaaagcucaaucaacuaaguagaaaagaauuugaucuguauaagaagucuggaaucacugaggucgacaggacagaggccaaagaaggcuugaagcggggugagauuacccaccaugcugugucccgaggcagcgccaaacugcagugguucguagaaagaaacauggugauccccgaggggcgcguuauagaucucggauguggcagagggggauggucauacuauugcgcaggccuuaagaaagugacggaaguccgggguuacaccaaagggggaccaggccacgaggagcccgugccuaugaguacauauggcuggaauaucgucaagcugaugagcgggaaagacguguucuacuugccgcccgaaaagugugauacucugcucugcgacauuggagaguccucuccaagcccuaccguugaagagucccguacaaucagaguauuaaaaaugguggagcccuggcugaagaacaaucaguuuuguauuaaaguccuuaacccuuacaugccaacugugaucgaacaccuggagaggcuacagcgcaagcaugguggcaugcucguucggaauccccugucacgaaacucuacccacgaaauguauuggauuaguaaugggacaggaaacaucgugucgagcgucaauaugguguccagauugcugcucaacagguucaccaugacucaucgccggccuacgauagagaaggauguagaccuuggcgccgguacaagacacgugaacgcugaaccagagacccccaauauggacguuauuggggagcguaucaggcggaucaaagaggaacacucuucaacuuggcauuacgaugacgaaaacccguauaagaccugggcguaccacggaagcuaugaggucaaagccacaggcuccgcaaguucuaugauuaauggcguggugaagcuguuaacgaaaccuugggaugucguuccaauggugacccaaauggcuaugacugacacaacccccuuugggcagcagcgcguauucaaggaaaagguggauacucgaacaccuagaccaaugcccggaaccaggaaagucauggagauaacagccgaguggcuguggcggacuuugggucgcaacaagagaccgaggcucugcacccgagaagaguuuaucaaaaaggugcggacgaaugcagccaugggcgcuguuuucaccgaagagaaccaaugggacagcgcccgugcggcaguggaagaugaggaguuuuggaaacuggucgacagagaacgcgagcuacauaaacuugggaaauguggaucaugcguguacaauaugaugggcaagagggaaaagaaacugggugaguucgggaaggccaaaggaucccgggcuauuugguauauguggcucggcgccagauaccuggaguuugaagcauugggcuuccugaacgaggaucacugguuuagucgcgaaaauagccauucugggguagagggagaaggucuccacaaacuuggcuacauccugagggacauuuccaaaaucccugggggagcuauguaugccgaugacacagcuggcugggacacucgaauaaccgaggaugacuuacacaacgaggaaaagaucacacagcagauggaucccgagcaucggcagcuggccaaugcaauuuucaaguugacuuaccaaaacaaaguugugaagguccagagaccaaccccuaaagguacggugauggacaucauuucaaggaaggaucagcgcgggagcggacaggugggcacauauggccucaauaccuuuacuaacauggaagcgcaacugauccgucagauggagggggaaggaguccuaucgaaagccgaccuugagaauccccaucugcucgagaagaagguuacacaguggcuggaaaccaaagguguggagcgguugaagagaauggcuauaucuggcgaugacugcguagugaaaccaauugaugacagguucgccaacgcauuacuggcucucaacgauauggggaagguccgcaaagacaucccccaguggcaaccuaguaagggauggcaugauuggcaacaggugccauucuguucccaccacuuucaugaacuuaucaugaaggacggccgaaaacugguugugccgugccggccccaggacgagcuaauugguagagccaggauaagccaaggggcaggauggucacugcgcgaaacugccugucucggcaaggcguacgcucagaugugggccuugauguauuuccacagacgggaucugaggcuugcauccaaugccaucugcucugcugucccugugcauuggguaccaaccagccguacaacguggaguauucacgcccaucaccaguggaugaccacugaggacaugcugacaguuuggaaccgaguguggaucgaggauaaucccuggauggaagacaaaaccccugucacuacaugggaggaugugccauaccucggcaagcgcgaagaccaaugguguggguccuuaauuggacugaccagcagagcaacgugggcucagaacaucuugacagccauacagcagguucggucucugaucgguaaugaggaguuucucgauuauaugcccucaaugaaaagguuccgcaaggaagaggaaagugagggcgcgauuugguga

SEQ ID NO: 15635 - RNA, 9873 nt, Artificial Sequence
  derived and/or modified CDS sequence (opt3) from DENV-3__JQ920478__SS-prME
accagccugugccucaugaugaugcuucccgccacccuggcuuuccacuugacuuccagagacggcgaaccuaggaugaucguggggaagaacgaacggggaaaaucuuuacuguuuaagacggccucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaaguagggggacuagcauuuuugcaggacaucugaaaugucgguuaaagauggacaaacuggagcuaaaggguaugucuuaugccaugugccucaaugcuuucgugcugaaaaaggaggucuccgaaacccagcacggcacgauacuuaucaagguggaguacaaaggggaagaugcgccauguaagauucccuucucaaccgaggacggacaaggcaaagcacauaacggucguuugaucacagccaacccuauaguuacuaagaaagaggaaccagugaauauugaggcugaacccccguuuggggagagcaacaucguaaucggcauuggagauaaggcccugaagaucaauugguacaaaaagggcaguucuauugggaaaauguucgaagcaaccgcccgcggagcuagaaggauggccauacucggugacacagcaugggauuuuggcuccgucgggggagugcugaacagccuuggcaagaugguucaccagaucuucgguucggcguauacugcucuguuuucugggguguccuggauuaugaaaaucggcaucggagucuugcucaccuggauuggccuaaauucaaagaacacgaguaugagcuucuccugcauagugaucgggauuaucacauuauaccugggagccguagugcaggcagacaugggcuguguuauuaauuggaaggguaaagagcuaaagugcgggucuggaaucuuugucaccaacgaggugcauacuuggacagaacaguauaaauuccaagccgauagcccuaagcggcucgcuaccgccauagcaggcgcuugggagaaugguguguguggcauccgaucaacuacccgcauggaaaaccugcuuuggaaacagauugccaaugaguugaacuacauccugugggaaaauaacauuaagcucacaaucgucguuggggacgugauaggagugcuggagcagggcaaaagaacguuaacaccccagccaauggagcugaaguauaguuggaagacuugggggaaagcgaagauuguaacagccgaaacccaaaauuccagcuuuaucauugauggaccuaacacacccgagugcccaucugcucuuagggcauggaacgucugggaaguggaggacuacggcuucgguguuuuuacuaccaauaucugguugaaacuccgggaaaaguauacgcagcugugugaccaccgccuaaugucagccgcugugaaagaugagagagccguccacgcagacaugggguacuggauagagagucagaagaacggaagcuggaagcuggaaaaagcgucccucaucgaggugaagacaugcaccuggcccaaaucucauacucuguggucgaauggcguucuugaaagcgauaugauuaucccuaaguccuuggccgguccaauuucacagcacaacuacaggccgggcuaucauacccaaacagcugggcccuggcaccugggaaaauuagagcucgacuucaauuacugcgagggcacuaccgugguaaucacagaaaacugugggacgcguggaccuagucugcggaccacuacagucucuggcaaacuuauacacgaguggugcugucgaagcugcacccugccacccuugagauauaugggugaagauggguguugguacggaauggagauuaggccuaucaaugaaaaggaggagaacauggugaaaucccucgugucagccggcagcgguaagacugacaauuuuacaaugggcguccugugccuagcaauccuguucgaagagguuaugcgcgggaaauucggaaagaaacauaugauugcuggcgcccucuuuaccuucgugcugcuuuugucugggcagaucacguggcgggauauggcacacacucugauuaugauaggauccaacgccagugacagaaugggcauggguguaaccuauuuagcucucaucgcgacauuuaagauucagccauuccuggcccuuggguuuuuccugaggaagcuaaccagccgcgaaaaucuccuguugggagugggccuggcaauggcuacuacauuacaacuccccgaggauaucgaacagauggccaacggcauugcccuggggcuuauggcucugaaauugaucacccaguuugagacauaccagcucuggacugcacugauaucucuaauguguuccaauaccaucuucacgcugacagucgccuggcgaaccgcgacucuuauucucgcugugaucucacuguugccgguuugccaaaguagcucgaugcggaagaccgacuggcugccuaugacaguggccgcaaugggagucccacccuuaccucucuuuauuuucucccugaaagauacucuuaagcguagaucuuggccccugaacgagggugugauggccguuggcuuggugagcauccucgcuucaaguuuucugaggaaugacgucccaauggcagggccucuaguagccggaggccugcuuauagcguguuaugugauuaccgguacguccgcugaucucacaguugaaaaagccgcagacgugaccugggaggaagaggccgaacagacuggggucucucauaaccugaugaucacaguggacgaugacggaaccaugcgcaucaaggaugacgagacugagaacauuuugacaguauuacugaaaaccgcucuccugauagugagcggcaucuuccccuacuccauuccagccacgcuucuggucuggcacacuuggcagaagcagacccaacggucaggcguuuugugggaugugccgagcccucccgaaacacagaaggcagagcuagaagaggggguguacagaaucaaacagcagggaauuuuugguaagacccaagucggcguggggguucagaaagagggaguauuccauacaauguggcacgugacuaggggcgcuguccugacccacaaugguaagcgacucgaaccaaacugggccaaugugaaaaaggaccugaucaguuaugggggaggcuggaaacuuucugcgcaguggcaaaaaggcgaggaaguucaggugauagccgucgagcccgggaagaacccuaaaaauuuccagacgaugccaggaaucuuucagacaacuaccggugaaauuggcgcaaucgcuuuagauuucaagcccgggacauccggaagcccuauuaucaaccgcgagggcaaagugguaggucuguacgggaauggagucgugaccaagaacggcggcuauguuucggggauagcccaaacuaaugcugagccggacggaccaacccccgaacucgaggaagagauguuuaagaaacggaacuugacaauuauggaucugcauccugguucaggcaagacgagaaaauaccucccagcaaucgugagggaagccaucaagcgucgccugcggacucuuauucuggcccccaccagagucguggcugcggagauggaggaagcauugaaagggcuaccuaucagguaucagacaaccgccacuaagucugagcacacaggacgagaaauaguugaccugaugugccaugcuaccuucacgaugcggcucuuaaguccggugcgcguccccaauuacaaccugauugugauggaugaggcccacuuuacugacccagcauccaucgccgcuagaggcuauauuagcacaaggguagguaugggggaagcggccgcaaucuucaugaccgcuaccccucccggaacugccgaugcauuuccacagucuaaugccccuauacaggacgaggagcgggacauucccgaacgaagcuggaacuccggcaaugaguggaucacagauuucgcuggcaagaccgugugguuuguuccaucaaucaaagccgggaacgacauugcgaacugucuuagaaagaauggcaaaaaggucauccaacugagucgcaaaacauucgauacugaauaccagaagacgaagcucaacgacugggauuuuguggugaccacagacauuagcgagaugggugcaaauuucaaagccgauagggucauagacccgcgucggugcuugaagccuguaauccugacugauggccccgagagagugauucucgcugggccaaugcccguuaccguggccucugcugcacagaggcgcggacgagucggcagaaacucccagaaagaaaaugaccaauacaucuucacaggucagccucugaacaaugaugaggaccaugcccacuggaccgaagcuaagaugcuucuagacaacaucaauacuccagaggggauuauacccgcccuguuugaaccugagcgggagaaaucagcagcgaucgauggcgaauauagguugaagggagagagucgcaaaacguucguggaauuaaugcguagaggcgaccugccgguuuggcucgcccacaagguggcuagcgaggggauuaaguacaccgaucggaaauggugcuuugacggagaaaggaacaaucagauccuggaggagaacauggaugucgaaauuuggacaaaggagggugagaaaaagaaacuucgcccacgauggcuggacgccagaacuuauuccgauccccucgcauugaaggaguucaaggacuuugcugccggccggaaaucuaucgcacuggaucuagugaccgaaauagggaggguaccuucgcaucuggcccaccgcacaagaaaugcucucgacaaccuugugaugcugcauaccagcgagcacggaggcagggcguaccggcacgccguugaggaauuacccgagacuauggaaacauugcugcuccugggucuuaugauccugcucaccgggggagcaauguuguuccugauuucaggaaagggcaucgggaaaacguccauuggauuaaucugugucguggcuaguucugguaugcuauggauggccgaugugccacugcaguggauagccagcgcaauuguccucgaguuuuucaugaugguucuucugaucccugagcccgaaaagcaacguacuccacaggacaaucaguuggcuuaugugguaauuggcauccugacacucgccgcgauaguggcugccaacgagauggggcugcuugaaaccaccaaacgcgaucucggaauguccaaggagccuggcgucgugucaccgacaucuuaccuggacguugacuugcaucccgcaagcgccuggacucuguaugcuguggcaacgaccgucaucacaccaauguuacgacacacuauugaaaauaguaccgccaacguaucccuagcggcuaucgccaaccaagcagugguucugaugggucucgauaagggguggccuauuagcaaaauggaccuuggcgugccccuguuggcccugggaugcuacucucaggucaauccacucacacugaccgcugccgugcuuuuacuggucacucauuacgcaaucauaggcccugggcuccaggcuaaggccacgagagaggcgcagaaaaggacagccgcaggaauuaugaagaaccccaccguggauggcaucaugacuaucgacuuggauccgguuauuuaugacucaaaauuugagaagcaacugggucaggugaugcuacugguacucugugcugugcagcuucuguugaugcggaccuccugggccuucugcgaagcacugacacucgcuacugggccaaucaccacacugugggagggaaguccuggcaaguuuuggaauacgaccauagccgucagcauggccaacauuuuccgcgguucguacuuagcgggcgcugggcuugcauuuucuaucaugaaauccguuggaacuggcaagagagggacaggaagccagggcgaaacccugggugagaaauggaagaaaaagcucaaucaacuaucaaggaaagaguucgaucuguauaagaagagugggauuacugagguggaccggacagaggccaaagaaggauugaagcgaggcgagaucacccaccaugcugucucuagagguuccgccaaacugcagugguucguggaacgcaacaugguaauacccgagggcagggugaucgaucucggguguggacggggcggguggagcuacuauugcgcaggacuuaagaaaguuacggaagugcguggcuacaccaagggugggccaggacacgaggagcccgucccuaugucaacauauggcuggaauauugugaagcugaugaguggcaaagacgucuuuuacuugccgcccgaaaagugugauacucugcucugcgacaucggggagagcuccccaucuccuaccguggaagagagcagaacaauuaggguuuuaaaaaugguagagcccuggcugaagaacaaucaguucuguaucaaagugcuuaacccuuacaugccaacugucauugaacaccuggagcgccuacagcggaagcauggagguaugcucgugcgaaauccccuguccagaaacucaacccacgaaauguauuggaucucuaauggcacagggaacauaguuaguucggugaauauggucagcagguugcugcucaaccgcuuuaccaugacucaucggagaccuacgauugagaaggauguggaccuuggagccggcacacgucacguaaacgcugaaccagagacccccaauauggacgugaucggugagaggauccggcgcauuaaagaagaacacuccucuacuuggcauuacgaugacgaaaacccguauaagaccugggcguaccacgggucauaugagguuaaagccacaggaagcgcauccaguaugauaaauggcgucgugaagcuguuaacgaaaccuugggaucuggugccaauggucacccaaauggcuaugacugacacaacccccuucggccagcagcgaguuuuuaaggaaaagguggauacuagaacaccuaggccaaugcccgggacccggaaaguaauggagaucacagccgagugguuguggcgcacucucggaagaaacaagaggccgcgacugugcacccgggaagaguucauuaaaaaggugcguacgaaugcagccaugggugcugucuuuaccgaagagaaccaaugggacucugccagagcggcaguggaagaugaggaguucuggaagcugguugaccgcgaaagggagcuucauaagcugggcaaaugugggagcugcguguacaauaugaugggaaagcgggaaaagaaacucggcgaguuugguaaggccaaagggucaagagcuaucugguauauguggcugggagcccgcuacuuggaguucgaagcacugggcuuucucaacgaggaucacugguucuccagggaaaauagucauagcggcgucgagggggaaggacuucacaagcuggguuacauuuuacgagacaucucuaaaauaccuggcggggcuauguaugccgaugacacagcuggaugggacacucggaucaccgaggaugaccugcacaacgaggaaaagauuacacagcagauggaucccgagcauagacaguuggccaaugcaaucuuuaagcucacuuaccaaaacaaagugguaaagguucagaggccaaccccuaaaggcacggugauggacauuaucucccgcaaggaucagcgugguucagggcaggucggaacauauggccugaauaccuucacuaacauggaagcgcaacuaauacggcagauggagggcgaaggggugcuuagcaaagccgaccuggagaauccccaccuccuggagaagaaggugacacagugguuggaaaccaaaggagucgagagauuaaagaggauggcuauuucgggugaugacugcguugugaaaccaaucgaugaccgcuucgccaacgcacugcucgcucuuaacgauaugggcaagguacgaaaagacaucccccaguggcaaccuucuaagggguggcaugauuggcaacaggugccauuuuguagucaccacuuccaugaacugauuaugaaggacggacggaagcuagucgugccgugcagaccccaggacgagcugauaggcagggcccgcaucucccaaggugcaggguggagccucagagaaacugccuguuugggaaaggcguacgcucagaugugggcccugauguauuuucaccggagggaucuucgucuggcaucaaaugccauuugcuccgcuguuccugugcauugggucccaaccucucgaacaacguggagcauccacgcccaucaccaguggaugaccacugaggacaugcucacaguguggaaccgcguauggauugaggauaaucccuggauggaagacaaaaccccuguuacuacaugggaggaugugccauacuuaggcaagagagaagaccaaugguguggcagucugaucggguugaccucccgggcaacgugggcucagaacauacugacagccauccagcaggucaggagccucauuggaaaugaggaguuccuugauuauaugcccucuaugaaacgcuuuagaaaggaagaggaaucagagggugcgaucugguga

SEQ ID NO: 15636 - RNA, 9873 nt, Artificial Sequence
  derived and/or modified CDS sequence (opt3) from DENV-3__JQ920480__SS-prME
accagccugugccucaugaugaugcuucccgccacccuggcuuuccacuugacuuccagagacggcgagccuaggaugaucguggggaagaacgaacggggaaaaucuuuacuguuuaagacggcaucagguauuaauauguguacccuaauugccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugacuacggaacccuuggccuggaaugcagcccacgaacugguuuggauuuuaaugagaugauccuacugaccaugaaaaacaaggcguggauggugcauagacagugguuccucgaccugccgcuucccuggacauccggggccaccacugagacaccuacguggaauaaaaaggaacuguugguaaccuuuaaaaacgcacacgcuaagaagcaagagguugugguccucggcucacaggaaggagccaugcacacugcucugacaggcgccaccgagauccagacaagugggggaacuagcauuuucgcaggucauuuaaaauguaggcugaagauggauaaacuagaacucaagggcaugucuuaugccaugugccugaaugcuuuugugcuuaaaaaggaggucuccgagacccagcacgggacgauauugaucaagguggaauacaaaggagaggacgcgccauguaagauucccuucucaaccgaagauggccaagguaaagcacauaacgggcggcugaucacagccaacccuauaguuacuaagaaagaggagccagugaauauugaagcugagcccccguucggcgaaagcaacaucguaaucggaauuggcgacaaggcccucaagaucaauugguacaaaaaggggaguucuauuggaaaaauguuugaggcaaccgcccguggugcucgcagaauggccauacugggcgauacagcaugggacuucggguccgucggaggcgugcuuaacagccuggguaagaugguucaccagaucuuugggucggcguauacugcuuuguucucuggcguguccuggauuaugaaaaucggaaucggcguccuccugaccuggauuggguuaaauucaaagaacacgaguaugagcuuuuccugcauagugaucggaauuaucacacuguaccuaggcgccguagugcaggcagauauggguuguguuauuaauuggaaggggaaagaacucaagugcggaucuggcaucuucgucaccaacgaggugcauacuuggacagagcaguauaaauuucaagccgacagcccuaagaggcuggcuaccgccauagccggugcuugggaaaauggcgugugugggauccggucaacuacccgaauggagaaccuuuuguggaaacagauugccaaugaacugaacuacauccucugggagaauaacauuaagcugacaaucgucguuggagaugugauaggcguguuagaacaggggaaacgcacgcugacaccccagccaauggagcuuaaguauaguuggaagacuuggggaaaagcgaagauuguaacagccgagacccaaaauuccagcuucaucauugacggcccuaacacacccgaaugcccaucugcuuugagagcauggaacgucugggagguggaagacuacgguuuugggguuuucacuaccaauaucuggcucaaacugagggagaaguauacgcagcuaugugaucaccggcugaugucagccgcugugaaagacgaacgcgccguccacgcagauaugggauacuggauagagagucagaagaacgagagcuggaagcucgaaaaagcgucccugaucgaggugaagacaugcaccuggcccaaaucucauacucuuuggucgaauggcguuuuggaaagcgacaugauuaucccuaagucccuggccgguccaauuucacagcacaacuacagaccgggcuaucauacccaaacagcugggcccuggcacuuaggaaaacucgagcuggauuuuaauuacugcgagggcacuaccgugguaaucacagaaaacugugggacgaggggaccuagucuucguaccacuacagucucuggcaagcugauacacgaguggugcugucggagcugcaccuugccaccccuccgauauaugggugaagacggguguugguacggaauggagauuagaccuaucaaugaaaaggaggagaacauggugaaaucccuggugucagccggcagcgguaagacugauaauuucacaaugggcguccuaugccuggcaauccucuuugaagagguuaugagggggaaauucggaaagaaacauaugauugcuggcgcccuguucauguuugugcuuuugcugucugggcagaucaccuggcgcgacaugguacacacguuaauuaugauaggauccaacgcaagugaucggaugggcaugggugugacuuaucucgcccugaucgcuaccuucaagauucagccauuucuugcgcugggguucuuucuaagaaagcucacaagcagggaaaaucuguugcugggagucggcuuagccauggcaaccacucuccaacugcccgaggacaucgaacagauggcuaacggcauugcccuugggcugauggccuugaaacucaucacacaguucgagaccuaccagcuguggacagcucuaauaucucugauguguuccaauacuaucuuuacccuuacgguggcauggcgcacagccacccucauucuggcgguuaucucauugcugccggugugccaaaguagcucgaugcgaaagacugauugguuaccuaugaccgucgcugccaugggagugccaccccucccucuguucauauuuucccuuaaagacacacugaagcggcguucuuggcccuugaacgaggguguuauggcagugggccucgucagcauccuggccucaaguuuccuaagaaaugauguaccaauggcugggccucugguggcaggaggccuucucauagccuguuauguuauuacugguaccuccgcggaccugacgguggaaaaagcugccgacgucacaugggaggaagaggcagaacagaccggggugucucauaacuugaugaucacuguagaugacgauggaacaaugaggaucaaggacgaugagaccgagaacauuuuaacugugcugcucaaaacagcccugcuuauagucagcggcaucuuucccuacuccauuccagcuacccuguugguuuggcacacguggcagaagcagacucaacgcucaggcgugcuaugggacgugccgagcccucccgaaacccagaaggccgagcuggaagagggggucuaccggaucaaacagcagggaauuuucgguaagacacaagugggcguugggguacagaaagagggaguguuucauaccauguggcacgucacaagaggcgcagugcucacucacaaugguaagaggcuggaaccaaacugggcuaauguuaaaaaggaucuuaucaguuaugggggaggcuggaaguuaucugcccaguggcaaaaaggcgaggaagugcaggucauagcgguggagcccgggaagaacccuaaaaauuuccagaccaugccaggaaucuuccagacgacaacuggugaaauuggcgccaucgcacuggacuuuaagcccgggaccuccggaagcccuauuaucaaccgagagggcaaaguagucggucucuacgggaauggagugguuacaaagaacggcggcuaugugucggggauagcucaaaccaaugccgagccggauggaccaacucccgaauuggaggaagagauguucaagaaacgcaaccugaccauuauggaccuccauccugguucaggcaagacacggaaauaccugccagcuaucgucagagaagcaaucaagaggcgucuucgcacgcugauuuuggcccccacucgggugguugccgcugagauggaggaagcgcuaaaagggcugccuaucagauaucagaccacagcaaccaagucugagcacacuggaagggaaauaguggaucucaugugccaugccacauuuaccaugcgauuacugaguccgguccgggugcccaauuacaaccuuauuguaauggacgaggcucacuucacggauccagccuccaucgcagcccgcggcuauauuagcacuagaguggguaugggggaagcugcggccaucuuuaugacagcaaccccucccggaaccgcugacgccuucccacagucuaaugcaccuauacaggacgaggagagggauauucccgaacggagcuggaacuccggcaaugaguggaucacugacuuugccggcaagacaguuugguucgucccaucaaucaaagcugggaacgauauugccaacugucugcgaaagaaugggaagaaagugauccaacucaguagaaaaaccuuugacacagaauaccagaaaacuaaguugaacgauugggacuucguggucacgaccgauauuagcgagaugggugcgaauuuuaaagcagaccgcguaauagauccgaggcguugccugaagccugugauccucacagacggccccgagcggguuauucuggccgggccaaugcccgugacugucgcuucugccgcucagagaaggggacgcgugggccgaaacucccagaaagaaaaugaucaauacaucuucaccggucagccucuuaacaaugacgaggaccaugcacacuggacagaagccaagaugcuacuggauaacaucaauaccccagaggggauuauacccgcuuuguucgaaccugagagagagaaaucagccgcaaucgacggcgaauaucgguuaaagggagagaguaggaaaacuuuuguugaacugaugcgccguggcgaucucccgguguggcuggcgcacaaggucgccagcgaggggauuaaguacacggacagaaaauggugcuucgauggagaacggaacaaucagauccuugaggagaacauggacguggaaauuuggaccaaggagggugagaaaaagaaacugaggccacgcuggcucgaugcucgaacauauuccgaccccuuggcccugaaagaguuuaaggauuucgcagcuggcagaaaaucuaucgcccuagaccugguaacugaaauagggcgggugccuucgcaucucgcacacaggacccgcaaugcccuugauaaccugguuauguuacauacaagcgagcacggaggcagagcuuacaggcacgcggucgaggaauugcccgagaccauggaaacucugcuccugcuuggucugaugauccucuugacagggggcgccaugcuguuuuuaauuucaggaaagggcaucgggaaaacguccauuggacuaaucugugugguggcaaguucugguaugcuguggauggcugacgucccacuccaguggauagccagcgccauuguucuugaguucuuuaugauggugcuguugaucccugagcccgaaaagcaacggaccccacaggauaaucagcuggcauauguagugauuggcauccucacucuggcugccauagucgcggcuaacgagauggggcuucucgaaacaaccaaacgugaccugggaauguccaaggagccuggcgugguuucaccgaccucuuacuuggacguggaucugcaucccgccagcgcauggacauuauaugccgucgcuacuacgguaaucaccccaaugcuacgccacacaauugaaaauaguacugcaaacgugucccuggccgcgaucgcuaaccaagccguugugcucaugggucuugacaagggguggccuauuagcaaaauggaucugggcguccccuugcuggcacucggaugcuacucucaggugaauccacugacccuuacagccgcugucuuacugcucgugacccauuacgccaucauaggcccuggguugcaggcaaaggcuacucgagaggcccagaaaagaacggcggccggaauuaugaagaaccccacaguugacggcaucaugaccaucgaucuggacccggugauuuaugauucaaaauucgagaagcaacuaggucagguaaugcugcucgugcuuugugcaguccagcuguugcugaugaggacuuccugggcuuuuugcgaagcccucacccuggcaacagggccaaucacuaccuuaugggagggaaguccuggcaaguucuggaauacaacgauagcuguuagcauggccaacauuuuucgggguucguaccuugccggcgcggggcuggcuuucucuaucaugaaauccgugggaaccggcaagcgcgggacuggaagccagggcgaaacacucggugagaaauggaagaaaaagcuaaaucaacugucaagaaaagaauuugacuuguauaagaagagugggauuaccgaggucgauaggacugaggcaaaagaaggacugaagcggggcgagaucacacaccaugccgugucucgagguuccgcuaaacuccagugguucguagaaagaaacauggugauacccgagggccgcguuaucgaccuuggguguggaaggggcggguggagcuacuauugcgccggacugaagaaagugaccgaaguccggggcuacacgaagggugggccaggacacgaggagcccgugccuaugucaaccuauggcuggaauauugucaaguugaugaguggcaaagauguguucuaccugccgcccgaaaagugugacacacucuuaugcgauaucggggagagcuccccaucuccuacuguugaagagagccguaccauuagaguacugaaaaugguggagcccuggcuuaagaacaaucaguuuuguaucaaaguccugaacccuuacaugccaacagugauugaacaccuagagaggcuccagcgcaagcauggagguaugcugguucggaaucccuugucccgaaacucaacucacgaaauguauuggaucucuaauggcaccgggaacauagugaguucggucaauauggugagcagacugcuccuuaacagguucacaaugacccaucgccggccuacuauugagaaggacguagaccugggagcaggcacgagacacgugaacgccgaaccagagacacccaauauggauguuaucggugagcguaucaggcggauuaaagaagaacacuccucuaccuggcauuacgacgaugaaaacccguauaagacuugggcuuaccacgggucauaugaggucaaagcgaccggaagcgccuccaguaugauaaauggcguggugaaguuacugacaaaaccuugggacgucguuccaauggugacgcaaauggcaaugaccgauacuacacccuuuggccagcagcgcguauucaaggaaaagguggacacccgaacuccuagaccaaugcccgggacaaggaaagucauggagaucaccgcugagugguuguggcggacacucggacgcaacaagagaccgaggcugugcacucgagaagaguuuauuaaaaaggugcggaccaaugccgcaaugggugccguuuucacggaagagaaccaaugggauucugcucgugccgcgguggaagacgaggaguuuuggaagcuagucgauagagaacgcgagcuucauaagcugggcaaaugugggagcugcguguacaauaugaugggaaagagggaaaagaaacucggcgaguucgguaaggcaaaagggucacgggccaucugguauauguggcugggagcuagauacuuggaguuugaagcccugggcuuccucaacgaggaccacugguuuucccgcgaaaauagucauagcggcguagagggggaaggacuucacaagcuggguuacauuuuaagggauaucucuaaaauaccuggcggggcaauguaugcugacgacaccgccggaugggauacacgaaucacugaggacgaucugcacaacgaggaaaagauuacccagcagauggaccccgagcaucggcaguuggcuaaugccaucuucaagcucacauaccaaaacaaaguugugaagguccagagaccaacuccuaaaggcaccgugauggauauuaucuccaggaaggaccagcgcgguucaggacaggugggaacguauggccugaauacauuuaccaacauggaagcacaacuaauacgucagauggagggcgaagggguccuuagcaaagcggaucuggagaauccccaccuccuggagaagaagguuacucagugguuggaaacaaaaggaguggagcgguuaaagagaauggccauuucgggugacgauugcguagugaaaccaaucgacgauagguucgcuaacgcccugcucgcacuuaacgacaugggcaagguccgcaaagauaucccccaguggcaaccuucuaagggguggcaugacuggcaacaggugccauucuguagucaccacuuucaugaacugauuaugaaggacggacgaaagcuaguugugccgugccggccccaggaugagcugauaggcagagcuaggaucucccaaggugccggguggagccuccgcgaaaccgcauguuugggaaaggccuacgcgcagaugugggcucugauguauuuccacagacgggaccuuaggcuggccucaaaugcaauuugcuccgccgucccugugcauuggguaccaacuucucguaccacauggagcauccacgcucaucaccaguggaugacgaccgaggauaugcucacuguuuggaaccgaguguggauugaggacaaucccuggauggaagauaaaacaccugucaccacuugggaggacgugccauacuuaggcaagcgcgaagaucaaugguguggcagucugaucggguugacauccagagccaccugggcacagaacauacugacggcuauccagcagguucggagccucauuggaaaugaggaguuucuugacuauaugcccucuaugaaaagguuccgcaaggaagaggaaucagagggugccaucugguga

SEQ ID NO: 15637 - RNA, 9873 nt, Artificial Sequence
  derived and/or modified CDS sequence (opt3) from DENV-3__JQ920479__SS-prME
accagccugugccucaugaugaugcuucccgccacccuggcuuuccacuugacuuccagagacggcgagccuaggaugaucguggggaaaaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguuccucgaucugccgcuucccuggacauccggggccaccacugaaacaccuacguggaauaaaaaggagcuguugguaaccuuuaaaaacgcacacgcuaagaagcaagaaguugugguccucggcucacaggagggagccaugcacacugcucugacaggcgccaccgaaauccagacaagugggggaacuagcauuuucgcaggucauuuaaaauguaggcugaagauggacaaacuagagcucaagggcaugucuuaugccaugugccugaaugcuuuugugcuuaaaaaggaggucuccgaaacccagcacgggacgauauugaucaagguggaguacaaaggagaagaugcgccauguaagauucccuucucaaccgaggacggccaagguaaagcacauaacgggcggcugaucacagccaacccuauaguuacuaagaaagaggaaccagugaauauugaggcugaacccccguucggcgagagcaacaucguaaucggaauuggcgauaaggcccucaagaucaauugguacaaaaaggggaguucuauuggaaaaauguuugaagcaaccgcccguggugcucgcagaauggccauacugggcgacacagcaugggauuucggguccgucggaggcgugcuuaacagccuggguaagaugguucaccagaucuuugggucggcguauacugcuuuguucucuggcguguccuggauuaugaaaaucggaaucggcguccuccugaccuggauuggguuaaauucaaagaacacgaguaugagcuuuuccugcauagugaucggaauuaucacacuguaccuaggcgccguagugcaggcagacauggguuguguuauuaauuggaaggggaaagagcucaagugcggaucuggcaucuucgucaccaacgaggugcauacuuggacagaacaguauaaauuucaagccgauagcccuaagaggcuggcuaccgccauagccggugcuugggagaauggcgugugugggauccggucaacuacccgaauggaaaaccuuuuguggaaacagauugccaaugagcugaacuacauccucugggaaaauaacauuaagcugacaaucgucguuggagacgugauaggcguguuagagcaggggaaacgcacgcugacaccccagccaauggagcuuaaguauaguuggaagacuuggggaaaagcgaagauuguaacagccgaaacccaaaauuccagcuucaucauugauggcccuaacacacccgagugcccaucugcuuugagagcauggaacgucugggaaguggaggacuacgguuuugggguuuucacuaccaauaucuggcucaaacugagggaaaaguauacgcagcuaugugaccaccggcugaugucagccgcugugaaagaugagcgcgccguccacgcagacaugggauacuggauagagagucagaagaacgaaagcuggaagcucgagaaagcgucccugaucgaagugaagacaugcaccuggcccaaaucucauacucuuuggucgaauggcguuuuggagagcgauaugauuaucccuaagucccuggccgguccaauuucacagcacaacuacagaccgggcuaucauacccaaacagcugggcccuggcacuuaggaaaacucgagcuggacuuuaauuacugcgaaggcacuaccgugguaaucacagagaacugugggauaaggggaccuagucuucguacgaccacugucucuggcaagcugauucacgaauggugcugucggagcugcacauugccaccccuccgauauaugggugaggauggguguugguacggaauggaaaucagaccuaucaaugagaaggaggaaaacauggugaaaucccuggugucagccggcagcgguaagaccgacaauuucacuaugggcguccuaugccuggcaauucucuuugaggaaguuaugagggggaaauucggaaagaaacauaugaucgcuggcgcccuguucauguuugugcuuuugcugucugggcagauuacauggcgcgauaugguacacaccuuaauaaugaucggauccaacgcaagugaccggaugggcaugggugugacguaucucgcccugauugcuacuuucaagauccagccauuucuugcgcugggguucuuucuaagaaagcucaccagcagggagaaucuguugcugggagucggcuuagccauggcaacaacccuccaacugcccgaagauauugagcagauggcuaacggcaucgcccuugggcugauggccuugaaacucauaacucaguucgagacauaccagcuguggaccgcucuaaucucucugauguguuccaauacaauuuuuacucuuaccguggcauggcgcacggccacacucauccuggcgguuauuucauugcugccggugugccaaaguagcucgaugcgaaagaccgacugguuaccuaugacugucgcugccaugggagugccaccccucccucuguucaucuuuucccuuaaagauacccugaagcggcguucuuggcccuugaacgaagguguuauggcagugggccucgucagcauacuggccucaaguuuccuaagaaaugacguaccaauggcugggccucugguggcaggaggccuucucauugccuguuauguuaucacagguacuuccgcggaucugaccguggagaaagcugccgacgucacgugggaagaggaagcagagcagacaggggugucucauaacuugaugaucaccguagacgaugacggaacuaugaggauuaaggaugacgagacagaaaacauauuaaccgugcugcucaaaacugcccugcuuaucgucagcggcauuuuucccuacuccaucccagcuacacuguugguuuggcacaccuggcagaagcagacgcaacgcucaggcgugcuaugggaugugccgagcccucccgagacucagaaggccgaacuggaggagggggucuaccggauuaaacagcagggaaucuucgguaagacccaagugggcguugggguacagaaagaaggaguguuucauacaauguggcacgucaccagaggcgcagugcucacacacaaugguaagaggcuggagccaaacugggcuaauguuaaaaaggaccuuauaaguuaugggggaggcuggaaguuaucugcccaguggcaaaaaggcgaagaggugcaggucaucgcgguggaacccgggaagaacccuaaaaauuuccagacuaugccaggaauuuuccagaccacgacaggugagaucggcgccauugcacuggauuuuaagcccgggacuuccggaagcccuaucauaaaccgagagggcaaaguagucggucucuacgggaauggagugguuaccaagaacggcggcuaugugucggggauugcucaaacaaaugccgaaccggacggaccaacccccgaguuggaagaggaaauguucaagaaacgcaaccugacuaucauggaucuccauccugguucaggcaagacccggaaauaccugccagcuaucgucagagaggcaauuaagaggcgucuucgcacacugaucuuggcccccacgcgggugguugccgcugagauggaagaggcgcuaaaagggcugccuauaagauaucagacuaccgcaacaaagucugaacacaccggaagggagauuguggaccucaugugccaugccacuuuuacaaugcgauuacugaguccgguccgggugcccaauuacaaccuuaucguaauggaugaagcucacuucaccgacccagccuccauugcagcccgcggcuauaucagcacgagaguggguaugggggaggcugcggccauauuuaugacugcaacaccucccggaaccgcugaugccuucccacagucuaaugcaccuauucaggacgaggaaagggacauccccgagcggagcuggaacuccggcaaugaauggaucaccgauuuugccggcaagacuguuugguucgucccaucaauuaaagcugggaacgacaucgccaacugucugcgaaagaaugggaagaaagugauucaacucaguagaaaaacauuugauaccgaguaccagaaaacaaaguugaacgacugggauuucguggucacuacggacauaagcgagaugggugcgaauuuuaaagcagaucgcguaaucgacccgaggcguugccugaagccugugauucucaccgauggccccgaacggguuauccuggccgggccaaugcccgugacagucgcuucugccgcucagagaaggggacgcgugggccgaaacucccagaaagagaaugaccaauacaucuucacuggucagccucuuaacaaugaugaagaccaugcacacuggaccgaggccaagaugcuacuggacaacauuaauacaccagaagggauaauccccgcuuuguucgagccugagagagaaaaaucagccgcaauugauggcgaguaucgguuaaagggagaaaguaggaaaaccuuuguugagcugaugcgccguggcgaccucccgguguggcuggcgcacaaggucgccagcgaagggaucaaguacacugauagaaaauggugcuucgacggagagcggaacaaucagauucuugaggaaaacauggauguggagaucuggacgaaggaaggugagaaaaagaaacugaggccacgcuggcucgacgcucgaaccuauuccgaucccuuggcccugaaggaauuuaaggacuucgcagcuggcagaaaaucuauagcccuagaucugguaacagagaucgggcgggugccuucgcaucucgcacacaggacucgcaaugcccuugacaaccugguuauguuacauaccagcgagcacggaggcagagcuuacaggcacgcggucgaagaguugcccgaaacaauggagacccugcuccugcuuggucugaugauucucuugacugggggcgccaugcuguuuuuaaucucaggaaagggcauugggaaaacauccaucggacuaauaugugugguggcaaguucugguaugcuguggauggcugaugucccacuccaguggauugccagcgccaucguucuugaguucuuuaugauggugcuguugauuccugaacccgagaagcaacggacgccacaggacaaucagcuggcauauguagugaucggcauacucacccuggcugccaucgucgcggcuaacgaaauggggcuucucgagacuacaaaacgugaucugggaauguccaaggaaccuggcgugguuucaccgaccucuuacuuggacguggaccugcaucccgccagcgcauggaccuuauaugccgucgcuacaacuguaauuacgccaaugcuacgccacaccaucgagaauaguacagcaaacgugucccuggccgcgauugcuaaccaagccguugugcucaugggucuugauaagggguggccuaucagcaaaauggaccugggcguccccuugcuggcacucggaugcuacucucaggugaauccacugacucuuaccgccgcugucuuacugcucgugacacauuacgccauaauuggcccuggguugcaggcaaaggcuacccgagaggcccagaaaagaacugcggccggaaucaugaagaaccccacgguugauggcaucaugacaauugaccuggauccggugaucuaugacucaaaauucgaaaagcaacuaggucagguaaugcugcucgugcuuugugcaguccagcuguugcugaugaggaccuccugggcuuuuugcgaggcccucacucuggcaaccgggccaauaacaacuuuaugggaaggaaguccuggcaaguucuggaauaccacaauugcuguuagcauggccaacaucuuucgggguucguaccuugccggcgcggggcuggcuuucucuauuaugaaauccgugggaacgggcaagcgcgggaccggaagccagggcgagacucucggugaaaaauggaagaaaaagcuaaaucaacugucaagaaaagaguuugauuuguauaagaagagugggaucacagaggucgacaggaccgaagcaaaagagggacugaagcggggcgaaauaacucaccaugccgugucucgagguuccgcuaaacuccagugguucguagagagaaacauggugauccccgaaggccgcguuauugaucuuggguguggaaggggcggguggagcuacuauucagccggacugaagaaagugacagagguccggggcuacaccaagggugggccaggacacgaggaacccgugccuaugaguacguauggcuggaauaucgucaaguugaugagcggcaaagacguguucuaccugccgcccgagaagugcgauacccucuuaugugacauuggggaauccucuccaagcccuacaguugaggagucccguacuaucagaguacugaaaaugguggaacccuggcuuaagaacaaucaguuuugcauuaaaguccugaacccuuacaugccaaccgugaucgagcaccuagaaaggcuccagcgcaagcauggagguaugcugguucggaaucccuugucacgaaacucuacacacgagauguauuggauaaguaauggcacugggaacauugugucgagcgucaauaugguguccagacugcuccuuaacagguucaccaugacacaucgccggccuaccaucgaaaaggauguagaccugggagcaggcacuagacacgugaacgccgagccagagacgcccaauauggacguuaucggugaacguauuaggcggauaaaagaggaacacucuucaacauggcauuacgaugacgagaacccguauaagaccugggcuuaccacgggagcuaugaagucaaagcgacuggauccgccaguucuaugaucaauggcguggugaaguuacugaccaaaccuugggaugucguuccaauggugacacaaauggcaaugacggacaccacucccuuuggccagcagcgcguauucaaggagaagguggauacacgaaccccuagaccaaugcccgggacuaggaaagucauggagauuacagcugaaugguuguggcggacccucggacgcaacaagagaccgaggcuguguacacgagaggaauuuaucaaaaaggugcggacuaaugccgcaaugggugccguuuucaccgaggaaaaccaaugggacagcgcucgugccgcgguggaggaugaggaauuuuggaagcuagucgacagagagcgcgaacuucauaagcugggcaaaugcgggucauguguguacaauaugaugggaaagagggagaagaaacucggcgaguucgguaaggcaaaagggucccgggccauuugguauauguggcugggagcuagauacuuggaauuugaggcccugggcuuccucaacgaagaucacugguuuagucgcgagaauagccauucuggcguagaaggggagggacuucacaagcuggguuacaucuuaagggacauauccaaaaucccuggcggggcaauguaugcugaugacacggccggaugggacacccgaauuacagaggaugaccugcacaacgaagagaagaucacucagcagauggaucccgaacaucggcaguuggcuaaugccauuuucaagcucaccuaccaaaacaaaguugugaagguccagagaccaacaccuaaaggcacugugauggacaucauaucaaggaaggaucagcgcgguagcggacaggugggaaccuauggccugaauacguuuacaaacauggaggcacaacuaauucgucagauggaaggcgaggggguccuuucgaaagcggaccuggagaauccccaccuccuggaaaagaagguuacccagugguuggagacuaaaggaguggaacgguuaaagagaauggccaucucuggugaugacugcguagugaaaccaaucgaugacagguucgcuaacgcccugcucgcacuuaacgauaugggcaagguccgcaaagacauuccccaguggcaaccuaguaagggguggcaugauuggcaacaggugccauucugcucccaccacuuucaugagcugauaaugaaggacggacgaaagcuaguugugccgugucggccccaggacgaacugaucggcagagcuaggauuagccaaggugccggguggucacuccgcgagacagcaugcuugggaaaggccuacgcgcagaugugggcucugauguauuuccacagacgggaucuuaggcuggccuccaaugcaaucuguucugccgucccugugcauuggguaccaaccagccguacuaccuggaguauucacgcucaucaccaguggaugacaacggaggacaugcucaccguuuggaaccgaguguggaucgaagauaaucccuggauggaggacaaaacuccugucacaaccugggaagaugugccauacuuaggcaagcgcgaggaccaauggugcggcucccugauaggguugacuagcagagccacaugggcacagaacauccugaccgcuauucagcagguucggucucucaucggaaaugaggaauuucuugauuauaugcccucaaugaaaagguuccgcaaggaggaagagagugaaggugccauuugguga

SEQ ID NO: 15638 - RNA, 9873 nt, Artificial Sequence
  derived and/or modified CDS sequence (opt3) from DENV-3__KU216208__SS-prME
accagccugugccucaugaugauccuucccgccgcucuggcauuccacuugacuuccagggacggagagccuaggaugauuguggggaagaacgaacggggaaagucuuuacuguuuaagacugccucagguauaaauauguguacgcucaucgcgauggaucucggcgaaaugugcgacgauaccgucacauacaaauguccacacauuacugaaguugagccggaagacaucgauugcugguguaaccugaccaguacaugggugaccuaugggacuugcaaucaggcuggagagcaccgccgagacaagcguagcgucgcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggauugaugugguccuggagcacggcgggugcgugacgacuauggcgaagaauaaacccacacuagacaucgagcuccagaagaccgaagcaacucagcuggccacacuuaggaaacuguguauugagggaaagaucaccaacauaacgaccgauagccggugcccuacacagggcgaagcuguguugccagaggaacaggaccagaauuaugucuguaaacacgccuacguugaucgcgguugggggaacggaugcggccucuucggcaaggggagucuggugacuugcgcaaaguuucaauguuuagagcccauugagggaaaaguagugcaguaugaaaaucugaaguacaccgucaucauuacagugcauacuggugaccagcaccagguuggcaacgagacccaaggggugacagcugaaaucaccccucaggccuccacuacggaggcgauccucccagaauauggaacacuuggccuggagugcucuccgcgaaccgguuuggacuucaaugagaugauucuacugacuaugaaaaacaaggccuggaugguccauagacagugguuuuucgaucucccccugccuuggaccagcggggcaacaaccgaaacuccaacauggaauaggaaagagcuucuggugacguuuaagaacgcucacgccaaaaagcaagaaguaguuguguugggcucccaggagggagcuaugcacaccgcccucacuggcgcaacagaaauacaaaauucagggggaaccaguaucuucgccggucaucugaagugucgguuaaaaauggacaagcuggagcuaaaaggcaugagcuacgcuaugugcacaaacacuuuuguccucaagaaagaggugucugaaacccagcacgggacgauucugaucaaggucgaguacaagggagaagaugcgcccuguaaaauaccuuucuccaccgaggacggccaagguaaggcacauaacgggcgucuuauuacagccaauccagugguuacuaaaaaggaggaacccgugaacaucgaggcugaaccgccuuucggcgagucaaauaucguaauuggaaucggcgauaacgccuugaaaauuaauugguauaagaaggggagcaguauaggaaaaauguuugaagcaaccgcccgcggugcuagaaggauggccauccugggcgacacagcaugggauuucgggucugucggaggcgugcucaacucccuggguaagaugguucaccagauuuuugggagcgcguacacugcucuuuucucgggcgugucuugggucaugaaaaucggaaucggcgugcuguugaccuggauugggcucaauuccaagaacacgucaaugaguuuuagcugcauagccaucggaauuaucacacuguauuuaggcgcaguagugcaggccgacauggguuguguugucaauuggaaagggaaggagcugaagugcggauccggcauuuucgugaccaacgaggugcauacuuggacagaacaguacaaauuucaagcugauucucccaagcggcuagccaccgcaaucgcuggugccugggagaauggcgucugugggauacgaagcacuacccgcauggaaaaccuccuguggaaacagaucgcgaaugagcuuaacuauauuuugugggaaaauaacaucaagcugacaguuguggugggagacacgauuggcguacucgagcaggggaaaagaacccugacuccacagccuauggaguuaaaguacucauggaaaacauggggaaaggccaagaucgucaccgcugaaacacaaaacaguuccuucauaauugauggccccaauacuccagagugccccagcgcaucuagggccuggaacgugugggaaguugaggacuaugguuuugggguguucaccacgaauaucuggcugaaacuucgggaagucuacacacagaugugugaccaccgcuugaugucagcugccgugaaggaugagagagcaguucacgcggacaugggauacuggauugagagucagaaaaacggcagcuggaagcucgaaaaagccucccugaucgaggugaagaccugcacuuggccuaagucucauacccuauggucgaaugguguacuggaaagcgauaugauaaucccaaaaucccucgcuggcccgauuucacagcacaacuauaggcccggguaccauacacaaacugccggaccuuggcaccugggcaaacuugaguuggacuuuaauuauugcgaggggaccacagucgugaucacggaaaacuguggaacccguggcccaagucugcggacuacaaccgugucugguaaauuaauucacgaguggugcugucgaagcugcacucuacccccucugagauacaugggggaagauggauguugguauggcauggagaucaggccaauauccgaaaaggaggagaauauggucaaaucacuuguuagcgcagguucuggcaagguggacaacuucacaauggggguacugugcuuggcuauucucuuugaagaggugaugcgcggaaaguucggcaaaaagcauaugaucgccggggucuucuuuaccuucgugcugcuacuguccggacagaucacguggcgggauauggcacacacucucauuaugaucggcaguaaugccagcgacagaauggguauggggguuaccuaccuggcucuuauugcgacauuuaaaauacagcccuucuuggcccugggauuuuucuuaaggaagcucaccucucgcgaaaaccugcuucugggcgugggccuagcaauggcuacuacacuccaacugccggaggauaucgaacagauggccaaugggauugccuugggacugauggcuuuaaaacucaucacccaguuugagacauaucagcuguggacugcacuuauuucccugaccuguucaaacacgaucuucacauugaccgucgccuggcgaacugcgacccucauacuggcuggugugagucuacugccuguuugccaaagcucguccaugcggaagacagacuggcuuccaaugacuguggccgcaaugggcguacccccucucccccuguuuaucuucucuuugaaggauacccugaaacguagaagcuggccauuaaaugaggggguaauggccgugggacucguuucaauucuggcuaguucccuucugaggaacgacgugccuauggcaggccccuuggucgccggugggcuccugaucgcguguuacgugauuacgggaacaucugcugaucuaaccguagaaaaggccgcagacgugacuugggaggaagaggccgaacagacaggcgucagccauaaccugaugaucaccguugacgaugacggcacuaugcgcauaaaagaugacgagacagagaauauucuuaccgugcuccugaagacggcuuuguuaaucguguccgggaucuuuccauacucaauuccggccacucugcucgucuggcacaccuggcagaaacagacacaacggagcggagugcugugggauguuccuagucccccagaaacccagaaggcagagcuugaagaggguguauauagaauaaaacagcagggcauccuggggaagacacaagugggagucggcgugcagaaggaggguguuuuccauacuauguggcacgugaccagaggggcugucuugacgcacaacggaaaacgacuagaacccaauugggccucugugaagaaagaccugauuuccuacggcggcggguggcgccucagcgcgcaguggcaaaagggagaggaaguacaggucaucgccguggagccugguaaaaacccaaagaauuuucagacaaugcccggcacuuuccagaccacaaccggggaaauuggagcaaucgcucuggauuucaagccuggcacuucggguucaccgauaaucaaccgggaggggaaaguugugggacuuuauggcaauggcgucgugaccaagaacgggggauacguuucugguauugcccaaacaaaugcugagccagacggccccacgccugaauuagaggaagagauguuuaaaaagagaaaccugacuaucauggaucuccauccagggaguggaaaaaccaggaaguauuugcccgcaauugugcgugaagccaucaagcgccggcugagaacacucauacuggccccuaccagggucguggcugcggagauggaggaagcacuuaaaggccugccgauucgauaccagacuacagccaccaaguccgagcacacgggucgggaaaucguagacuugaugugccaugcuacuuucacaaugcgccuacugagccccgugagaguuccaaauuauaaccucaucauuauggaugaggcccacuuuaccgacccugcaucuaucgccgcuaggggguacauaagcacccgggucggaaugggcgaagcggccgcaauuuucaugacugcuacacccccaggcaccgccgaugcauuuccucaguccaaugcccccauccaggacgaggagcgagacauuccagaaagaucauggaacagugggaaugaguggaucacagauuucgcuggaaaaacugugugguuugugccgagcauaaaggccgguaacgacauugcgaacuguuuacgcaaaaauggcaagaaggucauccaacugucuaggaaaacguucgaaaccgaguaccagaagacaaaacuuaacgauugggacuuuguagugacuaccgauaucuccgagaugggggcaaauuucaaggccgaccguguuauugauccucggagaugccugaaacccgugauccucacagacggaccagaaagggucauuuuggcuggccccaugccugugaccgccgcuucagcagcccagcgccgagguagaguugggcggaacccacagaaggagaaugaucaauauauauuuacuggccagccccugaacaaugacgaagaucaugcucacuggacggaggccaagaugcuccuggacaacaucaauaccccugaaggaauuaucccggcacuuuucgagccagagagggagaagagugcggccaucgacggcgaguaccgccuaaagggggaaagccguaaaacauucguggagcugaugagacggggagauuugcccgucugguuagcuuauaagguggccuccgaagguauuaaauacacugacaggaaguggugcuuugauggccagcgcaacaaucagauacuggaggagaacauggacguagaaaucuggaccaaagagggggaaaagaagaaacuccgaccuagauggcuggaugcacggacauauucugacccccuugcucugaaggaguucaaagauuuugccgcaggaaggaagucgauugcccucgacuuggugaccgaaaucggccgcguuccaagccaccuggcucauagaacuaggaaugcgcuagauaaccuggucaugcuccacacaucagagcauggugggcgggccuaccgucacgcaguggaggaacuuccugagacgauggaaacccuguuauugcugggccucaugauucugcuuacuggaggcgcuaugcuguuccucaucuccgggaaaggaauagguaagacaaguaucggcuugauuugugugaucgccucuagcgggaugcuguggauggccgagauucccuuacaauggaucgcauccgcuauaguccuagaguuuuucaugaugguucugcucauuccagaaccugagaagcagcgcaccccgcaggacaaucaacuugccuaugugguaaucggcauucugaccuuggcggcuaucauagccgcaaacgaaaugggccugcucgagacaacuaaacgagaucuggguaugucaaaggaacccgggguggucucuccaacgagcuaccuugacguggaucuccacccugccagugcuuggacccuguacgcaguugccacaacugugaucacccccauguugagacauacaauugaaaauuccaccgcgaacgucagccuggcugccaucgcaaaccaggccguaguguuaaugggccuagacaaaggauggccaauuucuaagauggaccugggcguuccucuccuugcucuggggugcuauucacaggugaaucccuugacucugacggccgcaguccuccugcuuaucacacacuacgcuauaauuggaccgggcuuacaggccaaagcgaccagggaggcccaaaagcggacugcagcugguaucaugaagaacccaaccguggaugggaucauuacaaucgaccuggauccugucauauaugacuccaaauuugaaaagcagcucggacaggugauguugcugguucuaugugccgugcagcugcuccuuaugcgcacaaguugggcacugugcgaggcuuugacccuggccacaggccccauuacgacccucugggaagguagcccaggcaaauucuggaauacuacaaucgccguaucgauggcgaacauuuuuagagggucuuaccuggcuggagcaggcuuagccuucuccaucaugaaaagcguggggaccggaaaaaggggcacugguucacaaggggagacacuuggagaaaaguggaagaaaaagcugaaucagcucagucggaaagaguuugaucuauauaagaaaucuggcauaaccgaggucgaccgaacggaagcuaaggagggucugaaaagaggcgaaaccacacaucacgccguuucccgcgggagcgcaaaguugcagugguucguggagaggaacauggucauccccgaaggacgggugauugaucugggcugugggcguggaggcuggucauacuauugcgccggucucaagaaaguaacugaggugagaggguacaccaagggaggcccuggccaugaggaaccgguucccauggcuacauacggguggaauaucgugaaacuuaugaguggaaaggacgucuuuuaucugccaccugagaaaugugauacuuugcugugcgacauuggugaaagcucccccucuccuaccguggaggagagcaggacaauccgcguccucaagaugguggaaccaugguuaaagaacaaucaguucuguauuaaaguucugaaccccuacaugccugcgguaaucgagcaccuugaacggcugcaacgaaagcacggcgggaugcuagugagaaauccacucuccaggaacucaacccaugagauguauuggauaucuaauggaacuggcaacauugucaguucggugaauaugguuagccgccuguugcugaaccgguucacgaugacacacagacgucccaccaucgaaaaagauguggaccucggugccgggacuaggcaugucaacgcagagccggagaccccuaauauggaugugaucggagaacggauuaagcgcauaaaagaggaacacaacuccacauggcacuacgacgacgagaauccauauaagacgugggcuuaccauggcucuuaugaaguaaaggccaccggcucagcaagcuccaugaucaacggggugguuaaacuucugacuaagcccugggaugucgugccuauggugacacagauggccaugaccgacacuacaccauuuggacagcaacgagucuucaaagagaagguugauaccagaacacccaggccgaugccugguacucggaaagugauggagauuaccgcugaaugguuauggcgcacgcugggcagaaauaagaggccccgauugugcacccgggaggaauuuacaaagaaaguacguacuaacgccgcgaugggggcaguguucaccgaggaaaaucagugggacagugccaaggcugccgucgaggaugaggaauuuuggaaacucguggacagagagcgcgaacugcacaagcuaggaaaauguggcucuugcguuuacaacaugauggguaagagggagaagaaacuuggggaguucggaaaagcaaaaggcagccgggcuaucugguacauguggcugggcgccagauaucucgaauuugaggcucugggguucuugaaugaagaucauugguuuucacgcgagaacuccuacaguggaguggaaggugagggccugcacaagcucggguauauucuuagggacaucagcaaaauaccaggaggcgccauguacgcagaugacacagcggguugggauacucgaaucaccgaggacgaccugcauaaugaagagaagauuacgcagcagauggauccugaacaccgguuacuggccaacgcuaucuucaaauugacauaucaaaauaaggucgugaagguacagagacccaccccaacugggacaguuauggacauuaucucuaggaaagaucagcgcggauccggccaggugggcaccuacgggcucaacacuuuuaccaauauggaggcccaacugguccgucagauggaaggagagggugugcuaucaaaggcagaccuugagaacccccaucugccugagaagaagauaacacaguggcucgagacgaaaggcguggaacggcugaagagaauggcuauuagcggggaugacugcgucguuaagccaaucgaugacagguucgccaacgcauuguuagcccugaaugauaugggaaaagugcgcaaggacaucccgcaguggcaacccucgaaaggcuggcaugauuggcagcagguaccuuuuuguucucaccauuuccacgagcucauuaugaaggacggucgaaaacuuguggucccaugccggccccaggaugaacugauagggagagcgaggaucagucaaggagcuggcuggucccuacgcgagaccgccugucugggcaaggcauaugcccagauguggagccucauguacuuccacagacgggacuugaggcuggcuucaaacgccauuugcuccgcagugccuguucauugggugccaacuucucguacaaccuggagcauccacgcucaucaccaguggaugacuacagaggacaugcuuaccgucuggaaucgaguguggauugaagauaaccccuggauggaggacaagacgccuguaacaaccugggaaaauguuccguaccuggggaaacgcgaggaucaaugguguggaagucucaucgguuuaacuuccagagccaccugggcgcagaacauaccaacagcuauccaacaggugcggagccugauuggcaaugaggaauuuuuggacuauaugcccucuaugaagagguuccgcaaagaggaagagucagaaggggccaucugguga

SEQ ID NO: 15639 - RNA, 9873 nt, Artificial Sequence
  derived and/or modified CDS sequence (opt3) from DENV-3__GU370053__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuugggccagcggggcaacaaccgaaacuccaacauggaauaggaaagagcuucugguaacguuuaagaacgcucacgccaaaaagcaagaaguuguggucuugggcucccaggagggagcuaugcacaccgcccucacuggcgcaacagaaauucagaauucagggggaaccaguauauucgccggucaucugaagugucgguuaaaaauggacaagcuggagcuaaaaggcaugagcuacgcuaugugcacaaacacuuuugugcucaagaaagaggucucugaaacccagcacgggacgauccugauuaagguggaguacaagggagaagaugcgcccuguaaaaucccuuucuccaccgaggacggccaagguaaggcacauaacgggcgucuuauaacagccaauccaguugugacuaaaaaggaggaacccguaaacauugaggcugaaccgccuuucggcgagucaaauaucgucaucggaauuggcgauaacgccuugaaaaucaauugguauaagaaggggagcaguauuggaaaaauguuugaagcaaccgcccgcggugcuagaaggauggccauacugggcgacacagcaugggauuucgggucugugggaggcguucucaacucccuggguaagauggugcaccagaucuuugggagcgcguacacugcucuuuucucgggcgucucuugggugaugaaaauuggaaucggcguacuguugaccuggaucgggcucaauuccaagaacacgucaaugaguuuuagcugcauugccauaggaaucauuacacuguauuuaggcgcagugguucaggccgacauggguugugucaucaauuggaaagggaaggagcugaagugcggauccggcauuuucgugaccaacgaggugcauacuuggacagaacaguacaaauuucaagcugauucucccaagcggcuagccaccgcaaucgcuggugccugggagaauggcgucugugggauacgaagcacuacccgcauggaaaaccuccuguggaaacagaucgcgaaugagcuuaacuauauuuugugggaaaauaacaucaagcugacaguuguggugggagacacgauuggcguacucgagcaggggaaaagaacccugacuccacagccuauggaguuaaaguacucauggaaaacauggggaaaggccaagaucgucaccgcugaaauacaaaacaguuccuucauuaucgauggccccaauacaccagagugccccagcgcaucuagggccuggaacgugugggaaguugaggacuaugguuuugggguguucacuaccaauauuuggcugaaacuucgggaagucuacacgcaguugugugaccaccgccucaugucagcugccgugaaggaugagagagcaguucacgcggacaugggauacuggaucgagagucagaaaaacggcagcuggaagcuggaaaaagccucccuaauagaggugaagacaugcaccuggccuaagucucauacucuguggucgaaugguguacucgaaagcgauaugaucauuccaaaaucccuggcuggcccgaucucacagcacaacuauaggcccggguaccauacccaaacagccggaccuuggcaccuuggcaaguuggagcuggacuuuaauuauugcgaggggacuaccgucgugauuacagaaaguuguggaacgcguggcccaucuuuacggaccacuacagugagcgguaaacucauccacgaguggugcugucgauccugcacccugcccccucuuagauacaugggggaagauggauguugguauggcauggagauaaggccaauuucagaaaaggaggagaacauggucaaaagccugguuucugcagguuccggcaagguggacaauuucacuauggggguauugugccucgcuauccuguacgaagaggugaugcgcggaaaguuuggcaaaaagcauaugaucgccggggucuucuucacauuugugcuacugcucaguggacagauuaccuggcgggauauggcacacacgcugaucaugauuggcagcaacgccucugacagaauggguauggggguuacuuaucuugcuuugauagcgaccuucaaaauccagcccuuucuggccuuaggauucuuucucaggaagcugacaucccgcgaaaaucuucugcuaggcgugggccucgcaauggcuaccacucugcaauugccggaggauauugaacagauggccaacgggaucgcccugggauuaauggcucucaaacugauuacacaguucgagaccuaccagcuuuggacagcacuggucucauugacuuguaguaauaccaucuuuacgcucacaguggccuggcgaaccgcgacucugauacuagcugguguuagccugcuuccugugugccaaucguccucuaugcggaagaccgacuggcucccaauggccgucgcagccaugggcguacccccucugcccuuguucaucuuuagccugaaggauacauuaaaacguagaucauggccacucaacgagggggugauggcuguuggacuggugaguauucuugcauccucucuguugaggaaugacgucccuauggccggcccccucguggcgggugggcugcuaaucgcuuguuacguaauuacuggaaccagcgccgaucugacgguggaaaaggcagccgacgucacaugggaggaagaggcugaacagaccggcguuucccauaaccuuaugaucacuguggacgaugacggcacaaugcgcauaaaagaugacgagaccgagaacauucucacugugcuguugaagacagccuuacugaucgucucagggaucuucccauauagcauuccggcaacccuccugguguggcacacguggcagaaacagacucaacggaguggaguucuuugggauguaccuucucccccagaaacccagaaggcugagcuggaagaggguguguacagaauaaaacagcagggcaucuuugggaagacacaagucggagugggcguucagaaggaggguguguuccauaccauguggcacgucacaaggggggccguguugacucacaauggaaaacgacuagaacccaacugggcguccguaaagaaagaccugauuagcuauggcggcggguggcgccucucggcccaguggcaaaagggagaggaaguccaggugaucgcaguugagccugguaaaaauccaaagaacuuucagaccaugcccggcacguuccagacaacuaccggggaaauuggagcuaucgcccuggauuucaagccuggcacaucagguucuccgauaaucaaucgggaggggaaaguggucggacuuuacggcaacggcgugguuaccaagaaugggggauaugugagugguauugcucaaacuaacgcagagccagacggccccaccccugaauuagaggaagagauguuuaaaaagagaaaucugacaaucauggaucuccauccaggguccggaaaaacgaggaaguacuugcccgccauuguccgugaagccaucaagcgccggcugagaacucucauacuggcuccuaccagggugguagcggcagagauggaggaagcccuuaaaggccugccgauucgauaucagacaaccgcuacuaagagcgagcacacaggucgggaaaucguggacuugaugugccaugccaccuucacgaugcgccuacugucucccguuagagucccaaacuacaaucucaucgugauggaugaggcacacuuuacugacccugccagcauugcugcgaggggguacaucuccacacgggugggaaugggcgaagccgcagcuauauucaugaccgccacccccccaggcacugcagaugccuuuccucagucaaacgcucccauucaggacgaggagcgagacaucccagaaagaaguuggaauagcgggaacgaguggauuacagauuucgccggaaaaaccgucugguuuguaccgucuaucaaggcggguaaugacauagcaaacuguuuacgcaaaaacggcaagaaggugauucaacuguccaggaaaacauucgauacugaauaucagaagacgaaacuuaaugacugggauuuuguugugaccacagacaucucagagaugggggccaacuucaaggcugaucgugucaucgacccucggagaugccugaaacccgugauucucacugauggaccagagaggguuaucuuggccggccccaugccugugaccgcugcaagugccgcucagcgccgagguagagucgggcggaauccacagaaggaaaacgaccaauacauuuuuacaggccagccccugaauaacgaugaggaccaugcccacuggaccgaagcaaagaugcuccuggacaauauaaacacuccugagggaaucauuccggcgcuuuucgaaccagagagggagaaaagcgccgcuaucgauggcgaauaucgccuaaagggggagucccguaaaacguucguggaacugaugagacggggagacuugcccguaugguuagcccacaagguggcaucugaggguaucaaauacaccgauaggaaguggugcuuugacggccagcgcaauaaccagauucuggaagagaauauggauguugagauauggacaaaagaaggggagaagaagaaacuccgaccuagauggcuggacgcucggacuuauucggauccccuugcccugaaggaauucaaagacuuugcagccggaaggaagagcaucgcucucgauuuggucaccgagauuggccgcgugccaucacaucuggcgcacagaacaaggaacgcccuagacaaucuggugaugcuccauaccuccgaacacggugggcgggcauaccgucacgcugucgaggagcuuccugaaacuauggagacacuguuauugcugggccucaugauccugcuuacgggaggcgccaugcuguuccucauuagugggaaaggaaucgguaagaccucuauaggcuugaucuguguuauugccagcuccgggaugcuguggauggcagaagugcccuuacaauggaucgcuucagccauuguacuagaguuuuucaugauggugcugcucaucccagagccugaaaagcagcgcacuccgcaggauaaccaacuugcguaugucgugauaggaauucugacauuggcugccaucauugcagccaaugagaugggccugcucgaaaccaccaaacgagaccuggguaugucuaaggagcccgggguugugagcccaacaaguuaccuugaugucgaccuccauccugcuuccgcauggacucuguacgccguagcgacgaccgugaucacacccauguugagacacacuauagaaaacagcaccgcuaauguuucucuggccgcaaucgccaaccaggcuguggucuuaaugggccuagacaaaggauggccaauuucaaagauggaucugggcgugccucuccuugcccuggggugcuauucccaggucaaccccuugacacugaccgcagcugugcuccugcuuaucacucauuacgccauuaucggaccgggcuuacaggcgaaagccacgagggaggcacaaaagcggacagcugccgguauaaugaagaauccaaccguugacgggauuaugacuaucgaucuggacccugugaucuaugauaguaaauuugagaagcagcucggacagguaauguugcuggugcuaugugcaguccagcugcuccuuaugcgcaccagcugggcucugugcgaagccuugacacuggccacuggccccauuaccacacucugggaggguucgccaggcaaauucuggaacacgaccaucgcgguuucuauggcuaauauauuuagaggguccuaccuggcaggagccggcuuagcuuucagcauuaugaagucaguggggacuggaaaaaggggcacagguagucaaggggaaacccuuggagagaaguggaagaaaaagcugaaccagcucucucggaaagaauuugaccuauauaagaaauccggcaucacugaggucgaucgaacagaggccaaggaaggucugaaaagaggcgagaccacgcaccaugcagugagccgcgggucagccaaguugcagugguucguagaaaggaauauggugguucccgagggacgggugauugaccugggcugugggcguggaggcuggaguuacuauugcgcuggucucaagaaagucaccgaagugagaggguacacaaagggaggcccuggccacgaggagccgguccccaugagcacuuacggguggaacaucgugaaacuuauguccggaaaggauguuuuuuaucugccaccugaaaaaugugacaccuugcugugcgauauaggugagucuagccccuccccuacaguagaagagucaaggacuauccgcgugcucaagauggucgagccaugguuaaagaauaaccaguucuguauuaaagugcugaaucccuacaugccuaccguuaucgaacaccuugagcggcugcaacgaaagcauggcgggaugcuagugagaaacccacucucuaggaauaguacacacgaaauguauuggauuucgaacggaaccggcaauaucgucagcuccgugaacaugguaucucgccuguugcugaaucgguucacuaugacgcauagacgucccacaauugagaaagacguggaucucggugcggggaccaggcacguuaacgccgaaccggagacuccuaacauggacgucaucggagagcggauaaagcgcauuaaagaagagcacaauucaaccuggcauuacgacgaugaaaacccauauaagacaugggcauaccacggcagcuaugaggugaaggcuacgggcuccgccaguucuaugaucaaugggguggucaaacuucugaccaagcccugggacguugugccuaugguaacucagauggcaaugacagauaccacuccauuuggacagcaacgaguguucaaagaaaaggucgacacaagaacccccaggccgaugccugguacacggaaagugauggagaucacugccgagugguuauggcgcacccugggcagaaacaagaggccccgauugugcacgcgggaagaguuuaccaagaaaguucguacaaaugcugccaugggggcgguguucacugaagagaaccagugggauagcgcaaaggccgcugucgaagacgaggaguuuuggaaacucguggauagagaacgcgagcugcauaagcuaggaaaauguggcucaugcguauacaauaugauggguaagagggaaaaaaagcuuggggaguucggaaaggccaaaggcucccgggcaauuugguacauguggcugggcgcuagauaucucgaguuugaagcccugggguucuugaacgaggaccacugguuuagucgcgaaaauagcuacucuggaguugagggugaaggccugcauaagcucggguauauacuuagggauaucuccaaaauuccaggaggcgcuauguacgccgacgauaccgcagguugggacacacgaaucacugaggacgaucugcacaacgaggaaaagauuauccagcagauggacccugagcaccggcaauuagcgaaugccauauucaaacugaccuaucagaacaagguggucaaggugcagagacccacgccaacagggaccgugauggauaucauuucaaggaaagaccagcgcggaagcggccaagucggcacuuacggguugaauacauuuaccaacauggaagcucagcucguucgucagauggagggagaaggugugcugacuaaggccgaucuagagaauccccaucuuccugagaaaaagaucacccaguggcuggaaacaaaaggcguagagcggcucaagagaauggcaauuucgggggacgauugcguggucaagccaaucgacgauagguucgcuaacgcccuguuggcauuaaacgacaugggaaaagugcgcaaggauauaccgcaauggcagcccucucgaggcuggcacgacuggcagcagguuccuuuuuguagucaucacuuccacgaacugauuaugaaagauggucggaagcucguggucccaugcagaccccaagacgagcuuaucgggagggcccgcaucucccagggagcgggcuggagccugagagaaacggcuugucuaggcaaagccuaugcacagauguggucacugauguacuuccaucggagggaccuccguuuggccuccaaugcuauuugcucugccgugccuguacacuggguuccaaccagccgaacuacauggaguauacaugcacaccaucaauggaugaccacugaggauaugcugacaguguggaaccgcgucuggaucgaggaaaaucccuggauggaggacaagaccccugugacgacaugggaaaacguuccguaccuugggaagagagaggaucagugguguggaucccugauuggucucaccagccgggcuacuugggcccagaauaucuuaaccgcgauucagcaagugaggucucugaucggcaacgaggaauuuuuggacuauaugccaucaaugaaacgcuucagaaaggaggaagagagugaaggggcuauaugguga

SEQ ID NO: 15640 - RNA, 9873 nt, Artificial Sequence
  derived and/or modified CDS sequence (opt3) from DENV-3__JQ411814__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcauugggaacagagacuuuguagaaggauugucaggugccaccuggguugaugugguccuggagcacggcgggugcgugacgacuauggcgaagaauaaacccacacuagacaucgagcuccagaagaccgaagcaacucaacuggccacacuuaggaaacuguguauugagggaaagaucaccaacauaacgaccgauagccggugcccuacacagggcgaagcuguguugccagaggaacaggaccagaauuaugucuguaaacacacuuacguugaucgcgguugggggaacggaugcggccucuucggcaaggggagucuggugaccugcgccaaguuucaauguuuagagcccauugagggaaaaguagugcaguaugaaaaucugaaguacacagucaucauuacugugcauaccggugaccagcaccagguuggcaacgagacacaaggggugaccgcagaaaucacuccucaggcuuccacgacagaggccauccucccagaauauggaacccuuggccuggagugcucuccgcgaacugguuuggacuucaaugagaugauucuacugaccaugaaaaacaaggcguggaugguccauagacagugguuuuucgaucucccccugccuuggacaagcggggccaccacugaaacaccaacguggaauaggaaagagcuucuggugaccuuuaagaacgcacacgcuaaaaagcaagaaguaguuguguugggcucccaggagggagccaugcacacugcucucacaggcgccaccgaaauacagaauucagggggaacaaguaucuucgcaggucaucugaagugucgguuaaaaauggacaagcuggagcuaaaaggcaugagcuacgccaugugcacuaacaccuuuguccucaagaaagaggugucugaaacgcagcacgggaccauucugaucaaggucgaguacaagggagaagaugcucccuguaaaauaccuuucuccacagaggacggccaagguaaggcgcauaacgggcgucuuauuacugcaaauccagugguuaccaaaaaggaggaacccgugaacaucgaggccgaaccgccuuucggcgagucaaauaucguaauuggaaucggcgauaacgcuuugaaaauuaauugguauaagaaggggagcaguauaggaaaaauguuugaagccacagcacgcggugccagaaggauggcuauccugggcgacacugccugggauuucgggucugucggaggcgugcucaacucccuggguaagaugguucaccagauuuuugggagcgcauacaccgcgcuuuucucgggcgugucuugggucaugaaaaucggaaucggcgugcuguugacguggauugggcucaauuccaagaacacaucaaugaguuuuagcugcauagcuaucggaauuaucacccuguauuuaggcgccguagugcaggcagacauggguuguguuauuaauuggaaagggaaggagcugaagugcggauccggcaucuucgucacuaacgaggugcauacauggaccgaacaguacaaauuucaagccgauucucccaagcggcuagcuacugccauagcaggugcuugggagaauggcgugugugggauccgaagcaccacacgcauggaaaaccuccuguggaaacagauugccaaugagcuuaacuauaucuugugggaaaauaacauuaagcugacggucguugugggagacaccaucggcgugcucgagcaggggaaaagaacucugacaccacagccuauggaguuaaaguacucauggaaaaccuggggaaaggcgaagauaguaacagccgaaacucaaaacaguuccuucauuaucgauggccccaauaccccagagugccccagcgcuucuagggcauggaacgucugggaaguggaggacuaugguuuugggguuuucacgacaaauauuuggcugaaacuucgggacguguacacccaguugugugaucaccgccucaugucagccgcugucaaggacgaaagagccgugcacgcagauaugggauacuggaucgagagucagaaaaacggcagcuggaagcuggagaaagcgucccuaauagaaguuaagacuugcaccuggccuaagucucauacacuguggucgaauggugugcucgagagcgacaugaucauuccaaaaucccuggccggcccgaucucacagcacaacuauaggcccggguaccauacucaaaccgcuggaccuuggcaccuuggcaaguuggaacuggauuuuaauuauugcgaggggacaacgguagucauuaccgagaacuguggaacucguggcccaaguuuacggacaaccacugugucugguaaacucauccacgaauggugcugucgaagcugcacacugcccccucuuagauacaugggggaggacggauguugguauggcauggaaauaaggccaauuuccgagaaggaagagaauauggugaaaucacuggucagcgccgguucuggcaagguugauaacuucaccauggggguguugugccucgcaauccuguuugaggaaguaaugcgcggaaaguucggcaaaaagcauaugaucgcuggggugcuauucacguuuguccugcuccuguccggacagauuacuuggcgggacauggcccacacccuuaucaugauuggcaguaaugcaagcgauagaauggguaugggggugacauacuuggcccugauagcuaccuucaaaauccagcccuuuuuagcgcucggauucuuucugaggaagcuuacuucucgcgagaaccugcuacucggcguuggccuggccauggcaacaaccuugcaacugccggaagacauugagcagauggcuaaugggaucgccuuaggacucauggcccugaaacuuauuacacaguucgaaacuuaucagcuguggaccgcuuuggugucccucacguguucaaacacaauccugacccuaacugucgcauggcgaaccgccacacugauacuugcgggugugagucuccugccuguuugccaaagcucguccaugcggaagacugauugguugccaaugaccguggcugccaugggcguccccccucugcccuuauuuaucuucucucucaaggacacgcugaaacguagaagcuggccacuuaaugaggggguaauggcagugggacugguuucaauuuuggccaguucccuccugaggaacgaugugccuauggcuggcccccuagucgcaggugggcugcuuaucgccuguuacgugauuacaggaaccucugcggaccucacuguagagaaggcugccgacgugacaugggaagaggaagcagagcagaccggcgucagccauaaccugaugaucacuguugaugacgauggcacaaugcgcauaaaagacgaugaaaccgagaauauuuugacgguguuacugaagacugcccuccugaucguguccgggaucuuuccauacucaauuccggcuacccuucuggucuggcacacauggcagaaacagacccaacggagcggaguguugugggacguuccuagucccccagagacacagaaggccgaacuagaggaagguguauauagaauaaaacagcagggcauccuggggaagacucaagugggagucggcgugcagaaggaggguguuuuccauaccauguggcacgugacgaggggggcaguccucacacacaacggaaaacgacuggagcccaauugggcuucugugaagaaagaucuuauuuccuacggcggcggguggcgcuuaagcgcccaguggcaaaagggagaagagguacaggucaucgcgguggaaccugguaaaaacccaaagaauuuucagacuaugcccggcaccuuccagacaaccacuggggagauuggagccaucgcacuggacuuuaagccuggcaccucggguucaccgauaaucaaccgggaagggaaaguugugggacucuauggcaauggcgucgugacaaagaacgggggauacguuucugguauugcucaaacgaaugccgagccagauggccccacuccugaguuggaagaggaaauguucaaaaagagaaaccugaccaucauggaccuccauccagggaguggaaaaacaaggaaguaucugcccgcuauugugcgugaggcaaucaagcgccggcuuagaacccugauauuggccccuacuagggucguggccgcugaaauggaggaggcgcuaaaaggccugccgauucgauaccagacaaccgcaacgaaguccgaacacacuggucgggagaucguagaucucaugugccaugccacauucaccaugcgcuuacugagccccgugagaguuccaaauuauaaccuuaucauuauggacgaagcucacuuuaccgauccugccucuaucgcagccaggggguacauaagcacucgggucggaaugggcgaggcugcggccauuuucaugacagcaacccccccaggcacagcugacgccuuuccucaguccaaugcacccauccaggacgaagagcgagauauuccagagagaucauggaacagugggaaugaauggaucacugacuucgccggaaaaacggugugguuugugccgagcauaaaggcugguaacgauauugccaacugucugcgcaaaaauggcaagaaggucauccaacucucuaggaaaaccuucgacacagaguaccagaagacuaaauugaacgauugggacuuuguagugaccacagauaucuccgaaaugggggcgaauuucaaggcagaccguguuauugauccucggagaugccugaaacccgugauccucaccgacggaccagagagggucauucuggccggccccaugccugugacugcugccucagcugcacagcgccgagguagaguugggcggaacccacagaaggagaaugaucaauauauauuuacgggccagccccuuaacaaugacgaagaccaugcccacuggaccgaggcuaagaugcuacuggauaacaucaauacaccugaaggaauuaucccggccuuguucgagccagaaagggagaaaagugcagcgaucgacggcgaguaccgcuuaaagggggaaagccguaaaacuuuuguggagcugaugagacggggagaucuccccgucuggcuggcccacaagguggcuuccgaagguauuaaauauaccgacaggaaguggugcuucgauggccagcgcaacaaucagauacuugaggaaaacauggacguagagaucuggacaaaagagggggaaaagaagaaacugcgaccuagauggcucgaugcccggaccuacucugaccccuuggcacugaaggaguucaaagauuuugcugccggaaggaagucgauugcacuagaccuggugacugaaaucggccgcguuccaagccaucucgcccacagaacaaggaaugcucuugauaaccuggucauguuacauacgucagagcacggugggcgggcguaucgucacgccguggaagaguugccugagaccauggaaacucugcuccugcuuggccugaugauucucuugacaggaggcgcaaugcuguucuuaaucuccgggaaaggaauagguaagaccaguaucggccuaauuugugugaucgcuucuagcgggaugcuguggauggccgagauuccccuccaauggaucgccuccgcaauaguccuugaauuuuucaugaugguucuguugauuccagagccugagaagcagcgcaccccgcaggacaaucaacuggcuuacgugguaaucggaauucucacacuggccgcgaucauagcugccaacgaaaugggccuucucgagacuacgaaacgagaucuggguaugucaaaggaacccgggguggucucuccaaccagcuauuuggacguggaccugcauccugcaagugccuggacauuauacgcuguugcaacuaccgugaucacacccaugcuaagacacaccauugagaauuccacugccaacgucagccuggcggcuaucgccaaccaggcaguagugcucaugggccuugauaaaggauggccaauuucuaagauggaccugggcguuccuuugcuggcccucgggugcuacucacaggugaauccccugacgcuuacagcugccgucuuacugcucaucacccauuaugcaauaauuggaccgggcuugcaggcuaaagccacuagggaagcgcaaaagcggaccgccgcagguaucaugaagaacccaacaguggaugggaucaugacuauugaccuggauccugucaucuacgacuccaaauuugagaagcagcuaggacaggugaugcugcucguucuuugugcugugcagcuguugcugaugcgcaccaguugggcccucugcgaggcacugacauuagcuacgggccccauaaccacucuuugggaagguagcccaggcaaauucuggaauacaaccauugccguaucgauggccaacaucuuuagagggucuuaucuggcgggagcuggccucgcauucuccauuaugaagagcguggggacuggaaaaaggggcacagguucacaaggggagacccuaggagaaaaguggaagaaaaagcugaaucaguugagucggaaagaguuugaucuguacaagaaaucuggcaucacggaagucgaccgaaccgaggccaaggagggucucaaaagaggcgaaauaacacaccaugcuguuucccgcgggagcgccaagcuucagugguucguggagaggaacauggucauccccgaaggacgggugauugaucugggcugugggcguggaggcuggucauauuacugcgcagguuugaagaaaguaacugaggugagaggguauaccaagggaggcccuggccacgaagagccgguucccaugaguacauacggguggaauaucgugaaacugaugagcggaaaggacgucuuuuaccucccaccugagaaaugugauacuuuacugugcgacauuggugaauccucucccagcccuaccguggaggaauccaggacaauccgcguccuuaagaugguggagccauggcugaagaacaaucaguucuguauuaaaguucuaaaccccuauaugccuaccguaaucgagcaccucgaacggcugcaacgaaagcauggcgggauguuggugagaaauccacugucaaggaacucuacucacgagauguacuggauaaguaauggaacgggcaacauugucucgagcgugaauaugguuucccgccuccuucugaaccgguuuacaaugacccauagacgucccacuaucgaaaaagauguggacuuaggugccgggaccaggcacgucaacgcugagccggaaacaccuaauauggacgugaucggagagcggauuaagcgcauaaaagaggaacacaacucuacguggcauuaugaugacgagaauccauacaagaccugggcguaucacggcucauacgaaguaaaggccacuggcagcgcauccaguaugaucaacggggugguuaaacuguugacaaagcccugggaugucgugccuauggugacccagauggcuaugacugacacaaccccauucggacagcaacgagucuucaaagagaagguugauacaagaacucccaggccgaugccugguacccggaaagugaugggcauuacggccgaauggcucuggcgcacccuggggagaaauaagaggccccgacuaugcacacgggaggaguuuacuaagaaaguacguaccaacgcagccaugggagcuguguucacagaagagaaucagugggacucugccaaggcggcagucgaagaugaggaauuuuggaaacuuguggacagagagcgcgagcugcauaagcucggcaaaugugguagcugcguuuauaacaugauggggaagagggaaaaaaagcugggagaguucggcaaggccaaaggcucacgggcuaucugguacaugugguugggggccagauaccuggaauuugaggcacucggauuccuuaaugaggaucacugguuuucccgcgacaacaguuauagcgguguggaaggcgaggggcugcauaaguuaggauacauucugagggauaucucuaaaauaccaggcggugcuauguaugccgacgacacugcugggugggauacccgaaucacggaagacgauuugcacaaugaggaaaagauuacacagcagauggacccugagcaccggcaacucgccaacgcaaucuucaaacugaccuaccagaauaaggucgugaagguacagagacccacuccaacaggaaccguuauggauauuaucuccaggaaagaccagcgcggcucaggccaaguggggacuuauggacuaaacaccuuuacaaauauggagguccagcuugugcgucagauggaaggugagggcgugcugagcaaggcggaucucgaaaacccccaucugccugagaaaaagauaacgcagugguuggaaaccaaaggggucgagcgguuaaagagaauggccauuucgggagacgauugcguugugaagccaaucgacgauagguucgcuaacgcccugcucgcacuuaaugacaugggcaaaguacgcaaggauaucccgcaauggcagcccucuaaagguuggcacgacuggcagcaggugccuuuuuguagucaucacuuccacgagcugauuaugaaggacgggcgaaaacuagucgugccaugccggccccaagaugaacugauaggaagagcuaggaucucccagggcgccggcuggagccuccgcgagacugcauguuuggggaaggccuacgcgcagauguggucacugauguauuuucauagacgggaccuuaggcuggcuuccaacgccauuugcucugcaguuccugugcacugggucccaacaagccguaccacuuggaguauccaugcccaccaucaauggaugacaaccgaagauaugcucacgguguggaaucgaguauggauugaggacaaccccuggauggaagauaagacaccuguuaccacuugggagaaugugccguacuuaggaaaacgcgaggaccaguggugugguucccugaucggcuugaccagcagagcuacaugggcccagaacauaccaacugcaauccagcaaguccggucucugauugggaaugaagaguuccucgauuacaugcccucaaugaagagguuccgcaaagaagaggagagugaaggagcuaucugguga

SEQ ID NO: 15641 - RNA, 9873 nt, Artificial Sequence
  derived and/or modified CDS sequence (opt3) from DENV-3__KM190937__SS-prME
accucgcugugccucaugaugaugcuucccgccacacuggcuuuccacuugacuuccagagacggcgaaccuaggaugaucguggggaagaaugaacggggaaaaucuuuacuguuuaagacggccucagguauuaauauguguacccugauagccauggaucucggcgagaugugcgacgauacagucacuuacaaauguccacauaucaccgaaguugagccggaagacauugauugcugguguaaccugacaaguaccugggugacuuaugggacaugcaaucaggcgggagagcaccgccgagacaagcguagcguagcuaucgcaccccaugugggcaugggucuugauaccagaacgcagacuuggauguccgcagagggggccuggaggcaggucgaaaaaguggagaccugggcucugcggcacccuggauucacaauuuuggcacucuuucuggcccauuacaucggcacuucucugacccagaagguugugauauucauccucuuaaugcuggucacaccaucgaugaccaugcgcugugugggcguagggaacagagacuuuguugaaggacuuucaggugcuacguggguggaugucguguuggagcacggcgggugcgugacuacaauggccaagaauaaacccacccuggacauugagcuacagaagacugaagcgacacaacucgcaacccugaggaaacuuuguaucgagggaaagauuacgaacaucaccacagauagccggugcccuacucagggcgaagccauacugccagaggaacaggaccagaauuaugucuguaaacacaccuacguugaucgcgguugggggaacggaugcggcuuguucggcaaggggagucucgugacaugcgcuaaguuucaaugucuggaguccauugagggaaaaguagugcagcaugaaaauuuaaaguauacugucaucauuaccgugcacacaggugaccagcaucagguuggcaacgagaugcaaggggugaccgccgaaaucacuccccaggcaucuacggcugaggucauccugccugaauacggaacacucggccuugagugcagcccacgaaccggucuggacuucaaugagaugauuuccuugacuaugaaaaacaaggccuggauggugcacagacagugguuuuucgaucuaccgcugcccuggaccucaggggcgacagccgaaaccccuacuuggaauaggaaagagcuccugguaacauuuaagaacgcacacgcuaaaaagcaagaaguugugguccuuggcagucaggagggagccaugcauacggcucugaccggcgccacugaaauacagacaagcgggggaaccucuaucuucgcaggucacuugaagugucggcucaaaauggacaagcuggaguuaaaaggcauguccuaugccaugugccugagcucauuugugcuaaagaaagaggucagugaaacacagcaugggacuauucucaucaagguggaguacaagggagaagaugcuccauguaaaauacccuucucuaccgaggacggccaagguaaggcgcacaaugggcgucugauuacggcaaacccuguugugaccaaaaaggaggaaccaguaaacaucgaggccgaacccccguucggcgaguccaauaucgucauuggaaucggcgauaaagcucuuaagauuaacugguacaagaaagggagcucgauaggaaagauguuugaagccacagcacgcggugccagaaggauggcuaucuugggcgacacugccugggauuucgggucugugggaggcguucuaaauucccucgguaaaauggugcaucagauuuuugggucagcauauaccgcgcuguucggcggagucaguuggaugaugaagaucggcaucggggugcuucugacauggauuggauugaacagcaaaaauacuuccaugucuuuuagcugcauagcuaucggcauuaucacccucuaccugggugccguagugcaggcagacaugggguguguuauuaacuggaagggaaaggaguuaaaaugcggcucagguaucuucgucacgaaugaggugcacacauggaccgaacaguauaaguuucaagccgauaguccuaaacggcuggcuacugccauagcaggcgcuugggagaacgggguguguggaauccgauccacaacccgcauggaaaaucuacucuggaagcagauugccaacgagcugaauuacauccuuugggaaaacaauauuaaauugacugucguugugggcgacaucaccggggugcuggagcagggaaagagaacacucacgccccagccaauggagcugaaauauagcuggaagaccuggggcaaggcgaaaauaguaacugccgaaacacaaaacucuucauucauuaucgaugguccuaguacccccgagugcccaagcgcuuccagggcauggaaugucugggaaguggaggacuacggguuuggaguuuucacaacuaacauuugguuaaagcugcgggaaguguauacccagcuuugugaccaccgcuugaugucugccgcugucaaagaugagagagccgugcaugcagacaugggcuacuggaucgagucgcagaagaacgguagcuggaaacucgaaaaggcguccuuuauagagguuaagacgugcacauggcccaaaucacacacccuguggaguaauggcgugcuagaaucugauaugaucauuccuaagagccuggccgggccaaucucccagcauaaccacaggccgggauaccacacucaaaccgcuggccccuggcaucucgggaaacuggagcuugacuucaauuauugcgagggaacaacuguagucauuucagaaaacuguggcacccgugguccuagcuugcggacaacgaccgugucugggaagcugauccacgaguggugcugucgauccugcacuuuaccaccccucagauacaugggagaagauggcuguugguaugguauggagauaaggccuauuaaugaaaaagaggagaacauggugaagagucuggccagcgcaggcucugggaaggucgacaauuuuacaaugggaguucuuugccuggcuaucuuguucgaagaggugaugcgcggcaaauucgggaagauccauaugauugccggaguacucuuuaccuucgugcugcuacuguccggccagaucacuuggcgggauauggcacacacacucauuaugauagguucaaacgccagugacagaauggggaugggagucaccuaccuggcucuuaucgcgacguuuaaaauucagccauucuuggcccugggcuuuuucuuaaggaagcucacuagccgcgaaaaucugcuucugggcguggggcuagcaauggcugccacccuccgacugcccgaggauaucgaacaaauggccaacggaauugcuuugggucugauggcauuaaaacucaucacacaguuugagaccuaucagcuguggacugcccuuguuucgcugacauguuccaauaccauauucacauugacuguggcguggcggaccgcuacgcucauccuggccggcauuucucuacugccggucugccagagcucaaguaugcguaagacagacuggcuuccuaugaccguggcagccaugggggcucaaccacucccccuguuuaucuucuccuugaaggauacucugaaaagaaggucuuggccuuuaaacgagggaguuauggcagugggccucgucagcauucuggccuccucacuucugcgcaaugacguacccauggcggguccauugguggcugggggacuccugaucgccuguuacguuauaaccggcacaagcgcagaucuaacuguggaaaaggccgcugacgucaccugggaggaagaggccgaacagacgggcgugagucauaaccugaugguaacaguggacgaugacgggaccaugcggauuaaagaugacgagacugagaauauccuuacaguccuccugaagaccgcauuguuaaucguuucuggaauuuuuccuuauuccauacccgcuacucugcucguguggcacacauggcagaaacagacccaaagaagcggugugcugugggaugucccaucgccgccugaaacgcagaaggccgagcuugaagagggcguguacaggaucaaacagcaggggauuuucggaaagacucaaguuggcguaggugugcagaaggagggggucuuucacaccauguggcaugugacacgaggagcgguucugacccacaacggcaaacgcuuggaacccaacugggccucagugaagaaagaccuaaucucuuacggcgggggauggcggcugagugcacaguggcaaaagggugaggaaguccaggugauugcuguagagccaggcaaaaaucccaagaacuuccagacaaugccugggaucuuccagacuaccacgggagaaauaggcgccaucgcucucgauuuuaagccagguacauccgggagccccauuaucaauagagagggaaaagucgugggccuguauggcaacgggguugugacuaagaauggagguuacgucucuggcauugcacaaaccaacgccgagccugacgggccgacaccagaacuugaggaagagauguucaaaaagaggaauuuaaccaucauggaucugcaucccggaagcggcaaaacucguaaguaucucccugccauagugcgcgaagcuauuaagcggagauugaggacccugauccucgcgccaacacgaguuguggcagccgagauggaggaagcucugaaaggucuucccauccgguaccagacgacugccaccaaguccgagcacacagggcgcgaaauugucgaccugaugugccaugcaaccuuuacuaugagauugcuaucaccugugaggguaccgaacuauaaucugaucauaauggaugaggcccacuucacagaccccgcuaguauugcggcccggggauacaucagcacccgagugggcaugggcgaagcagcugccauuuuuaugacggcaacuccaccugggacagccgaugcuuucccccagucuaacgccccaauccaggacgaggagagagacauaccugaacgcuccuggaacucaggaaacgaguggauuaccgauuuuguugguaaaaccgucugguucgugcccaguaucaaggcgggcaaugacaucgcaaacugucucaggaaaaaugggaagaaggugauucaauuaagccguaaaacuuuugauacagaauaucagaagaccaaacugaacgacugggauuucgucguaacaacugacaucuccgagaugggagccaacuuuaaggcugaucgggugauugacccaagaaggugccuuaaaccgguuauacugacggauggcccugagcgcgugauccucgccggucccaugccagucaccguggcuucugcagcccagcgaagagggcggguuggcaggaauccccagaaggaaaacgaccaauacauuuucaugggacagccuuugaauaacgaugaggaccacgcucauuggacagaagccaagaugcugcucgacaauaucaacacuccagagggcaucauucccgcacuguucgaaccugagcgcgagaaaucggcggccauagauggggaauaccgucuuaagggagagagcagaaaaaccuuuguggaacuaaugcggaggggugaccugccggucugguuggcucacaagguggccucagagggcaucaaauauacagaucgcaaguggugcuucgacggggaacgaaauaaccagauuuuagaggagaauauggauguagaaaucuggaccaaagagggagaaaagaagaaacugagaccacgguggcucgacgcaaggacuuacuccgauccccuggcucuuaaggaguuuaaagacuucgccgcaggccgcaagaguauugcccuggaucucgugacggaaaucgguagaguuccuucucauuuggcucacaggacccggaacgcgcuggacaaucuagucaugcugcacacaagcgagcaugggggccgugccuaucgccacgcaguggaggaacuccccgagacuauggaaacccuucuguuauugggacugaugauacuccugacaggcggggcuaugcuuuuucugaucuccggaaaagguauuggcaagaccucaaucgggcucauuugugugaucgccucuagcggaauguuguggauggccgaugucccacugcaguggauagcaagugcuauuguuuuagaguucuuuaugauggugcuacugaucccugagcccgaaaagcaacgaacuccacaggacaaccagcucgccuacguagugauuggcauccuuacacuggcggcuauagucgccgcaaaugagauggguuugcuggaaacgaccaaaagagaucucgggauguccaaggagccuggcgugguuagcccgacuucuuaucuggacguggaccuucaucccgccucagcuuggacacucuacgcagucgccaccaccguaaucacaccaaugcugaggcacacuauugaaaacuccacggcgaaugugaguuuggcugccaucgcaaaccaagccguugugcugaugggauuagauaaaggcuggccuauuagcaagauggaccuaggggucccccugcucgcucuuggaugcuauagccaggugaauccacugaccuuggccgcagcuguccugcuccuggugacacauuacgccaucauaggcccuggucuucaggcgaaagccacucgggaggcacagaagcgcaccgcugccgggauuaugaagaaccccacaguugauggaaucaugaccaucgacuuagauccggugauuuacgacucuaaauucgagaagcaacugggccagguaaugcucuuggugcugugugcaguccagcuacugcucaugagaacuuccugggcucuuugcgaaguucugacguuggccacagguccaaucaccacucugugggagggcagcccugggaaauuuuggaacaccacaauagccgugucaauggcgaauauuuucaggggaaguuaucucgcuggcgcagggcuggccuuuucuaucaugaaguccgucggaacuggcaaacgggguaccgggagccagggagaaacauuaggcgagaaguggaagaagaaacuuaaccaacugucacgaaaagaguucgaucucuacaagaaaagugguauuacggagguggacagaaccgaggcuaaagaaggccuaaaacgcggggagaucacucaccacgccguaagcaggggauccgcaaagcugcagugguuuguggaacggaauaugguuauacccgagggccgugugaucgauuugggguguggaagaggcgguuggucuuauuacugcgccgggcugaagaaagucacagaagugaggggauauaccaagggcggcccagggcaugaggagcccgucccuaugagcacuuacggauggaacauugugaaacucauguccgguaaggacguuuucuaucuuccgcccgaaaaaugugauacacuguugugcgacaucggcgagucaucuccaaguccuaccguagaagagucgcgcacgauucgggugcugaagauggucgagcccuggcucaagaauaaccaguucuguaucaaaguguuaaauccuuacaugccaaccguuauugaacaccuggagcgacuucagagaaagcaugggggaaugcuggugaggaacccccuaagccgcaauuccacacacgaaauguacuggaucucuaacggcacugguaauauagucucaagcgugaacaugguaucccggcuccuguugaauagauuuaccaugacacaccguaggccuacuauugagaaagauguggaccugggggcuggaacccggcauguuaacgcggaaccagagacacccaauauggacgucaucggcgagcgcaucaagcgaauuaaagaagaacacaguucuaccuggcauuaugaugacgaaaacccguacaagacuugggccuaucacggcagcuacgaggugaaggcaacggggucagcuuccaguaugauaaacggaguggucaaacuccuuacaaagccuugggauguugugccaaugguaacccaaauggccaugacugacaccacacccuucggucagcagagaguguuuaaagaaaaggucgauacgaggaccccucggccaaugcccggcacucgcaaagugauggagaucacagcagaguggcuguggagaaccuuagggaggaauaagcgaccgcggcugugcacucgugaagaguucacaaagaaaguuagaaccaacgccgcuaugggagccguguuuacagaagagaaucaaugggacagcgcgcgcgcagccgucgaagaugaggaguucuggaaguugguggacagggaacgggagcuccauaaacugggcaagugugguucuugcguauauaacaugauggggaaaagagaaaagaaacuaggagaguuuggcaaggcuaagggcucccgcgccauuugguacauguggcuuggggcaagguaucuggaguucgaagcucucggauuucugaaugaggaucacugguucucacgagaaaacagcuacucggguguugagggcgaaggguugcacaaacugggauacauccuccgggacauuucuaagaucccuggcggugccauguaugcugaugacacugccgggugggacaccagaauaacggaggaugaccuucauaaugaggagaagaucacccagcagauggaucccgagcacaggcagcuggcaaacgcgauuuuuaaguuaacauaccaaaauaaaguggucaaggugcagcgcccaacuccuaagggaaccgugauggacaucauuagucguaaagaucagcggggcuccggccaggucgggacauauggacugaacacuuucaccaauauggaagcccaauugaucagacagauggagggugaaggcguucucagcaaggcugaccuggagaacccccauccacuagagaaaaagauaacgcaguggcuugaaacaaaagggguggagaggcugaagcgcauggccauuucaggagaugacugcguagugaagcccaucgaugaccgauuugcaaaugcucuccuggccuugaacgauaugggcaaaguccggaaggacaucccucaguggcaaccauccaaagguuggcacgauuggcaacaggugccguucuguucucaccauuuccacgaauuaauuaugaaggacgggagaaaacugguugugcccugcaggccucaggacgagcucauaggacgcgcaagaaucagccaaggcgccggcuggagucuucgggaaaccgcgugucuggggaaggcuuacgcccagaugugggcacuaauguauuuucauaggcgugaucugcgacucgccuccaaugcuauuugcagcgccgucccagugcacuggguacccacuucucgcacaaccuggucaauccaugcacaccaccaguggaugacuaccgaggacauguugacaguuuggaacagaguguggauugaggauaacccuuggauggaagacaagacgccagucaccacuugggaggaugugcccuaccugggaaaacgggaagaccaauggugugguagucuuaucggccugacauccagggcuaccugggcccagaauauacucacugcgauccagcagguucgcagcuuaauugggaacgaggaguuccuggauuauaugccuucuaugaagagauuucggaaagaagaggaaucggagggagcuaucugguga

SEQ ID NO: 15642 - RNA, 9873 nt, Artificial Sequence
  derived and/or modified CDS sequence (opt3) from DENV-3__JQ920487__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguugcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacagucguugugggagacgugaucggcguacuggagcaggggaaacgcacguuaacaccccagccaauggagcugaaguauaguuggaagacuuggggaaaagcgaagauagucacagccgaaacccaaaauuccagcuuuauuaucgauggcccuaacacacccgagugcccaucugcuucaagagcauggaacgugugggaaguugaggacuacgguuucgggguguuuacuaccaauauuuggcuuaaauugagggaaauguauacgcagcucugugaccaccggcugaugagugccgcugucaaggaugagcgcgccgugcacgcagacaugggauacuggaucgagagccagaaaaacggcuccuggaagcuagaaaaggcgucucugauagagguuaaaacaugcaccuggcccaagucgcauacucucuggagcaauggugugcuggaauccgauaugaucauuccuaaaucacuugccggcccaaucagucagcacaacuacagaccgggguaucauacccaaacagcuggacccuggcacuugggcaagcuggaguuagacuucaauuacugcgaggggacuaccguagucauuacagaaaacuguggaacgaggggcccuucucuccguaccacuacagugagcgguaaacugauccacgaguggugcugucgguccugcacccuuccaccccugcgauauaugggggaagauggauguugguacggcauggagauaagaccuauuaaugaaaaggaggagaacauggugaagucauuggucagcgccgguucuggcaaagcagacaauuuuacuauggggguucucugccuggcuauccuauucgaagaggugaugaggggaaaguucggcaaaaagcauaugaucgccggggcacuguuuacauucguacuccugcuuuccggacagauuaccuggcgcgauauggcccacacguugaucaugauuggcaguaacgcuagcgaccggauggguaugggggugacuuaucuggcguuaauagccaccuuuaaaauccagccauuccucgcacugggauuuuuccuuagaaagcugacaucuagggaaaaucuacuccugggcgucggcuuggcuauggccaccacucugcaauuacccgaggauauugaacagauggccaacgggaucgcucucggacugauggcacuuaagcugauuacacaguuugagaccuaccaguuguggacagcccucgugucccugauguguucaaauacuaucuucacccuaacgguugcguggcgcacagcuacccugauacuugccgugaucagucuccugccggucugccaaagcucguccaugcgaaaaacugacugguugccuaugaccguggcagccauggguguuccaccccugccuuuauuuauuuucucucucaaggauacacugaaacggcguagcuggccccuuaacgagggcgugauggcugucgggcugguaucaaucuuggcaaguuccuuucucagaaaugacgugccaauggccggaccucugguugcgggcggucuacugauugcuuguuaugugaucacugggaccucugccgaucuuacggucgaaaaggcagccgacgugacaugggaggaagaggcugaacagaccggaguaagccauaaccucaugauaacuguggacgaugacggcacaaugaggauuaaagaugacgagaccgagaacauccugacugucuuguuaaagacagcccugcucaucguuuccggcauuuuccccuacucaauaccagcaacccugcuuguguggcacacguggcagaaacagacucaacgcagcggggugcugugggaugucccgaguccucccgaaacccagaaggcugaguuggaagagggaguguaccggaucaagcagcaggguauuuuuggcaaaacacaaguugggguaggagugcagaaggagggcgucuuccauaccauguggcacgugacaagaggugccguucuaacucacaaugggaaaaggcuggaaccaaacugggcgaaugugaagaaagaccucaucucuuauggaggcggcuggaagcuguccgcccaguggcaaaagggggaggaaguccaggugauugcaguagagcccggcaagaacccuaagaauuuccagaccaugccagguaucuuucagacgacaacuggcgaaauaggggcuaucgcccuugauuucaaacccggaaccagcggcucgccuauuaucaaccgagaggguaaggucgugggguuauacggaaauggcguugugaccaagaacggcggguaugucucaggaauugcucaaaccaaugcagagccggacgguccaacucccgaacuggaggaagagauguuuaagaagcgcaaccucaccaucauggauuugcauccuggcucugggaaaacacggaaguaccugccagccauagugagagaagccauuaaaaggcgucuccgcacgcugauccuugcucccacucggguuguggcggcagagauggaggaagcccugaagggauugccuaucagauaucagaccacagcuaccaaaagugagcacacuggcagggaaauugucgaccuaaugugccaugccacauucaccaugcgacugcucuccccggugcggguacccaauuacaacuuaaucgugauggaugaggcacacuuuacggacccagccagcauagcugcgcgcgguuauauuucuacuagaguugggaugggagaagccgcagcuaucuucaugacagccaccccucccggcaccgcagaugccuuuccacagagcaaugcuccuauucaggacgaggagagggacauccccgaacgguccuggaacucaggcaaugaguggauaacugauuucgccgggaagacagucugguuugugccaaguauuaaggcgggaaacgacaucgcaaacugucugagaaagaaugguaagaaagugauccaacuuagcagaaagaccuucgauacagaauaccagaaaacuaagcugaacgacugggauuuugucguaacgaccgacauuucugagaugggcgccaauuucaaggcugaucgcgugaucgacccgaggcguugccucaaaccuguuauuuugacagaugggcccgagcgggugauacuggccggaccaaugcccgucacuguggcuuccgcagcccagagaaggggccgcguuggucgaaacccucagaaggaaaaugaccaauacaucuucaccgggcagccacucaacaaugaugaggaccaugcucacuggacagaagccaaaaugcugcuugacaacauuaauacccccgagggcaucaucccugcacuauuugaaccggagagagagaagucagcggccauugauggagaauaucggcugaaaggcgagaguaggaagacuuucguggaauugaugcgccguggggacuuaccagucuggcuggcucacaaaguggccagcgagggaauaaaguacacggauagaaaguggugcuuugacggugaacggaacaaucagauccucgaggagaacauggauguagaaauuuggaccaaagagggcgaaaagaaaaagcugaggccccgcuggcuugacgcacgaacauauuccgauccucuggcucucaaagaguucaaggacuuugccgcagggagaaagucuaucgccuuggaucuggugacugaaauuggacggguucccucgcaucuagcucacaggacccgcaaugcgcuggacaaccucgucaugcuucauacaagcgagcacggcgguagagccuacaggcacgcaguggaggaacugccagagaccauggaaacuuuauugcugcucgggcugaugauccuucugacaggcggagcuaugcuauucuugauaucaggcaaagggaucggaaagacguccauuggucugaucuguguggucgccaguucuggcauguuauggauggccgauguuccucuacaguggauugcaagcgcuaucgugcuggaguuuuucaugaugguacuccuuauacccgagccagaaaaacaacggaccccucaggacaaucagcuggccuauguggucauugggaucuugacucuggcggcuauuguggccgcaaacgagaugggacuccuggaaacaaccaagcgugaucuuggcauguccaaagagccggguguugugucacccaccucuuaccucgacgucgaccugcauccagccagcgcuuggacauuguaugcaguagccacuacggugaucaccccuaugcugcgccacacaauagaaaauaguacugcgaacguuuccuuagcugccaucgcaaaccaagccgugguccuaauggggcuggauaagggcuggcccauuagcaagauggaccucggagugccacuucuggcuuugggcugcuacucucaggucaauccucugacccucacagccgcagugcugcuuuuaguuacccauuacgcuaucauugggcccggacugcaggccaaagcgacucgagaggcccagaagagaacggcagcuggcaucaugaaaaacccgacaguggaugguauaaugaccauugaccucgauccaguaaucuaugacucaaaguuugagaaacaauugggacaggugaugcugcuaguccugugugccguucagcuccuucugaugaggacuuccugggcauucugcgaagcucuaacccuggccacaggaccuaucacuacccucugggagggcagucccgguaaguuuuggaauacaacgauugccgugagcauggcgaacaucuuccggggcucguaccuggcuggggcaggauuagccuuuucuauaaugaaguccgucggcaccgggaaacgcggaacuggcagccagggugaaacacuuggggagaaguggaaaaagaaacugaaucaacucucaagaaaggaguucgaucuauauaaaaagaguggaauuaccgagguggacaggacugaggcuaaggaaggccugaaacggggugagaucacacaccaugccguaucucgaggcuccgcaaaguugcagugguucguggaaagaaacaugguuauuccagaggggcgcgugaucgaucugggauguggcagaggcggguggagcuacuauugcgccgggcucaaaaaggucaccgaagugcgggguuacacgaaagggggacccggccacgaggagccugucccgaugucaaccuauggcuggaauauagugaaacuuaugagugggaaggacguauuuuaccugcccccagaaaaaugugauacauugcugugcgacaucggagagagcuccccuucucccacuguagaagagagccguaccauuagagugcucaagauggucgagccuugguugaaaaacaaucaguucuguaucaaggugcugaacccauacaugcccacaguuauugaacaccuugagaggcugcagcgcaaacaugguggcaugcuagugcggaauccucucucccgaaacucaacucacgaaauguauuggaucucuaaugggaccggaaacauugucaguucggugaauaugguaagcagacuguugcugaacagguuuacaaugacccaucgccggccaacuaucgagaaggauguggaccucggcgcugguacgagacacguuaacgcggaacccgagacaccgaauauggacgucauaggggagcguauuaggcggaucaaggaagaacacuccucuaccuggcauuacgaugacgaaaacccuuauaaaacuugggccuaccacggaucauaugaggugaaggcaaccggcagcgcuuccaguaugaucaauggcguggucaaacuucugacaaagccaugggauguugugcccaugguaacgcaaauggccaugaccgacacuacaccuuucgggcagcagcgcguguuuaaagaaaaggucgauacccgaacuccaagacccaugccgggaacaaggaaggugauggagauuaccgcagagugguuauggcggacacugggucgcaacaaaagaccuagguugugcacucgagaagaguucauaaagaaaguucggaccaaugccgcuaugggcgccguguuuacggaagagaaccaaugggacucugcgcgugcagccgucgaagaugaggaguucuggaagcucguggacagagaacgcgagcugcauaaacuagggaaguguggaagcugcguauacaauaugaugggcaaaagggaaaagaaacuuggugaguuugggaaagcuaagggaucacgggccaucugguauauguggcugggcgcaagauaccucgaguucgaagcucugggcuuuuugaacgaggaucacugguucucccgcgaaaauagucauagcgggguugagggagaaggucugcacaaacucggcuacauucuuagggacaucucuaagauucccgggggagccauguaugcugaugacaccgccggcugggacacacgaaucacugaggaugaccugcacaacgaggagaaaauaacccagcagauggauccagagcaucggcaguuagcaaaugcgaucuuuaagcugacauaccaaaacaagguggucaaagugcagagaccuacucccaaggguaccgugauggacauuaucuccaggaaagaucagcgcgggucaggacaggucggcacguauggcuugaauacauucaccaacauggaagcccaacucauucgucagauggagggggaaggaguucugagcaaggcugaccuagagaauccacaccuucuggagaaaaaggugacucaguggcucgaaacaaaggguguagagcggcugaaaagaauggccaucucgggcgaugacugcguggucaagcccauagaugacagguucgcaaacgcuuuguuagcccugaacgauauggggaaagugcgcaaggacauuccucaguggcaaccaucuaaaggauggcaugauuggcagcagguuccguuuuguagucaccacuuccaugaacucaucaugaaggacggccgaaaacuugugguccccugccggccucaggacgagcugaucgguagagcaaggauuucccaaggggccggauggagccuacgcgaaaccgcgugucugggcaaggcuuacgcccagaugugggcacucauguauuuucacagacgggauuugaggcuggccucaaaugcuauaugcuccgccgugccaguacauuggguucccacuucucguaccacauggagcauccacgcacaucaccaguggaugacgaccgaggacaugcuuacuguguggaaccgagucuggauugaggauaauccuuggauggaagacaagacaccagugaccacuugggaggauguucccuaccugggcaaacgcgaagaccaauggugugggagucucaucggauuaacauccagagcuaccugggcccagaacauucugacggcgauccaacaggugcggagcuugauagguaaugaggaguuccuggauuauaugccuucuaugaagagguuucgcaaagaagaggaaucagagggcgcuaucugguga

SEQ ID NO: 15643 - RNA, 9873 nt, Artificial Sequence
  derived and/or modified CDS sequence (opt3) from DENV-3__JQ920488__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgaaaugugcgacgauacagucacuuacaaguguccacugaucaccgaaguugaaccggaagacauugauugcugguguaaccuuacaaguaccugggugacuuaugggacaugcaaucaggcgggagaacaccgccgagacaagcguagcguagcucuggcaccccacgugggcauggguuuggauaccaggacgcagacuuggauguccgcagagggggccuggaggcaggucgaaaagguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaagcccacccuagacaucgagcuccagaagacugaagcgacacaacuggcaacccuuaggaagcuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcucuuagagcauggaacgucugggaaguggaggacuacgguuucgggguuuuuacuaccaauaucugguugaaacucagggaaaaguauacgcagcugugugaccaccggcuaaugucagccgcugugaaagaugagcgcgccguccacgcagacaugggauacuggauagagagucagaagaacgaaagcuggaagcuggagaaagcgucccucaucgaagugaagacaugcaccuggcccaaaucucauacucuguggucgaauggcguucuugagagcgauaugauuaucccuaaguccuuggccgguccaauuucacagcacaacuacagaccgggcuaucauacccaaacagcugggcccuggcaccugggaaaauuagagcucgacuucaauuacugcgaaggcacuaccgugguaaucacagagaacugugggauaaggggaccuagucugcguacgaccacugucucuggcaaacuuauucacgaauggugcugucggagcugcacacugccacccuugcgauauaugggugaggauggguguugguacggaauggaaaucagaccuaucaaugagaaggaggaaaacauggugaaaucccucgugucagccggcagcgguaagaccgacaauuuuacuaugggcguccugugccuagcaauucuguucgaggaaguuaugagggggaaauucggaaagaaacauaugaucgcuggcgcccucuuuacauucgugcugcuuuugucugggcagauuaccuggcgcgauauggcacacacgcugauaaugaucggauccaacgccagugaccggaugggcauggguguaacuuauuuagcucucauugcgaccuuuaagauccagccauuccuggcccuuggguuuuuccugagaaagcuaacaagcagggagaaucuccuguugggagugggccuggcaauggcuaccacuuuacaacuccccgaagauauugagcagauggccaacggcaucgcccuggggcuuauggcucugaaauugauaacacaguuugagaccuaccagcucuggacagcacugaucucucuaauguguuccaauacuauuuucacccugacggucgccuggcgcacagcgacccuuauccucgcugugauuucacuguugccgguuugccaaaguagcucgaugcgaaagacugacuggcugccuaugaccguggccgcaaugggagucccacccuuaccucucuuuaucuucucccugaaagauacacuuaagcggcguucuuggccccugaacgaaggugugauggccguuggcuuggugagcauacucgcuucaaguuuucugagaaaugacgucccaauggcagggccucuaguagccggaggccugcuuauugcguguuaugugaucacugguaccuccgcugaucucacgguugagaaagccgcagacgugacaugggaagaggaagccgagcagaccggggucucucauaaccugaugaucacuguggacgaugacggaacaaugaggauuaaggaugacgagaccgaaaacauauugacuguauuacugaaaacagcucuccugaucgugagcggcauuuuccccuacuccaucccagccacccuucuggucuggcacacguggcagaagcagacucaacgcucaggcguuuugugggaugugccgagcccucccgagacccagaaggcagaacuagaggaggggguguaccggauuaaacagcagggaaucuuugguaagacacaagucggcguggggguucagaaagaaggaguauuccauaccauguggcacgugacaagaggcgcuguccugacucacaaugguaagaggcucgagccaaacugggccaaugugaaaaaggaccugauaaguuaugggggaggcuggaaacuuggcgcgcaguggcaaaaaggggaagagguucaggugaucgccgucgaacccggaaagaacccuaaaaauuuccagaccaugccagguauuuuucagacgacaacuggcgagaucggggcaauugcuuuagauuucaagcccggaaccucuggcuccccuaucauaaaccgagaggguaaagugguagggcuguacggaaauggcgucgugacaaagaacggcggguauguuagcggaauugcccaaaccaaugcugaaccggacgguccaacucccgagcucgaagaggaaauguuuaagaaacgcaacuugaccaucauggaucugcauccuggcucggggaagacacggaaauaccucccagcaaucgugagagaggccauuaagaggcgucugcgcacgcuuauccuggcccccacucgggucguggcugcggagauggaagaggcauugaaaggacuaccuauaagauaucagaccacagccaccaagucagaacacacuggcagggagauuguugaccugaugugccaugcuacauucaccaugcgacucuuaucuccggugcggguccccaauuacaaccugaucgugauggaugaagcccacuuuacggacccagcaaguauugccgcucgcgguuauaucuccacuagaguagggaugggagaggcggccgcaauauucaugacagcuaccccucccggcaccgccgaugcauuuccacagagcaaugccccuauucaggacgaggaaagggacauccccgagcggucuuggaacagcggcaaugaauggaucacugauuucgcugggaagacagugugguuuguuccauccauuaaagccggaaacgacaucgcgaacugucuucgaaagaaugguaaaaaggucauucaacugucaagaaaaaccuucgauacagaguaccagaagacuaagcucaacgacugggauuuuguggugacgaccgacauaagugagaugggcgcaaauuucaaagccgaucgcgucaucgacccgaggcguugcuugaagccuguaauucugacagaugggcccgaacgggugauccucgcuggaccaaugcccguuacuguggccagcgcugcacagagaaggggccgcgucggucgaaacucucagaaagagaaugaccaauacaucuucaccgggcagccucugaacaaugaugaagaccaugcccacuggacagaggcuaagaugcuucuagacaacauuaauaccccagaaggcauaauccccgcccuguuugagccugagagagaaaaauccgcagcgauugauggagaguaucgguugaagggcgaaucaaggaaaacuuucguggaguuaaugcgccguggggaccugccgguuuggcucgcccacaagguggcuagugaaggaaucaaguacacggauagaaaauggugcuuugacggugagcggaacaaucagauucuggaggaaaacauggaugucgagaucuggaccaaggaaggcgagaaaaagaaacuuaggccacgcuggcuggacgcccgaacauauagcgauccccucgcauugaaggaguucaaggacuuugcugccgggagaaaauccauagcacuggaucuagugacugagaucggacggguaccuucucaucuggcccacaggacccgcaaugcucucgacaaccuugugaugcugcauacaucggagcacggcgguagagcguacaggcacgccguugaagaguuacccgaaaccauggagacuuugcugcuccuggggcuuaugauucugcucacaggcggagcaauguuguuccugaucagcggcaaggggauuggaaaaacgucaaucgguuuaauaugugucguggcuuccaguggcaugcuauggauggccgaugugccacugcaguggauugccucugcaaucguccucgaguuuuucaugaugguucuucugauuccugaacccgagaagcaacggaccccacaggacaaucaguuggcuuaugugguaaucgggauacugacucucgccgcgaucguggcugccaacgaaaugggacugcuugagacaaccaaacgugaucucggcaugagcaaggaaccuggugucguguccccgaccucauaccuggacguugacuugcaucccgcaucugccuggacacuguaugcuguggcaacuacggucauuaccccaauguuacgccacacaaucgagaauagcacugccaacguaagucuagcggcuauugccaaccaagcagugguucugauggggcucgauaagggcuggccuaucuccaaaauggaccuuggagugccccuguuggcccugggcugcuacagccaggucaauccacucacccugacagcugccgugcuuuuacuggucacccauuacgcaauaauugggccuggacuccaggcuaaggccacucgagaggcgcagaaaagaacggccgcaggcaucaugaagaaccccacaguggaugguaucaugaccauugacuuggauccgguuaucuaugacucuaaauuugaaaagcaacugggacaggugaugcuacugguacucugugcugugcagcuucuguugaugaggacuucaugggccuucugcgaggcacugacccucgcuacaggaccaauaacuacccugugggaaggcuccccugguaaguuuuggaauacaacgauugccgucaguauggccaacaucuuccggggcagcuacuuagcgggggcuggacuugcauuuucgauuaugaaaucuguuggcaccgggaagcgcggaacuggcucccagggugagacacugggggaaaaauggaagaaaaagcucaaucaacuaagcagaaaagaguucgaucuguauaagaagucaggaaucaccgagguggacaggacugaagccaaagagggcuugaagcggggugaaauaacacaccaugcugucagucgaggcucugccaaacugcagugguucguggagagaaacaugguaauccccgaagggcgcgugauugaucucggauguggcagaggcgggugguccuacuauugcgcagggcuuaagaaaguuaccgaggugcgggguuacacgaaagggggaccaggccacgaggaacccgucccuaugagcaccuauggcuggaauaucgugaagcugaugucagggaaagacgucuuuuacuugccgcccgagaagugugauacacugcucugcgacauuggagaaaguagcccauccccuacuguggaggagucucguaccaucagaguuuuaaaaaugguagaacccuggcugaagaacaaucaguucuguauuaaagugcuuaacccuuacaugccaacagucaucgagcaccuggaaaggcuacagcgcaagcaugguggcaugcucgugcggaauccccugagccgaaacuccacucacgagauguauuggauaucaaaugggaccggaaacauuguuucuagugugaauauggucucgagauugcugcucaacagguuuacaaugacccaucgccggccuacuaucgaaaaggauguggaccuuggcgccgguacgagacacguaaacgcugagccagagacacccaauauggacgugaucggggaacguauuaggcggauaaaagaggaacacagcuccaccuggcauuacgaugacgagaacccguauaagacuugggcguaccacggaucuuaugaaguuaaagccaccggcucagcaagcuccaugaucaauggcgucgugaagcuguuaacaaaaccuugggauguggucccaaugguuacgcaaauggcuaugaccgacacuacacccuucgggcagcagcgcguguuuaaggagaagguagauacccgaacuccuagaccaaugcccggaacaaggaaagugauggagauuaccgccgaauggcuguggcggacauugggucgcaacaagagaccgaggcucugcacucgagaggaguucaucaaaaagguccggaccaaugcagccaugggcgcuguguuuacggaggaaaaccaaugggacagugcccgugcggcaguugaggaugaggaguucuggaaacugguggacagagagcgcgaacuacauaaacuugggaaauguggaucuugcgucuacaauaugaugggcaagagggagaagaaacugggugaguuugggaaggccaaaggaagccgggcuauuugguauauguggcucggcgccagauaccuggaguucgaggcauugggcuuucugaacgaagaucacugguucucacgcgaaaauucccauagugggguggaaggagagggucuccacaaacuuggcuacauccugagggacauaagcaaaaucccugggggagcuauguaugccgaugacaccgcuggcugggacacacgaauuacugaggaugacuuacacaacgaagagaagaucacccagcagauggaucccgaacaucggcagcuggccaaugcaauuuuuaaguugacauaccaaaacaaaguaguuaaggugcagagaccaacuccuaaagguaccgucauggacaucauaucuaggaaggaucagcgcggguccggacaggugggcacguauggccucaauacauucaccaacauggaggcgcaacugauucgucagauggaaggggagggagugcuaucaaaagccgaccuugagaauccccaucugcucgaaaagaaggucacucaguggcuggagacaaaagguguugaacgguugaagagaauggcuaucagcggcgaugacugcgugguaaaaccaaucgaugacagguucgccaacgcauuacuggcucucaacgauauggggaaggugcgcaaagacauuccccaguggcaaccuucgaagggauggcaugauuggcagcaggucccauuuuguucucaccacuuccaugagcuuauaaugaaggacggccgaaaacuggugguuccgugccggccccaggacgaacuaaucgguagagccaggauuagucaaggggcaggauggucccugcgcgagaccgccugucucggcaaggcguacgcucagaugugggccuugauguauuuucacagacgggaucugaggcuugcaagcaaugccaucugcucagcugugccuguccauugggugccaacuucccguaccacauggucuauucacgcccaucaccaguggaugacgaccgaggacaugcugacuguauggaaccgaguuuggaucgaagauaaucccuggauggaggacaaaacaccugugaccacuugggaagaugucccauaccucggcaagcgcgaggaccaauggugugggagcuuaauaggacugacaaguagagcaaccugggcucagaacaucuugacggccauucaacaggugcggucccugaucgguaaugaggaguuccucgauuauaugcccagcaugaaaagguuucgcaaggaggaagagucugaaggcgcgauuugguga

SEQ ID NO: 15644 - RNA, 9873 nt, Artificial Sequence
  derived and/or modified CDS sequence (opt3) from DENV-3__JQ920489__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguaccuuaauagccauggaucucggcgagaugugcgacgauacagucacuuacaaguguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauacccggacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacauuaccacagauagccggugcccuacucagggcgaagccaucuugccagaggaacaggaccagaauuaugucuguaaacacaccuacguugaucgcgguugggggaacggaugcggccucuuuggcaaggggagucuggugacaugcgcuaaguuccaauguuuagaguccauagagggaaaagccguacagcacgaaaaucugaaguauacugugauuaucaccguccauacaggugaccagcaccaggugggcaacgagacccaagggguuacugcagaaauuacgccccaggcuucuacaguggaggccauccucccugaauacggaacccuuggccuggagugcagcccacgaacugguuuggacuuuaaugagaugauccuccugaccaugaaaaacaaggcguggaugguccauagacagugguucuuugaucucccgcugcccuggacauccggggccaccacugaaacaccuacguggaauaaaaaggagcuucuggugaccuucaaaaacgcacacgcuaagaagcaagaaguaguuguguugggcucacaggagggagccaugcacacugcucucacaggcgccaccgaaauucagacaagugggggaacuagcauauuugcaggucaucugaaauguagguuaaagauggacaaacuggagcuaaagggcaugucuuaugccaugugccucaaugcuuucguccugaaaaaggagguguccgaaacccagcacgggacgauccuuauuaaggucgaguacaaaggagaagaugcgccauguaagauccccuucucaaccgaggacggccaagguaaagcacauaacgggcgguugauaacagccaacccuauugugacuaagaaagaggaaccaguuaauaucgaggcugaacccccguuuggcgagagcaacaucgugauuggaaucggcgauaaggcccugaagauuaauugguacaaaaaggggaguucuauaggaaaaauguucgaagcaaccgcccguggugcucgcagaauggccauccucggcgacacagcaugggauuuuggguccguaggaggcguccugaacagccuugguaagauggugcaccagauuuucgggucggcguauacugcucuguuuucuggcguuuccuggaucaugaaaaucggaauuggcguguugcucaccuggauagggcuaaauucaaagaacacgaguaugagcuucuccugcaucgucauuggaaucauuacauuauaccugggcgccgugguacaggcagacauggguugugugaucaauuggaaggggaaagagcuaaagugcggaucuggcauauuuguuaccaacgagguccauacuuggacagaacaguauaaauuccaagccgauagcccuaagaggcucgcuaccgccaucgccggugcuugggagaauggcgugugugggauucggucaacuacccgaauggaaaaccugcuuuggaaacagaucgccaaugaguugaacuacauucugugggaaaauaacaucaagcucacaauaguggucggagacguuauuggcgugcuggagcaggggaaacgcacguuaacaccccagccaauggagcugaaguauaguuggaagacuuggggaaaagcgaagaucgugacagccgaaacccaaaauuccagcuuuauuaucgauggcccuaacacacccgagugcccaucugcuucaagagcauggaacguaugggaagucgaggacuacgguuucgggguguuuacuaccaauauauggcuuaaauugagggaaaaguauacgcagcucugugaccaccggcugaugagugccgcuguuaaagaugagcgcgccgugcacgcagacaugggauacuggaucgagagccagaagaacggcuccuggaagcuagaaaaagcgucucugauugaggucaagacaugcaccuggcccaaaucgcauacucucuggagcaauggugugcuggaauccgauaugaucauuccuaagucacuugccggcccaaucagucagcacaacuacagaccgggguaucauacccaaacagcuggacccuggcacuugggcaaacuggaguuagacuucaauuacugcgaggggacuaccguugugauaacagaaaacuguggaauuaggggcccuucucuccguacgaccacuguaagcgguaagcugauccacgaguggugcugucgguccugcacacuuccaccccugcgauauaugggggaagauggauguugguacggcauggagaucagaccuauuaaugaaaaggaggagaacauggucaaaucauuggugagcgccgguucuggcaagaccgacaauuuuacuaugggggugcucugccuggcaauccuauucgaagaggucaugaggggaaaauucggcaagaaacauaugauugcuggggcccuguuuacauucguucuccugcuuuccggacagauaaccuggcgcgauauggcacacacguugaucaugauuggcaguaacgccagcgaccggauggguaugggggugacuuaucuggcuuuaaucgcgaccuuuaagauucagccauuccucgcccugggauuuuuccuuagaaagcugacaucuagggaaaaucuacuccugggcguaggcuuggcaauggcuaccacucugcaauuacccgaggauaucgaacagauggccaacgggauagcccucggacugauggcucuuaaacugaucacacaguuugagaccuaccaguuguggacagcacucauuucccugauguguucaaauacuaucuucacccuaacgguggccuggcgcacagcgacccugauucuugcugucaucagucuccugccggugugccaaagcucguccaugcgaaagacugacugguugccuaugaccguugccgcaaugggugugccaccccugccuuuauuuauauucucucucaaagauacacugaagcggcguagcuggccccuuaacgagggcgucauggccguggggcugguuucaauuuuggcuaguuccuuucucagaaaugacgugccaauggcaggaccucuggucgccggcggucuacugaucgcguguuauguaaucacugggaccucugcugaucuuacgguggaaaaagccgcagacguuacaugggaggaagaggccgaacagaccggagugagccauaaccucaugauuacugucgacgaugacggcacaaugaggauaaaggaugacgagaccgagaacauccugacuguguuguuaaaaacagcucugcucauuguauccggcaucuuccccuacucaauuccagccacccugcuuguguggcacacguggcagaagcagacucaacgcagcgggguccugugggauguuccgaguccucccgaaacccagaaggcagaguuggaagagggaguguaccggaucaaacagcaggguauauuuggcaagacacaagugggggucggagugcagaaagagggcguuuuccauaccauguggcacguaacaagaggugcugugcuaacucacaaugggaagaggcuggaaccaaacugggccaaugucaaaaaggaccucaucucuuauggaggcggcuggaagcuguccgcgcaguggcaaaaaggggaggaagugcagguuauugccguggagcccggaaagaacccuaaaaauuuccagaccaugccagguaucuuucagacgacaacuggcgaaauuggggcaaucgcucuugauuucaagcccggaaccagcggcucgccuauaauuaaccgagaggguaaagucgugggguuauacggaaauggcguagucacaaagaacggcggguaugugucaggaaucgcccaaaccaaugcugagccggacgguccaacucccgaacuggaggaagagauguuuaagaaacgcaaccucaccaucauggauuugcauccuggcucugggaagacacggaaauaccugccagcaauuguuagagaagccaucaagaggcgucuccgcacgcugauacuugcccccacucggguggucgcugcggagauggaggaagcacugaaaggauugccuauuagauaucagaccacagccaccaagagugagcacacuggcagggaaaucguggaccuaaugugccaugcuacauucaccaugcgacugcucuccccgguucgggugcccaauuacaacuuaauugucauggaugaggcccacuuuacggacccagcaagcaucgccgcucgcgguuauauaucuacuagaguggggaugggagaagcggccgcaauuuucaugacagcuaccccucccggcaccgccgaugcauuuccacagagcaaugccccuauccaggacgaggagagggacauccccgaacgguccuggaacucaggcaaugaguggauuacugauuucgcugggaagacaguaugguuugugccaaguaucaaagccggaaacgacauugcgaacugucugcgaaagaaugguaaaaagguuauacaacuuagcagaaaaaccuucgauacagaauaccagaagacuaagcugaacgacugggauuuugucgugacgaccgacaucucugagaugggcgcaaauuucaaagccgaucgcgugauugacccgaggcguugccucaagccugucaucuugacagaugggcccgagcggguaauccuggcuggaccaaugcccgugacuguugccuccgcugcacagagaaggggccgcgugggucgaaacucacagaaagaaaaugaccaauacauuuucaccgggcagccucucaacaaugaugaggaccaugcccacuggacagaagcuaagaugcugcuugacaacauaaauaccccagagggcaucauucccgcccuauuugaaccugagagagagaaaagugcagcgaucgauggagaauaucggcugaagggcgagagcaggaaaacuuucgucgaauugaugcgccguggggacuuaccgguguggcuggcccacaagguugcuuccgagggaauuaaguacacggauagaaaauggugcuuugacggugaacggaacaaucagauccucgaggagaacauggauguggaaauauggaccagggagggcgaaaagaaaaagcugcgcccacgauggcuugacgccagaacauauucugauccccuggcacucaaagaguucaaggacuuugcugccgggcggaagucgaucgcauuggaucuggucacugaaauuggaagggugccuagccaucuagcccaccgcaccagaaaugcucuggacaaccucguaaugcuucauacaucagagcacggcgguagggcguaccggcacgccguggaggaacugcccgagaccauggaaacuuuauugcugcucgggcugaugauccuucugacaggcggagcaaugcuauucuugauuuccggcaaagggaucggaaagacgaguauaggucugauuuguguugucgcuucuagcggcauguuauggauggccgaugugccacuacaguggaucgccuccgcaauugugcuggaguuuuucaugaugguccuccuuaucccugagcccgaaaaacaacguaccccacaggacaaucagcuggcuuauguugugauagggaucuugacucuggccgcgauuguagcugccaacgagaugggacuccuggaaacaaccaagcgcgaucuuggcaugucaaaagagccugguguggucucuccgaccagcuaccucgacguggaccugcaucccgcaagugccuggacauuguaugcuguugcaacuacggugaucaccccaaugcugcgacacacaauugaaaauuccacugccaacgucagcuuagcggcuaucgccaaccaagcaguagugcuaauggggcuggauaagggcuggccuauaucuaagauggaccucggaguuccccuucuggccuugggcugcuacucacaggugaauccacugacccucacagcugccguccugcuuuuagugacccauuacgcaauuaucgggccuggacugcaggcuaaagccacuagagaggcgcagaagaggacggccgcaggcaucaugaaaaaccccacagucgaugguauuaugaccaucgaccucgauccggugauauaugacuccaaguuugagaaacaauuggggcagguuaugcugcuagugcugugugcuguacagcuccuucugaugcggaccaguugggccuucugcgaagcauugacucuggcuacaggaccaauuacuacccucugggagggcagcccugguaaguuuuggaauacaacgaucgccgugucgauggccaacauuuuccgcggcucuuaccuggcgggggcuggauuagcauuuuccaucaugaaaagcgucggcaccgggaaaagaggaacuggcucacagggugaaacacuuggggagaaguggaaaaagaaacugaaucaacucaguaggaaggaguucgaucuauauaaaaagucuggaauaaccgagguugaccggaucgaggccaaggaaggccugaaacgaggugagauuacucaccaugcuguguccagaggcagcgccaaguugcagugguucgucgaacgcaacauggugauccccgaggggaggguaauugaucugggauguggcagagggggauggucauacuauugcgcaggccucaaaaaggugacagaaguucgugguuacaccaaagggggaccaggccacgaggagcccgugccuaugaguacguauggcuggaauaucgucaaacuuaugagcgggaaggacguguuuuaccugccgcccgaaaaaugugauaccuugcugugcgacauuggagaguccucuccaagcccuacagucgaagaguccagaacuaucagggugcucaagaugguugagcccuggcuaaagaacaaucaguucuguauaaagguacugaacccuuacaugccaaccgugauugaacaccuugagcgccugcagcggaaacaugguggcaugcuaguccgaaauccccucucaagaaacucuacacacgaaauguauuggaucaguaaugggacuggaaacaucgugucgagcguuaauaugguguccaggcuguugcugaaccgcuuuaccaugacacaucggagaccuaccauugagaaggaugucgaccucggcgccgguacucgucacgugaacgcugaaccagagacgcccaauaugaacguaauaggggagaggauccggcgcauuaaggaagaacacucuucaacauggcauuacgacgaugaaaauccguauaaaaccugggcguaccacggaagcuaugaggugaaggccacuggcuccgcaaguucuaugaucaacggcguugucaaacuucugaccaagccuugggacguggugccaauggucacacaaauggcuaugacggauaccacucccuucgggcagcagcgaguuuuuaaagaaaagguggacacaagaaccccuaggccaaugcccggaacucggaagguaauggagauuacagccgagugguuauggcgcacccuggguagaaauaaaaggccgcgauugugcacacgggaagaguucaucaagaaagugcguacuaacgcagccaugggcgcugucuuuaccgaagagaaucaaugggauagcgccagagcggcaguggaagacgaggaguucuggaagcucguugaucgcgaaagggagcugcauaaacuagggaaguguggaucaugcguguacaacaugaugggcaaacgggaaaagaaacuuggugaguuugggaaagccaagggauccagagcuauaugguauauguggcugggcgcccgcuaccucgaguucgaagcacugggcuuuuugaaugaggaccacugguucaguagggaaaacagccauucuggggucgagggagaaggucugcacaaacucggcuacauccuucgagauauuuccaagaucccugggggagcuauguaugccgacgauacggcuggcugggacacccggauuacagaggacgaucugcacaaugaggagaagaucacucagcagauggaccccgagcauagacaguuagccaacgcaauauuuaagcugaccuaccaaaauaaggugguaaaaguucagaggccaacaccuaaggguacugugauggauauuaucucacgcaaagaccagcgugggagcggacaggucggcaccuauggcuugaacacguucacaaauauggaagcgcaacucauccggcagauggagggggaaggagugcugucgaaggccgaucuagagaacccccaccuucuggagaaaaaggugacccaguggcucgaaacuaagggugucgagagacugaaaaggauggcuauuucuggcgacgauugcguugugaagccaauagacgaucgcuucgccaacgcauuguuagcucugaaugacauggggaaaguacgaaaggauaucccccaguggcaaccuaguaaaggauggcaugacuggcaacaggugccauuuuguucccaccacuuccaugaacucauuaugaaggauggccggaaacuugucgugccgugcagaccccaggacgagcugaucgguagggcccgcauuagccaaggggcaggauggucacuaagagaaacagccugucugggcaaagcguacgcucagaugugggcccucauguauuuucaccggagggacuugcgucuggcauccaacgccaucugcucugcuguuccugugcauugggucccaaccagccgaacuaccuggaguauacacgcccaucaccaguggaugacaacggaggauaugcuuaccguguggaaucgcguauggaucgaggacaaccccuggauggaagauaagacuccuguuacaaccugggaggacgugccauaccugggcaaaagagaagaucaauggugugggucccucauuggauuaacuagccgggcaacaugggcucagaauauccugaccgccauucagcaggucaggucuuugaucgguaacgaggaguuccuggacuauaugcccucaaugaagcgcuuuagaaaagaagaggaaagugagggcgcgauuugguga

SEQ ID NO: 15645 - RNA, 9873 nt, Artificial Sequence
  derived and/or modified CDS sequence (opt3) from DENV-3__KF824902__SS-prME
acaagccugugccucaugaugaugcuucccgccacacuggcuuuccacuugacuuccagagacggcgagccuaggaugaucguggggaagaacgaacgggggaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguggcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaacaaccgagacuccuacauggaauaggaaagaacuguugguaacguuuaagaacgcucacgccaaaaagcaagagguugugguccucggcucacaggaaggagcuaugcacaccgcccugacuggcgcaacagagauccagaauagugggggaaccagcauuuucgccggucauuuaaagugucggcugaaaauggauaagcuagaacucaaaggcaugucuuaugcuaugugccugaacacauuugugcuuaagaaagaggucuccgagacucagcacgggaccauauugaucaagguggaauacaagggagaggacgcgccauguaaaauucccuucucaacggaagauggccaagguaaggcacauaacgggcgucugaucaccgccaauccuguugugaccaagaaggaggagccaguaaacauagaagcugagcccccguucggcgaaagcaauauugucaucggaaucggcgacaaagcccucaagauuaacugguacaagaaagggaguucuaucggaaagauguuugaggcaacugcccgcggugcuagaaggauggccauucugggcgauaccgcaugggacuucggguccgugggaggcguucuuaauagccuggguaaaauggugcaccagauauuugggucggcguauacagcuuuguucggcggagucucuuggaucaugaagauuggcaucggggugcuccugacuuggaucggauuaaacuccaaaaauaccucaaugaguuuuagcugcauuguaauaggcaucauuacgcuguaccuagguacagugguucaggccgauauggggugugucaucaacuggaagggaaaggaacucaaaugcggcuccgguauuuucgugaccaaugaggugcauacuuggacagagcaguauaaguuucaagcagacucuccuaaacggcuggccaccgcuaucgccggcgcaugggaaaacggggucuguggaauacgaagcacuacccgcauggagaaucuuuuguggaagcagaucgcuaacgaacugaauuacauucucugggagaacaauaucaaacugacaguuguggugggcgauauuaucgggguauuagaacagggaaagagagcccugacgccccagccaauggagcuuaaauauucauggaagaccuggggcaaggcgaaaauagucacugccgagauucaaaacaguuccuucaucauugacgguccuaacacacccgaaugcccaagcgcuucuagggcauggaaugugugggagguugaagacuacggguuuggaguguucaccacaaacaucugguugaagcuccgggaggucuauacucagaccugugaucaccgccugaugucagccgcuauaaaagacgaaagagccgugcacgcagauaugggcuacuggaucgagagucagaagaaugguagcuggaaacuagagaaggcguccuuuauugaaguuaagacgugcacauggcccaaaacccauacucuguggucuaacggcgugcucgagucggacaugaucauuccuaagagccuggccgggccaaucucccagcacaaucauaggccgggauaccacacccaaacagcuggccccuggcaccuugggaaauuggaacuggauuucaacuauugcgagggaacuaccguagucauaacagagaauuguggcacgcgugguccuucauuacggaccacuacagugagugggaagcucauucaugaauggugcugucgaucuugcacccugccaccccuuagauacaugggagaggacggcuguugguaugguauggaaaucaggccuaucaacgagaaagaagagaauaugguaaagagccuggucuccgccggcucagggaagguugauaacuuuacuaugggaguguugugccucgcaauucuguucgaggaaguaaugcgcggcaaauucgggaagaaacacaugaucgcuggagugcuauuuacauucaugcugcuccugagcggccagauuaccuggcgggacauggcccauacgcuuauaaugaucgguucuaaugcauccgauagaauggggaugggagucacuuacuuggcccugauugcuaccuuuaagauccagccauucuuagcgcucggcuuuuuccugaggaaacuuacaagucgcgagaaccugcuacucggcguggggcuggccauggcaaccacuuugcaacugcccgaagacauugagcagauggcuaauggaaucgccuuaggucucauggcccugaaacuuauaacacaguuugaaaccuaucagcuguggacagcuuugguuagccucacuuguucuaacaccaucuucacgcugacaguggcauggcgaaccgccacucuaauucuggcgggcgucucccuucucccggugugccaaucaaguagcaugcggaagaccgauuggcugccuguugcuguggccgcaaugggggucccacccuugccucuguuuaucuucucguuaaaagacacacucaagcguagauccuggccccugaaugagggaguaauggccgugggccuuguuucuauucuggcuagcucauugcucaggaacgaugugccaauggcagguccucuggucgccgggggacuacugaucgcguguuacgugauaacuggcaccagugcugaccuuacgguagagaaagccgcagacgugacaugggaagaggaagccgagcagaccggcgucucccacaaccucaugauuacuguugaugacgaugggacaaugcgcaucaaggacgaugaaaccgagaauauccugacuguguuguuaaaaacagcucugcucauugugucuggaauauuucccuauagcaucccagccacccugcuugucuggcauacguggcagaagcagacucaacgguccggugugcugugggacguuccgucaccucccgagacccagaaagcagaauuggaggaaggcguauacagaauuaagcagcaggggaucuucggaaagacacaagugggcgucggugugcagaaagaggggguuuuucacaccauguggcacgugacaaggggagcuguccuaacucauaacggcaagcgacuggagccaaauugggccagcgugaaaaaggaucucauuaguuacggcgggggauggcgccugucugcgcaguggcaaaaaggugaagagguacaggucaucgccguggaacccggccggaacccuaagaauuuccagaccaugccagggauauuccagacgacaacuggagagaucggcgcaauugcucuugacuuuaagcccgguaccuccgggagcccuaucauuaacagagaaggaaaaguugugggcuuauauggcaauggggucgugacaaagaacggagguuacguuucgggcaucgcccaagcuaaugcagagccggaggggccaacccccgaacuggaggaagagauguucaaaaagaggaaccucacuauaauggauuugcacccuggaucaggcaaaacccguaaguaucugccagccauugugcgcgaagccaucaagcggagacucaggacacugauccuugcucccacgcgagucguggcggcagagauggaggaagcccugaaagguuugccuauucgguaccagacuaccgcuacaaagucugagcauaccgggcgcgaaaucguagugcuaaugugccacgccacuuuuacaaugagacugcucaguccgguuaggguccccaauuauaacuuaauaauuauggacgaggcacauuucaccgauccagccuccaucgcugcgcggggauacauuagcacgcgagugggcaugggcgaagccgcagcuaucuuuaugacugccacaccucccgggaccgcagaggccuucccacagucuaaugcuccuauacaggacgaggaaagagauauucccgagcgcagcuggaacuccggaaaugaauggaucaccgacuuuguggguaaaacugucugguucguaccaucaaucaaggccggcaacgacauugcgaacugucugaggaaaaaugggaagaaggugauccaacuuagucguaaaacauuugauaccgaguaucagaagacaaaacugaacgacugggauuucguugugacuacggacauuagcgagaugggagcaaauuuuaaggccgaucgggucauagacccgagaaggugccucaaaccugugaucuugaccgauggccccgaacgcguuauucuggcugguccaaugcccgugacagccgcuucugcagcccagcgaagagggcgggucggcaggaacccucagaaggagaaugaccaauacaucuucaugggacagccacucaacaaugaugaagaccacgcucacuggacugaggccaagaugcugcuugauaacaucaauacccccgaaggcauuauaccugcacuauucgagccggagcgcgaaaaauccgcggccaucgacggggaguaccgucugaagggagaaucaagaaaaacauuuguggaguugaugcggaggggugacuuaccaguauggcuggcucauaagguggccagugaaggcauuaaauauaccgaucgcaaguggugcuucgacggggagcgaaacaaucagauccucgaggaaaacauggauguugagauuuggacuaaagaaggagagagaaagaagcugcggcccagguggcuugacgcacgcacguacagcgauccucuggcucucaaagaauuuaaggacuucgccgcaggcagaaaauccaucgccuuggaucuggucaccgagauagguagggugcccucucaccuagcucaucggacacguaaugcgcuggacaaccucgugaugcuucacacuucggagcacgggggccgcgccuaucgacaugcagucgaggaacugccagaaaccauggagacauuauugcugcucggacugaugauccuucugaccggcggggcuaugcucuuuuugauuagcggaaaggguaucggcaaaacuucaauugggcugaucuguguuauaguguccaguggaauguuauggauggccgauguaccucuacaguggauugccucugcaaucgugcuggaguucuuuaugaugguccuccuuauucccgaaccagagaagcaaagaacaccucaggacaaucagcuggcuuacgugguuaucggcauauugacgcuggccgcgaucguggcugccaacgaaaugggucuccuggagaccacuaagagggaucuugggaugagcaaagaaccgggcgucguaucccccacaucauaucucgacguggaucugcacccagcaucugccuggaccuuguacgcuguugcaaccacagugauuacuccuaugcugcggcauacgaucgagaauagcaccgccaacgucaguuuagcggcuauugccaaccaagcagugguccuaaugggacuggacaagggcuggcccaucuccaaaauggaccucggggugccacuucuggccuugggaugcuauagccagguuaauccucugacacucacugcugccgugcugcuuuuaguaacccacuacgcaauaauuggccccggucugcaggcuaaggccacacgcgaggcgcagaaaagaaccgccgcagggaucaugaagaacccgacuguggauggaaucaugacgauugaccucgauccagucaucuacgacucuaaguucgaaaaacaauugggccagguuaugcugcuagugcugugugcuguccagcuccuucugaugaggacaucaugggccuugugcgaggcacugacccucgcuacugguccuauaaccacacugugggaaggcucccccgggaaguuuuggaauacuaccauugccgugaguauggccaacaucuuccggggaagcuauuuagcgggcgcugggcuugcauuuucgauuaugaaaucuguaggaacaggcaagcgagguacggggucccagggagagacccugggcgaaaaauggaagaagaaacucaaucaacuaagcagacgcgaguucgagcuguacaagaaaucagguaucacugaaguggauaggacagaggccaaggaaggcuugaaacguggggaaaccacucaucacgcuguuagucggggaucugccaagcugcagugguuuguggaaagaaacauggucauaccagagggcagggugaucgaccucggguguggacgcggcgguugguccuauuacugcgcagggcuuaaaaaggucacagaggugcggggauauaccaagggcggccccgggcacgaagaaccuguuccgaugagcacguacggauggaauaccguaaaacugaugucagguaaggauguguucuauuugcccccagaaaaaugugacacacugcucugcgauauuggcgagaguagcccuucccccacugucgaggaaucucgaaccaucagaguguuaaagaugguugagccuuggcugaaaaacaaucaguucuguauuaaggugcuuaacccauacaugcccacagucaucgaacaucuggagaggcuacagcgcaagcacgggggaaugcucgugcggaauccucugagcagaaacuccacucaugaaauguacuggauuucaaauggcaccgguaacaucguaucuagugugaauaugguuucgcguuugcugcucaacagguuuacaaugacccaccggcgcccaacuauagagaaagacgucgaucuuggggccggaacgcgacacgugaacgcugagcccgaaacaccgaauauggacgugauuggcgagagaaucaagaggaucaaagaagaacacagcuccaccuggcacuaugaugacgaaaacccuuacaagacuugggcguaucauggcucuuacgaggucaaagccaccgggucagcaagcuccaugauuaauggaguugugaagcuguuaacaaagccaugggacguagugcccauggucacgcaaauggcuaugaccgauacuacaccuuucggucagcagcggguguuuaaagagaagguugacacccgcacuccaagacccaugccgggcacaaggaaagugauggaaauaaccgccgaguggcuguggcgaacauuggggcggaacaagcguccuagacucugcacucgcgaagaguucaccaaaaaggucaggacgaaugcagccaugggagcuguguuuaccgaagagaaccaaugggagagugcccgggcggcaguagaagaugaggaguucuggaagcugguuggcagagagcgcgagcuacacaaacuugguaagugugggucuugcguguauaauaugaugggaaaaagggaaaagaaacugggcgaguuuggcaaggccaaagggagccgagcuaucugguacauguggcucggagcccgguaucuggaguucgaggcauuggguuuucugaacgaagaccauugguucucaagagaaaauuccuacaguggcgucgagggggaaggacuccacaaacuuggcuacauucugagggauaucagcaagauucccgguggggcuauguaugccgacgauacagcuggaugggacacucgcaucaccgaggaugacuuacacaacgaagagaaaauaacacagcagauggauccagaacaucgucagcuggccaaugcaaucuuuaaguugacuuaccaaaacaaaguggugaagguccagcggccuacccccaaaggcacgguuauggacauuaucucuagaaaggaccagaggggcuccggacaggugggaacauauggucucaauaccuucacuaacauggaggcgcaacugauucgccagauggagggcgaagggguacuaucaaaggccgaucuugagaauccacaucugcucgagaagaagaucacacaguggcuggagaccaaaggaguggaacgauugaagcggauggcuauaagcggcgacgauugcgucgugaaacccauugacgauagauuugccaacgcauuacuggcucucaacgacauggguaagguuaggaaggauaucccucaguggcaaccaucgaaaggguggcaugacuggcaacaggugccguucuguucucaccacuuccaugagcuuaucaugaaggauggacgcaaacuggucgugcccugcagaccucaggacgagcuaauuggccgggccaggauaagucaaggcgcaggguggucccugaaggaaacugccugucucggaaaagcguacgcucagauguggagcuugauguauuuucaccgucgagaucugcgccuugccucaaaugcaaucugcuccgccguaccaguucauugggugcccaccucuagaacaacguggagcauucacgcucaucaccaguggaugaccacugaggacaugcugacagucuggaaccggguguggaucgaagauaauccuuggauggaggacaagaccccaguuacuacaugggaggacgugcccuaccucgguaagagggaagaucaaugguguggcaguuuaauugggcugaccucccgcgccacgugggcacagaacaucuugacagcuauacagcaggucagaagccugaucggagacgaggaguuccucgauuauaugccuucuaugaaacgguuuaggaaggaggaagagucagagggcgccauuugguga

SEQ ID NO: 15646 - RNA, 9873 nt, Artificial Sequence
  derived and/or modified CDS sequence (opt3) from DENV-3__KF824903__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucacaauuacugugcauaccggugaccagcaccagguuggcaacgacacacaaggggugaccgcugagaucacuccccaggccucuacggucgaagcgauucuuccugaguacggaacacugggcuuggaaugcagcccacgaaccggucuagauuucaaugagaugauccugcucacuaugaaaaacaaggccuggauggugcauagacagugguuuuucgaccugccgcuucccuggaccuccggggcaacaaccgagacuccuacauggaauaggaaagaacuguugguaacguuuaagaacgcucacgccaaaaagcaagagguugugguccucggcucacaggaaggagcuaugcacaccgcccugacuggcgcaacagagauccagaauagugggggaaccagcauuuucgccggucauuuaaagugucggcugaaaauggauaagcuagaacucaaaggcaugucuuaugcuaugugccugaacacauuugugcuuaagaaagaggucuccgagacucagcacgggaccauauugaucaagguggaauacaagggagaggacgcgccauguaaaauucccuucucaacggaagauggccaagguaaggcacauaacgggcgucugaucaccgccaauccuguugugacaaaaaaggaggagccaguaaacauagaagcugagcccccguucggcgaaagcaauauugucaucggaaucggcgacaaagcccucaagauuaacugguacaagaaagggaguucuaucggaaagauguuugaggcaacugcccgcggugcuagaaggauggccauucugggcgauaccgcaugggacuucggguccgugggaggcguucuuaauagccuggguaaaauggugcaccagauauuugggucggcguauacagcuuuguucggcggagucucuuggaucaugaagauuggcaucggggugcuccugacuuggaucggauuaaacuccaaaaauaccucaaugaguuuuagcugcauuguaauaggcaucauuacgcuguaccuagguacagugguucaggccgauauggggugugucaucaacuggaagggaaaggaacucaaaugcggcuccgguauuuucgugaccaaugaggugcauacuuggacagagcaguauaaguuucaagcagacucuccuaaacggcuggccaccgcuaucgccggcgcaugggaaaacggggucuguggaauacgaagcacuacccgcauggagaaucuuuuguggaagcagaucgcuaacgaacugaauuacauucucugggagaacaauaucaaacugacaguuguggugggcgauauuaucgggguauuagaacagggaaagagagcccugacgccccagccaauggagcuuaaauauucauggaagaccuggggcaaggcgaaaauagucacugccgagauucaaaacaguuccuucaucauugacgguccuaacacacccgaaugcccaagcgcuucuagggcauggaaugugugggagguugaagacuacggguuuggaguguucaccacaaacaucugguugaagcuccgggaggucuauacucagaccugugaucaccgccugaugucagccgcuauaaaagacgaaagagccgugcacgcagauaugggcuacuggaucgagagucagaagaaugguagcuggaaacuagagaaggcguccuuuauugaaguuaagacgugcacauggcccaaaucucauacccuguggucgaacggcgugcucgagagcgacaugaucauuccuaagucccuggccgggccaaucucacagcacaaucauaggccgggauaccacacucaaaccgcuggccccuggcaccuugggaaauuggaacuggauuucaacuauugcgagggaacaacuguagucauaaccgagaauuguggcacacgugguccuaguuuacggacgaccacugugucugggaagcucauucaugaauggugcugucgaagcugcacacugccaccccuuagauacaugggagaggacggcuguugguaugguauggaaaucaggccuaucaacgagaaagaagagaauauggugaagucccuggucucagccggcagcgggaagguugauaacuuuaccaugggaguguugugccucgcaauucuguucgaggaaguaaugcgcggcaaauucgggaagaaacacaugaucgcuggagugcuauuuacuuucaugcugcuccugucuggccagauuacauggcgggacauggcccauacccuuauaaugaucgguuccaaugcaagugauagaauggggaugggagucacguacuuggcccugauugcuacuuuuaagauccagccauucuuagcgcucggcuuuuuccugaggaaacuuaccagccgcgagaaccugcuacucggcguggggcuggccauggcaacaaccuugcaacugcccgaagacauugagcagauggcuaauggaaucgccuuaggucucauggcccugaagcuuauaacucaguuugaaacauaucagcuguggaccgcuuugguuucucucacauguuccaacacuaucuucacccugacgguggcauggcgaacagccacccuaauucuggcgggcgucucacuucucccggugugccaaaguagcucgaugcggaagacugauuggcugccuguugcuguggccgcaaugggggucccacccuugccucuguuuaucuucuccuuaaaagacacccucaagcguagaucuuggccccugaaugagggaguaauggccgugggccuuguuagcauucuggcuucaaguuugcucaggaacgaugugccaauggcagguccucuggucgccgggggacuacugaucgcguguuacgugauaacaggcacuuccgcugaccuuaccguagagaaagccgcagacgugacgugggaagaggaagccgagcagacaggcgucucucacaaccucaugauuaccguugaugacgaugggacuaugcgcaucaaggacgaugaaacagagaauauccugaccguguuguuaaaaacugcucugcucauugugagcggaauauuucccuauuccaucccagccacacugcuugucuggcauaccuggcagaagcagacgcaacggucaggugugcugugggacguuccgagcccucccgagacucagaaagcagaauuggaggaaggcguauacagaauuaagcagcaggggaucuucggaaagacccaagugggcgucggugugcagaaagaggggguuuuucacacaauguggcacgugaccaggggagcuguccuaacacauaacggcaagcgacuggagccaaauugggccagugugaaaaaggaucucauuucuuacggcgggggauggcgccuguccgcgcaguggcaaaaaggugaagagguacaggucaucgccguggaacccggccggaacccuaagaauuuccagacuaugccagggauauuccagaccacgacaggagagaucggcgcaauugcucuugacuuuaagcccgguacuagcgggucgccuaucauuaacagagaaggaaaaguugugggcuuauauggcaauggggucgugaccaagaacggagguuacguuucaggcaucgcccaagcuaaugcagagccggaggggccaacacccgaacuggaggaagagauguucaaaaagaggaaccucaccauaauggauuugcacccuggaucuggcaaaacucguaaguaucugccagccauugugcgcgaagccaucaagcggagacucaggacccugauccuugcucccacacgagucguggcggcagagauggaggaagcccugaaagguuugccuauucgguaccagacgacugcuaccaagagugagcauacagggcgcgaaaucguagagugcaugugucacgccaccuuuacuaugagacuacuguccccggugaggguucccaauuauaaccucauaauuauggacgaagcacauuucacagauccagccagcaucgcugcgcggggauacauuucuacccgagucggcaugggcgaggccgcagcuaucuuuaugacggccacuccucccgggacagcagaggccuucccacagagcaaugcuccuauacaggacgaagagagagauauucccgaacgcuccuggaacucaggaaaugaguggaucaccgacuuuguggguaaaaccgugugguucgucccaaguaucaaggccggcaacgacauugcgaacugcuuaaggaaaaaugggaagaagguaauccaacugagccguaaaacuuuugauacagaguaucagaagaccaaacuuaacgacugggauuucgugguuacaacugacauuucugaaaugggagcaaauuuuaaggccgaucgggugauagacccgagaaggugccugaaaccugucauccucacggauggccccgagcgcgugauuuuggcugguccaaugcccguuaccgccgcuuccgcagcccagcgaagagggcgggugggcaggaacccucagaaggaaaaugaccaauacaucuucacaggacagccacugaacaaugaugaggaccacgcucacuggacugaagccaagaugcuccuggauaacaucaauacccccgagggcauuauaccugcacuuuucgagccggaacgcgagaaaucagcggccaucgacggggaauaccgucuaaagggagagaguagaaaaacauuugucgaacugaugcggaggggugacuugccagugugguuagcucauaagguagccagcgagggcauuaaauauaccgaucgcaagugguguuucgacggggagcgaaacaaucagauccuggaagagaacauggauguggaaauuuggacuaaagagggagaaagaaagaagcuccggcccagguggcuggacgcacgcacguacuccgauccucuugcucugaaagaguuuaaggacuucgccgcaggcagaaaaucuaucgcccucgauuugguuaccgagauagguaggguccccucgcaccuggcucaucggacacguaaugcgcuagacaaccuggugaugcuccacacuagcgaacacgggggccgcgccuaucgacaugcaguggaggaacuuccagagaccauggagacacuguuauugcugggacucaugauccugcuuaccggcggggcuaugcuguuucucauuucaggaaaggguaucggcaaaacuuccauuggguugaucugcgucauaguuaguucuggaaugcuguggauggccgaugugccuuuacaguggauugccagcgcaaucguacuagaauucuuuaugauggugcugcucauucccgagccagaaaagcaaagaacaccucaggacaaucagcuugcuuacgucgugaucggcauacugacguuggccgcgaucguugcugccaacgagaugggucugcucgaaaccacuaagagggaucuggggauguccaaagagccgggcguggucucacccacaucuuaucuugacguagaucuccacccagcaagcgccuggacccuguacgcuguggcaaccacaguuauuacuccuauguugcggcauacgaucgagaauaguaccgccaacgugucccuggcggcuauugccaaccaagcagucguguuaaugggacuagacaagggcuggcccaucagcaaaauggaccugggggucccacuccuugcccugggauguuauucucaggugaauccuuugacacugacugcugccguucuccugcuugugacccacuacgcaauaauuggccccgguuuacaggcuaaggccacacgcgaagcgcagaaaagaaccgccgcagggaucaugaagaacccgacuguagauggaaucaugacgauugaccuggauccagugaucuacgacucaaaguucgagaaacaacucggccaggucauguugcugguucuaugcgcugugcagcugcuccuuaugaggacauccugggcccugugugaagcauugacccuggcuacugguccuauaaccacacucugggagggcagucccgggaaguuuuggaauacuaccauugccgucagcauggccaacaucuuccggggaucguaucuggcgggcgcuggguuagcauuuucuauuaugaaauccgugggaacaggcaagcgagguacggggagccagggagaaacccuuggcgagaaauggaagaagaaacugaaucaacucucaagacgcgaguucgaacuauacaagaaaagugguaucacugagguagauaggacagaagccaaggagggccugaaacggggggaaaccacucaucacgcugugucucguggauccgccaaguugcagugguuuguugagagaaacauggugauaccagagggcagggucaucgaccuggggugcggacgcggcgguuggagcuauuacugugcagggcucaaaaaggugacagaaguccggggauauaccaagggcggccccgggcacgaggaaccugugccgaugucaacguacggauggaauaccguuaaacuuaugagugguaaggauguauucuaucugcccccagagaaaugcgacacauugcugugugauauuggcgagagcuccccuucucccacuguggaagagagccgaaccaucagaguccucaagaugguggaaccuugguuaaaaaacaaucaguucugcauuaagguucugaacccauacaugcccacagugaucgagcaucuugaaaggcugcagcgcaagcacgggggaaugcuaguccggaauccucucuccagaaacucaacucaugagauguacuggauuucuaauggcaccgguaacaucgugaguucgguaaauauggugagccgucuguugcugaacagguuuacaaugacccaccggcgcccaacuauagagaaagacguugaucucggggccggaacgcgacacgucaacgcugaacccgagacaccgaauauggacgugauuggcgaaagaaucaagaggaucaaagaggaacauuccucuaccuggcacuaugaugacgagaacccuuacaagacuugggcguaucauggcucauacgaggugaaagccaccgggagcgcauccaguaugauuaauggagucguuaagcuucugacaaagccaugggacgugguacccauggugacgcaaauggcuaugaccgauacuacaccuuucggucagcagcgggucuuuaaagaaaagguggacacccgcacuccaagacccaugccgggcacaaggaaaguuauggagauaaccgccgaaugguuauggcgaacacuggggcggaacaagcguccuagauuguguacucgcgaggaauucaccaaaaaggugaggacgaaugcagccaugggagcugucuuuaccgaggagaaccaaugggaaucugcccgggcggcaguggaggaugaagaguucuggaagcucguaggcagagagcgcgaacugcacaaacuagguaagugcgggagcugcguuuauaauaugaugggaaaaagggagaagaaacuuggcgaauuuggcaaggccaaagggucacgagcuaucugguacauguggcugggagcccgguaucucgaguucgaagcacuggguuuuuugaacgaggaccauugguucuccagagagaauaguuacagcggcguggaaggggagggacugcacaagcucggcuacauucuuagggauaucucuaagauucccgguggggcuauguaugccgacgauacagcuggaugggacacucgcaucaccgaagaugaccugcacaacgaggaaaaaauaacacagcagauggauccagagcaucgucaguuagccaaugcaaucuuuaagcugacuuaccaaaacaaagucgugaaggugcagcggccuacccccaaaggcacggucauggacauuaucuccagaaaggaccagaggggcucagggcagguuggaacauaugguuugaauaccuucacuaacauggaggcgcaacucauucgccagauggaaggcgagggggugcugagcaaggccgaucuagaaaauccacaccuucuggagaaaaagaucacacaguggcucgaaaccaaaggaguagagcgacugaagcggauggcuauaucgggcgacgauuguguggucaaacccauugacgauagauuugccaacgcauuguuagcucugaacgacauggguaaggugaggaaggauaucccucaguggcaaccaucuaaaggguggcaugacuggcagcagguuccguucugcagucaccacuuccaugagcucaucaugaaggauggacgcaaacuugugguccccuguagaccucaggacgaacugauuggccgggccaggauaucccaaggcgcaggguggagccuaaaggagacugccugccugggaaaagcguacgcucagauguggucacucauguauuuucaccgucgagauuugcgccuggccuccaaugcaaucuguucugccgugccaguacauuggguucccaccagcagaacaacguggaguauucacgcucaucaccaguggaugaccacugaagacaugcuuacaguguggaaccgggucuggaucgaggauaauccuuggauggaggacaagaccccagugacuacaugggaagacguucccuaccuggguaagagggaggaucaauggugcggcucccucauuggguuaaccagccgcgccacgugggcacagaacauccugacagcuauacagcaggugagaucuuugaucggagacgaagaguuccuggauuauaugccuucaaugaaacgguuuaggaaggaagaggagagugaaggcgccauuugguga

SEQ ID NO: 15647 - RNA, 9873 nt, Artificial Sequence
  derived and/or modified CDS sequence (opt3) from DENV-3__JF504679__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacggccaagguaaggcgcauaacgggcgucuuauaacugcaaauccaguugugaccaaaaaggaggaacccguaaacauugaggccgaaccgccuuucggcgagucaaauaucgucaucggaauuggcgauaacgcuuugaaaaucaauugguauaagaaggggagcaguauuggaaaaauguuugaagccacagcacgcggugccagaaggauggcuauacugggcgacacugccugggauuucgggucugugggaggcguucucaacucccuggguaagauggugcaccagaucuuugggagcgcauacaccgcgcuuuucucgggcgucucuugggugaugaaaauuggaaucggcguacuguugacguggaucgggcucaauuccaagaacacaucaaugaguuuuagcugcauugcuauaggaaucauuacccuguauuuaggcgccgugguucaggcagacauggguugugucaucaauuggaaagggaaggagcugaagugcggauccggcauuuucgugacuaacgaggugcauacauggaccgaacaguacaaauuucaagccgauucucccaagcggcuagcuacugucaucgccggugcaugggagaauggcguuugugggauacgaagcaccacacgcauggaaaaccuccuguggaaacagaucgcuaaugagcuuaacuauauuuugugggaaaauaacaucaagcugacgguggugguaggagacaccauuggcguccucgagcaggggaaaagaacucugacaccacagccuauggaguuaaaguacucauggaaaaccuggggaaaggccaagaucgugacagcggaaacucaaaacaguuccuucauaauugauggccccaauaccccagagugccccagcgccucuagggcuuggaacguuugggaaguggaggacuaugguuuuggggucuucacgacaaauaucuggcugaaacuucgggaaguguacacccagaugugugaccaccgcuugaugucagcagccguuaaggaugagagagcugugcacgccgacaugggauacuggauugagagucagaaaaacggcagcuggaagcucgaaaaagcaucccugaucgagguaaagacuugcaccuggccuaagucucauacacuauggucgaaugguguccuggaaagcgauaugauaaucccaaaaucccucgcgggcccggugucacagcacaacuauaggcccggguaccauacucaaaccgccggaccuuggcaccugggcaagcuugaguuggacuuuaauuauugcgaggggacaacgguggucauuaccgaaaacuguggaacucguggcccaagucugcggacaaccacuguuucugguaaauuaauccacgaguggugcugucgaagcugcacacuccccccucugagauacaugggggaagauggauguugguauggcauggagauuaggccaaucuccgaacgcgaggagaauauggugaagucacuuguaagcgcugguucuggcaaaguggacaacuucaccauggggguccugugcuuggccauacucuuugaagaggugaugcggggaaaguucggcaagaaacauaugauugcagggguuuucuuuacguucaugcugcuacuguccggacagaucacuuggagagauauggcucacacccucaucaugauuggcaguaaugccagcgacaggauggguaugggggugacauaccuggcacuuaucgccaccuuuaagauucagcccuucuuggcucugggauuuuucuuacgcaaacucacuucucgagaaaaccugcuucugggcgucggccuagcgauggccacaaccauacaacucccggaggauaucgaacagauggcaaaugggauugcucugggauugauggcccugaaguuaaucacacaguuugagacuuaucagcucuggaccgcccugauuucccuuacguguucaaacacaaucuucacccugacuguggcuuggcggaccgcaacauugauacucgccgguguuagucugcuaccugugugccaaagcucguccaugcguaaaacugacuggcugccaaugaccgucgcggcuaugggcguacccccucuuccccucuuuaucuucucucugaaggauacguugaagagaaggagcuggccacugaaugagggggugauggccguuggauuagugucaauucucgcaaguucccugcuucgcaacgacgucccuauggccggcccccugguggcugguggguugcucaucgcauguuacguaauuacaggaaccucugccgaucugacuguggaaaaagcggcugacgucacaugggaggaagaggccgaacagaccggcguuagccauaaccuaaugaucacuguggacgaugacggcacaaugcggauaaaggaugacgagaccgagaauauucugacggugcuucucaaaacugcacuguugaucgucuccgggaucuuuccauacucaauuccggccaccuuacugguguggcacacauggcagaagcagacccaaagaagcggaguucucugggauguaccuagucccccagaaacacagaaagcugagcuggaagaggguguguauaggauaaagcagcagggcauccuugggaaaacucaagucggagugggcguucagaaggaggguguguuccauaccauguggcacgucacgcgaggggccgugcugacacacaacggaaagcgcuuggaacccaauugggcaucuguaaaaaaggaccuaauuuccuacggcggcggguggcggcugagcgcucaguggcaaaaaggagaggaaguccaggugaucgccguugagccugguaagaacccaaaaaauuuucagacuaugcccggcaccuuccagacaaccacuggggaaauuggagcgaucgcccucgauuucaagccuggcaccucggguucaccgauaaucaacagagaggggaagguggucggacuguauggcaauggcgugguuacaaaaaacgggggauacgugucugguauugcacaaacgaaugcugagccagacggccccacuccugaacuugaggaagagauguuuaagaaaaggaacuuaaccaucauggaucugcauccagggaguggaaagacacguaaauaucuccccgccauuguccgcgaagcuaucaagcggagauugaggacccugauacucgcaccuacucgagugguagccgccgagauggaggaagcucugaagggccuuccgauucgguaccagacaaccgcgacgaaauccgagcacacuggucgcgaaaucguggaccugaugugccaugcaacauucaccaugagauugcuaagccccguuagggucccaaauuauaaccugaucauuauggaugaggcccacuuuaccgacccugcuucuaucgccgcacggggguacauaagcacucgagugggaaugggcgaagccgcugcgauuuucaugacagccacccccccaggcacagcagaugcuuuuccucaguccaaugcccccauccaggacgaggagagagacauuccagaacgcucauggaacagugggaaugaguggaucacugauuucgcaggaaagacggugugguuugucccgagcauaaaagccgguaacgacauugcuaacugucucaggaagaauggcaaaaagguaauccaauuaucucguaagaccuucgauacagaauaccagaaaacuaagcugaacgacugggauuuugugguuaccacagacaucuccgagaugggggccaauuucaaagcggaucgggugauugacccuagaaggugccuuaagcccgucauccugaccgauggaccagagcgcgugauucucgcaggccccaugccuguuacuguggccucagcugcccagcgaagaggucgggucgggaggaacccacagaaagaaaaugaccaauauauauuuacgggccagcccuugaacaaugaugaggaccaugcucacuggaccgaagcaaagaugcugcucgacaacaucaauacaccugagggaauuaucccggcccuguucgaaccagagcgcgagaagagugcugccaucgauggcgaauaccgucuuaaaggggagagcagaaagacuuucguggaacuaaugcggaggggagaccugcccguaugguuggcacacaaaguggcguccgaggguauuaaguauaccgaucgcaaauggugcuuugacggccagcgaaacaaucagauauuagaagagaacauggauguugagaucuggacaaaggaaggggagaaaaagaagcugagaccucgguggcucgacgccaggaccuacucugauccccuggcucuuaaagaauucaaggacuuugccgcaggacgcaaaucgauugcucuggaucucgucacugagaucggcagagugccaagccauuuggcccacaggacacggaaugcacuggacaaccuagugaugcugcauacgucagaacacggugggcgugccuaucgccacgcugucgaggagcucccugaaaccauggagacucuucuguuauugggccugaugauucuccugacaggaggcgcgaugcuuuuccugaucuccgggaagggaauagguaaaaccaguaucggccucauuuguguuaucgccucuagcgggauguuguggauggcagaaauuccccugcaauggaucgcuuccgccauaguguuagaguuuuucaugaugguacuacugauuccagagccugaaaagcagcgaaccccgcaggauaaucaacucgccuacguggucaucggaauucuuacacuggcagcuaucauagccgcgaacgagaugggcuugcuggaaacuacgaagagagaccucgguaugucaaaagagcccggggugguuucuccaaccagcuaucuggauguggaccuucauccugcuagugccuggacacucuacgcagucgccacuaccguaaucacacccaugcugaggcacaccauugaaaauuccacugcuaacgugagcuuggcagccaucgcgaaccaggcuguugugcugaugggcuuagacaagggauggccaauuucuaaaauggaucuaggcgucccucugcucgcccuugggugcuacucacaggugaauccccugacguugacagcagccguccugcuccuggugacccauuaugcuaucauaggaccgggccuucaggccaaggcaacucgggaggcucaaaaacgcaccgccgcggguauuaugaagaacccaacaguugacgggaucaucacuauugauuuagacccugugaucuacgauuccaaguuugagaaacagcugggacagguaaugcucuuggugcugugugccguccagcuacugcucaugagaaccaguugggcacuuugcgaagcucugacauuggccacgggccccauaaccacucugugggaggguagcccaggcaaguucuggaauacaaccauugcaguuucgauggcuaacaucuuuagggggucuuaucucgccggagccggccuggcguucuccauuaugaaaagcguggggacuggaaagcggggcacagguucacaaggggaaaccuuaggagagaaauggaagaagaaacuuaaucagcugagucgaaaggaauuugaccucuacaaaaagucuggcaucacggaggucgauagaaccgaggcuaaagaaggucuaaagcgcggcgagacaacucaccaugcaguguccagggggagcgccaaacugcagugguucguagaacggaacauggugauacccgagggacguguuaucgacuugggcugugggagaggaggcuggucauauuacugcgcuggucugaagaaggugaccgaagucaggggguauacaaaaggaggcccuggccacgaggagccggugcccaugaguacuuacggguggaauauugucaagcucaugagcggaaaagauguguuuuaccuuccaccugaaaagugugacacccuguugugcgauaucggugaguccucucccagcccuacaguugaagagucccgcaccauucggguacugaaaaugguggagccauggcucaagaacaaucaguucuguaucaaggucuuaaaccccuauaugccugccgugauugaacaccuggagcgacuucaaagaaaacauggcgggaugcugguuaggaauccacuaucacgcaacucuacucacgaaauguacuggaucaguaauggaacgggcaacauagugucgagcgucaauauggugucccggcuccuguugaacagauucacaaugacccaucguaggcccacuauugagaaggacguagaucugggugcagggacccggcacgugaacgccgaaccggagacaccuaauauggacguuaucggagagcgcauccgaagaauuaaagaagagcacaacucuacguggcauuaugacgaugaaaauccauacaagaccugggcuuaucacggcucauacgaggucaaagcgacuggcagcgccuccaguaugauaaacgggguggugaagcuccuuacaaagcccugggacgucguuccuauggugacccagauggcaaugacugauacaaccccauuuggacagcaaaggguauucaaagaaaagguggacacacggacuccccgcccgaugccugguaccagaaaagucauggagaucacggcugaguggcuguggaggaccuuaggccgaaauaagcggccccgucugugcacaagagaagaguuuacuaaaaaggugcgcaccaacgccgcaaugggggccguuuucacagaagagaaucagugggauucugcuaaggccgcgguggaagacgaggaguuuuggaaauuggucgauagggaacgggagcuccauaagcugggaaaauguggcagcugcguguauaacaugauggguaagagagaaaaaaagcuaggggaguucggaaaagcaaagggcucacgcgccauuugguacauguggcuuggcgcuagguaccuggaguuugaagcccucggguuccugaaugaggaccacugguuuucccgagaaaacaguuauagcggaguagagggugaaggcuugcauaagcugggguacauccuccgggauauuucuaaaaucccaggaggcgcaauguaugcugacgauacugccgguugggacaccagaauaacggaggacgaucuucacaaugaggaaaagaucacacagcagaugaacccugagcacaggcuguuagcuaaugccauuuucaaacugaccuaccaaaacaagguugugaaaguccagcgccccacuccaacagggaccgugauggacaucauuucccguaaggaucagcggggaucaggccaggugggcacuuauggguugaauaccuuuacaaacauggaagcacaacucgucagacagauggagggagaagguguucugagcaaggcggaccuagagaacccccaucuuccugagaaaaagaucacgcaguggcuggaaaccaaaggcguggagaggcucaagcgcauggccauaucgggggaugacugcguagugaaaccaauugaugaccgauucgcuaaugcccuguuggcauuaaacgauaugggaaagguccggaaggacaucccgcaguggcaacccucuaaaggcuggcacgauuggcagcaggugccuuuuuguagucaucacuuccacgaacugaucaugaaggacgguagaaaacucguugugccaugcaggccccaggaugagcuuauugggcgcgcuagaauaucccaaggagccggcuggagccugcgggaaacugcaugucuaggcaaggccuacgcgcagauguggucacugauguauuuccauaggcgugaccuccgauuggcuuccaaugccaucugcucugcagucccugugcacuggguaccaacaagccgcaccacuuggaguauucaugcccaccaucaguggaugacaaccgaggacaugcugacgguuuggaacagaguguggaucgaggauaaucccuggauggaagacaaaacaccugucaccacuugggagaacgugccguaccuugggaagcgggaagaucaaugguguggaucccugauuggucucaccagcagggcuacaugggcccagaauaucccaacugcaauacagcagguucgcucuuuaaucggcaacgaggaguuucuggacuacaugcccucaaugaagagauuccggaaagaagaggaaagugagggggcuauuugguga

SEQ ID NO: 15648 - RNA, 9873 nt, Artificial Sequence
  derived and/or modified CDS sequence (opt3) from DENV-3__KC425219__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucgcaggucaccugaagugucguuuaaaaauggacaagcuggagcuaaaaggcaugagcuacgccaugugcacuaacaccuuugugcucaagaaagaggucucugaaacgcagcaugggaccauccugauuaagguggaguaccgcggagaagaugcucccuguaagaucccuuucuccacagaggacggccaagguaaagcgcacaacgggagacuuauaacugcaaauccaguugugaccaagaaagaggaacccguaaacauugaggccgaaccgccuuucggcgagucaaauaucgucaucggaauuggcgauaacgcuuugaagaucaauugguauaaaaaggggagcaguauuggaaagauguuugaagccacagcaaggggugcccggcgaauggcuauacugggcgacacugccugggauuucgggucugugggaggcguucucaacucccuggguaaaauggugcaucagaucuuugggagcgcauacaccgcgcuuuucucgggcgucucuugggugaugaagauuggaaucggcguacuguugacguggaucgggcucaaucccaaaaacacauccaugucauuuaguugcauugcuauaggaaucauuacccuguauuuaggcgccgugguucaggcagacauggguugugucaucaauuggaaggggaaagagcugaagugcggaagcggcauuuucgugacuaacgaggugcacacauggaccgaacaguacaaguuucaagccgauuccccaaaacgccuagcuacugccaucgcaggugcuugggagaauggcgucugugggauaagaucuaccacaaggauggaaaaccuccuguggaagcagaucgccaaugagcuuaacuauauuuugugggaaaauaacaucaaacugacgguuguggugggagacauuaucggcguacucgagcaggggaagcggacccugacuccucagcccauggaguuaaaauacagcuggaagacauggggaaaagcgaagauagucaccgccgaaacacaaaacucaaguuucauuaucgauggcccaaauacucccgagugcccuuccgcuagccgcgcauggaacgugugggaaguugaggacuaugguuuugggguguucaccacgaauauuuggcugaagcuuagagaagucuacacacaguugugugaccauaggcucaugucugccgcugugaaagaugagcgugccguucacgcagacaugggauacuggaucgagucacagaagaacggcaguuggaaacuggaaaaggcgagccuaauagaggugaaaaccugcacuuggccaaagucccacacccuguggucuaaugguguacucgaaucggauaugaucauuccgaagagccuggccggccccaucucccagcauaaccaccggccuggguaucauacacaaacugcuggaccauggcaccuuggcaaauuggagcuggacuuuaauuacugcgaggggaccacagucgugauuacggaaaacuguggaacccgaggccccucauuaagaacuacaaccgugagugguaagcucauccacgaguggugcuguaggucuugcacucugccuccacuucgcuauaugggggaagauggauguugguacggcauggagauacggcccauuagcgaaaaagaggagaauauggucaagucccugguuucagccgguagcggcaaaguggacaacuucacaauggggguauugugccucgcaauccuguuugaagaggugaugagaggaaaguucggcaagaaacauaugaucgcuggggucuucuuuaccuucgugcuacugcucucuggacagauuacguggagggauauggcccacacucugaucaugauuggcuccaaugcaagugaccgcauggguauggggguuaccuaucuugccuugauagcuacauuuaagauccagccguuccuggcguuaggauuuuuccuccgaaaacugaccagccgggaaaaccuucugcuaggcgugggccucgccauggcaacuacacugcaauugccugaggauauugaacagauggcuaaugggaucgcccugggauuaauggcccucaagcugauuacccaguuugagacauaccagcuuuggacugcucugaucucuuugaccuguuccaacacgauguucacacucaccgucgcauggcguacugccacccugauacuagcgggugugucacugcuuccaguuugccaaaguagcucgaugagaaaaacagacuggcuccccauggcuguggccgcaaugggcgucccuccccugccauuguuuaucuucucccugaaggauacuuuaaagaggcgcucuuggccucucaaugaggggguaauggccgugggacugguuagcauucuugcuucaagucuguugcggaacgacgugcccauggcaggcccacucgucgccggugggcugcuaaucgcguguuaugugauuaccggaacguccgcugaucugacaguagaaaaagccgcagacaucaccugggaggaagaggccgaacagacuggcgugucucauaaccuuaugauaacagucgacgaugacggcaccaugagaauuaaggaugacgagacugagaauauccucacaguucuguugaaaaccgcuuuacugaucgugagcgggguguuuccguacuccauuccugccacgcuccuggucuggcacacuuggcagaagcagacccaaaggucaggagugcuuugggauguucccagcccacccgaaacacagaaagcagagcuggaagaggguguauaccgaauaaagcagcagggcaucuucgggaaaacccaagugggagucggcgugcagaaggaggguguuuuucauacaauguggcacgugacucgcggggcugucuugaccuauaacggaaagcggcuagaaccuaauugggccagugugaaaaaggaccugauuucuuacggcggcggguggagacucuccgcgcaguggcaaaaaggagaggaaguacaggucaucgccguggagccagguaagaaccccaaaaauuuccagacgaugccuggcacauuccagacuaccacaggggaaauuggagcaaucgcucuggauuuuaagccgggcaccagcgguucgccaauaaucaacagggaggggaagguugugggacuuuauggcaauggcgucgugacuaaaaacgggggauacguuucagguauugcccaaaccaaugcugagcccgacggcccuacaccagaauuagaggaagagauguucaagaaacguaaccugacgaucauggaucuccaccccgggucuggaaagacucgcaaauauuugccugcaauugugcgggaagccaucaagagaaggcugcgaacccucauacuggccccgacacgggucguggcugcggagauggaggaagcacuuaagggccugcccauucgcuaccagaccacugccacaaaaagugagcauaccgguagagaaaucguagacuugaugugccacgcuacguuuacuaugaggcuacuguccccagugcggguuccuaauuauaaccucaucauuauggaugaggcccauuucacagaccccgcaagcaucgccgcucgaggguacauaucuaccagagucggaaugggcgaagcggccgcaauuuuuaugaccgcuacuccaccuggcacagccgaugcauucccccagagcaaugccccaauccaggacgaggagcgcgacauuccggaaagguccuggaacucagggaaugaguggaucaccgauuuugcuggaaagacagugugguucgugccuaguauaaaagccgguaacgacauugcgaacuguuuacguaagaauggcaaaaaggucauccaacugagccggaagacuuuugauacggaauaccagaaaaccaagcuuaacgacugggauuucguagugacaacugacaucucugagaugggggcaaauuuuaaagccgauagaguuauugaccccaggcgcugccugaagccagugauccucaccgauggacccgagcgagucauuuuggcuggcccuaugccagugacagccgcuuccgcagcccagagacgggguaggguugggcgcaacccccagaaagaaaaugaccaauauauauucaccggccagccucugaacaaugaugaggaccacgcucauuggacugaagccaagaugcuccuggacaacaucaauacgccggagggaauuaucccagcacuuuucgaacccgagcgugagaagucagcggccaucgauggcgaauacagacuaaaaggggagagucggaagaccuuuguggaacugaugaggcgcggagacuugccugucugguuagcucacaaaguggccagcgaggguauuaaguauacagaucgaaaauggugcuucgacggccagagaaacaaucagauacuggaagagaacauggauguagagaucuggacuaaggaaggggagaaaaagaagcuccggcccagguggcuggacgcacgcaccuacuccgauccacuugcucugaaagaauuuaaggacuucgccgcaggaagaaaaucuauugcccucgauuuggugacagagaucggcaggguuccuucgcaccuggcucaucggacccguaaugcgcuagacaaccuggucaugcuccacacuagcgaacauggugggcgcgccuaucgacacgcaguggaggagcuucccgaaacaauggagacgcuguuauugcugggccucaugauucugcuuaccggaggcgcuaugcuguuucucaucucagggaagggaauagguaaaacuuccaucggcuugauuugugugaucgccaguucugggaugcuguggauggccgaaauuccauuacaauggaucgcaagcgcuauaguccuagaguucuuuaugaugguucugcucauuccugagccggaaaagcagagaacaccccaggauaaucaacuugccuacgugguaaucggaauucugaccuuggcggcuaucauagccgcaaacgagaugggccugcucgaaaccacaaagagggaccuggguauguccaaagagccagggguggucucaccuacuucuuaucuugauguggaccuccaccccgccagcgcuuggacgcuguacgcaguugccaccacagugaucacuccaauguugcggcauaccauugaaaauaguacagcgaacgucucccuggcugccaucgcaaaccaggccguaguguuaaugggccuagacaagggauggccuauuagcaaaauggaucugggcguuccccuccuugcucuggggugcuacucucaggugaauccguugacccugacugccgcaguccuccugcuuaucacgcacuaugcuauaauuggaccaggcuuacaggccaaggcgacacgcgaggcccaaaaaagaaccgcagcugguaucaugaagaacccuacuguggacgggaucaugaccauugaucuggaccccgucaucuacgauucaaaguucgagaaacagcucggacaggugauguugcugguucuaugugccgugcagcugcuccuuaugaggacauccugggcacugugcgaagcuuugacucuggccaccggcccaauaacaacgcucugggaggguagucccggcaaguuuuggaauaccacuauugccguaagcauggcgaacaucuuccgggggucguaucuggcuggagcaggcuuagccuuuucuauuaugaaauccguggggacaggaaagcgaggcaccgguagccaaggggaaacucuuggagagaaauggaagaagaaacugaaucagcucucaagaaaggaauucgaccuauacaaaaagaguggcaucacagaggucgaucgcaccgaggcuaaagaaggucugaagaggggcgagauaacgcaucacgccguuucucggggguccgcaaaauugcagugguuuguggaacguaacauggucaucccugagggaagagugauugaccugggcugugggaggggaggcuggagcuauuacugcgccggucucaagaagguaaccgaagugcgcggguauacaaaaggaggcccgggccaugaggagcccguuccaaugucaacuuacggguggaauaucgugaagcuuaugaguggaaaagaugucuucuaccugccucccgaaaagugugacaccuugcugugcgauauuggugagagcuccccuucuccaacaguggaagagagccggacuauccgaguccucaaaaugguggagcccugguuaaagaacaaucaguucuguauuaagguucugaacccuuauaugccaaccguaaucgaacaccuugagagacugcaaaggaaacacggcgggaugcuagugcgcaauccccucucccggaacucaacacaugaaauguacuggauaucuaauggaaccggcaacauugucgcuagugugaauaugguuucgagacuguugcugaaccguuuuacuaugacgcacaggcggccgacaaucgagaaggacguggaucucggugcggggacccgccaugucaacgccgaaccugagacuccaaauauggacgugaucggagagcgaauuaaaagaauaaaggaagagcacaacagcaccuggcacuaugacgaugaaaaucccuacaaaacaugggcauaucauggcuccuacgagguaaaggcuacgggcucugccucaagcaugaucaacggggugguuaagcuucugaccaaaccuugggacgucgugccaauggugacucagauggcaaugacagauaccacucccuucggacagcaaagggucuuuaaggaaaaaguugacacacggaccccgcgcuccaugccugguacaagaagggugaugggcauuacugccgagugguuauggcgaacccuggggcggaauaagaaaccccguuugugcacgagagaggaauucaccaagaagguacgcacaaacgcugccaugggagcgguguuuacugaggaaaaucagugggauagugcaaaagccgcugucgaggacgaagauuucuggaagcucguggacagggagcgggagcugcacaaacuaggcaagugugguucuugcguuuauaacaugauggggaaaagagaaaagaaacuuggagaguuuggcaaggccaagggcagccgcgcaaucugguacauguggcugggggcuagguaccucgaauucgaggcccugggauuuuugaaugaggaucauugguucucacgagaaaacuccuauagugguguggagggcgaagggcugcacaaacucggauacauucuucgggacaucagcaagauaccaggcggugcuauguaugccgaugacaccgcagggugggacacaagaaucacugaggaugaccugcauaaugaagagaaaauuacccagcagauggauccugagcacaggcaauuagcgaacgccaucuuuaagcugacguaccagaauaaagucgugaagguacagcgccccacaccaaccggaacuguuauggacauuaucucucguaaggaucagcggggcuccggccaaguggggacauauggauugaacaccuucacuaauauggaagcucagcucauaagacagauggagggugaaggcguccugucaaaagccgaccuagagaacccccaccuuccugaaaagaaaauuacccaguggcuggagacaaaggggguggagaggcucaaacgcauggcaaucagcggagaugacugcguggucaagccaaucgaugaccgauuugcuaacgcccuguuggcauuaaaugauaugggcaagguucggaaagacauuccgcaauggcagcccucgaaggguuggcaugauuggcagcaggugccuuucuguucucaccauuuccacgaacugauaaugaaagacgggagaaagcucguagugccaugcaggccccaagacgagcuuaucggacgcgccagaauuagucagggcgcgggcuggucccugcgggaaacggcuugucuagggaaagccuacgcacagauguggagccugauguauuuucacaggcgugaucuccgauuggccucaaacgcuaucugcuccgccgucccugugcauuggguuccaaccucucgcacuacauggagcauucacgcacaucaccaauggaugaccacugaggacaugcugacaguguggaauagagucuggaucgaagauaaccccuggauggaggacaagaccccugugacgacaugggagaauguaccguaccuuggaaagcgggaagaucaguggugugguagucugauaggccucaccuccagggcuacuugggcccagaacaucccaaccgcgauucagcaaguucgcagcuuaaucgggaaugaggaauuccuggacuacaugcccucuaugaaaagauuucggaaggaggaggaaucagagggagcuauuugguga

SEQ ID NO: 15649 - RNA, 9873 nt, Artificial Sequence
  derived and/or modified CDS sequence (opt3) from DENV-3__AY858037__SS-prME
accagccugugccucaugaugaugcuucccgugacacuggccuuccacuugacuuccagggacggcgagccuaggaugaucgucgggaagaacgaacggggaaagucuuuacuguuuaagacggcuucagguauuaauauguguacccuuauagcaauggaucucggcgagaugugcgacgauacaguuacuuacaaguguccacugaucaccgaaguggagccggaagacauugauugcugguguaaccuuacaaguaccuggguaacuuaugggacaugcaaucaggccggagagcaucgccgagacaagcguagcguggcgcuggcuccccacgucggcauggguuuggauaccagagcccagacguggauguccgcagagggggccuggagacagguggaaaagguugagacuugggcuuuccggcauccuggauuuaccauccucgcacuguuccuggcccacuacauuggcacaucucucacucagaagguggucaucuuuauauuacugaugcuugugaccccaucgaugacaaugcgcuguguaggcguugggaacagagacuucguggaaggauugucaggugcuaccugggucgauguggugcuggagcauggcgggugcgucacgacuauggccaagaauaagcccacacuagacaucgagcuccagaagaccgaagcgacucaacuggcaacacuuaggaaacuguguauugagggaaagaucaccaacguuacgaccgauagccggugcccuacacagggcgaagccauuuugccagaggaacaggaccagaauuauguguguaaacacacuuacguagaucgcgguugggggaacggaugcggccucuuuggcaaggggagucuggugaccugcgcuaaguuccaauguuuagaguccaucgagggaaaagucgugcagcacgaaaaucugaaguauacaguuauaauuacugugcauaccggugaccagcaccaggucggcaacgagacacaaggggugaccgccgaaaucacuccccaggcaucuacgguagaggcuauucucccugaauacggaacacuuggccuggagugcagcccacgaaccgguuuggacuuuaaugagaugauccuacugacuaugaaaaacaaggccuggaugguucauagacagugguucuuugaucucccgcugcccuggaccuccggggcgacaaccgaaacuccuacauggaauaaaaaggagcuucuggugacguucaaaaacgcccacgcaaagaagcaagaagucguggucuugggcucacaggagggagcuaugcacaccgcccucacuggcgcuacagaaauccagaccagugggggaacaagcauuuuugccggucaucugaaauguagguuaaagauggacaaacuggagcuaaagggcaugucuuaugcaaugugcuccaaugccuucgugcucaaaaaggagguuucagaaacucagcacgggaccauacugaucaagguggaguacaaaggagaagaugcuccauguaagauucccuucagcacggaggacggccaagguaaagcgcauaacgggcggcuuaucaccgcaaacccuguagucacaaagaaagaggaaccagugaauauagaggccgaacccccguuuggcgagaguaacauuaucaucggaauuggcgaucgugcuuugaagaucaauugguacaagaaagggucuuccauuggaaagauguucgaagccacugcacgcggugccagaaggauggcuauacugggcgacaccgccugggauuuugggagcguuggaggcgugcucaacucgcuggguaaaaugguccaccagaucuucgggucugcauauacagcgcuauuuuccggcgugucauggauuaugaagaucggaaucggcguacuguugacuuggauugggcucaauaguaaaaacaccagcauguccuucucuugcauagugaucggaauuaucacgcuguacuuaggcgcuguuguccaggccgacauggguugugugauuaauuggaaggggaaggagcugaaaugcggaagcggcaucuuugugacaaacgagguccauaccuggacugaacaguauaaguuccaagcagauucaccuaaacggcuagccacagcuauagccggugcaugggagaauggcguuugugggauccgaaguaccacucgcauggaaaaccuccuguggaagcagauugcuaaugagcuuaacuacaucuugugggaaaauaacauuaaacugaccguggugguaggagacaucauaggcguccucgagcaggggaagagaacacugacgccccagccaauggaguuaaaauauuccuggaagaccuggggaaaggccaaaauugugacugcggaaacacaaaauagcucuuuuaucauugauggcccuaacacccccgagugcccaaacgccucaagggcuuggaauguuugggaaguggaggacuacgguuucggggucuuuacaacuaacaucuggcugaaacuucgggaaauguauacccaguugugugaccaccgccucaugagugcagccgugaaagaugagagagcuguucacgccgacaugggauacuggauagagagccagaagaauggcuccuggaaacuggaaaaggcaucucuaaucgaggugaagacgugcacauggcccaaaucgcauacccuguggagcaacgguguacucgaauccgauaugauuaucccuaagucacuggcgggcccaauuagucagcacaauuacaggccgggguaucauacucaaaccgccggacccuggcaccuuggcaaauuggagcuggacuucaacuacugcgaggggacaacugucgugaucaccgaaaauuguggaacacguggcccuucuuuacggacgaccacugugagcgguaagcucauacacgaguggugcugucgauccugcacacugccaccccuuagauauaugggggaagauggauguugguacggcauggagauuaggccuaucaacgaaaaagaggagaauauggucaagucacugguuagcgcugguucuggcaagguggacaacuuuaccauggggguauugugccucgccauccuguucgaagaggugaugcgcggaaaauucggcaagaaacauaugauugcagggguccuauuuacuuucgugcugcuccuguccggacagaucacauggcgggauauggcuagaacccuuauuaugauaggcaguaaugccagcgacaggauggguauggggguuacguauuuggcacugaucgccacuuuuaagauucagccauucuuagcucucggauuuuuccugcgcaaacuuaccucucgagaaaaccugcuacucggcgugggccuggcgauggccacaaccuugcaacugcccgaggauaucgaacagauggcaaaugggauugcuuuaggacucauggcccugaaacuuaucacucaguuugagacauaccagcuguggaccgccuuggucucccucauguguucaaacacaauauucacucugaccguggcuuggcggacggcaacacuaauccuggccgguauuagucuuuuuccgguuugccaaagcucguccaugcguaagaccgacuggcucccuaugacuguggcggcuaugggcgucccaccccugccuuuguucaucuuuucucugaaagauaccuuaaagagaaggagcuggccccucaaugaggggguaauggccgugggacugguuucaauucuugcaaguucccuguugcgcaacgacgugccaauggccggcccucucgucgcuggugggcugcuaaucgcauguuaugugauaacaggaacuucugccgaucugaccguagaaaaagcggcugacgugacgugggaggaagaggccgaacagacaggcgucagccacaaccuuaugauuaccguugacgaugacggcacuaugcggaucaaggaugacgagacagagaauauccucaccgugcuguugaaaacugcauuacugauuguguccgggauauuccccuacucaaucccagccacacuccuggucuggcauaccuggcagaagcagacgcaaagaagcggagugcuuugggauguuccgaguccucccgaaacucagaaagcugagcuggaagaggguguauacaggauuaagcagcagggcaucuuugggaagacccaagugggagucggcgugcagaaagaggguguuuuccacacaauguggcaugugacccgaggggccgucuugacauauaacggaaagcgccuagaaccaaauugggcaucugugaaaaaggaccugauuuccuacggcggcggguggcggcucagcgcucaguggcaaaaaggagaggaaguacaggucaucgccguggagcccgguaagaacccuaagaauuuccagacuaugccaggcauauuucagaccacgacaggggaaaucggagcgauugcccuggauuucaaacccggcacuucggguucaccuaucauuaacagagaggggaagguugugggacuuuauggcaauggcgucgugaccaaaaacgggggauacguuucugguaucgcacaaacaaaugcugagccggacggcccaacccccgaauuagaggaagagauguuuaagaaaaggaaccugacuauaauggaucuccacccugggaguggaaagacccguaaguauuugccagccauugugcgcgaagcuaucaaacggagacugaggacacucauccuggcacccacgcgagucguggccgccgagauggaggaagcucuuaagggccugccuauucgguaccagacuaccgcgacaaaauccgagcacaccgguaaggaaaucguagacuugaugugccaugcaacuuucacaaugcgccuacugagcccggugagaguucccaauuauaaccucauaauuauggaugaggcccacuuuaccgacccagcuucuaucgccgcaaggggguacauuagcacgcgggucggaaugggcgaagccgcugcgaucuucaugacugccacaccucccggcaccgcagaugcuuuuccacaguccaaugccccuauacaggacgaggagcgagacauucccgaaagaucauggaacagugggaaugauuggaucaccgacuucgcaggaaaaacugugugguuugugccaagcaucaaggccgguaacgauauugcuaacuguuuacgcaagaauggcaaaaaggucauccaacugucuaggaaaacauucgacaccgaguaccagaagacaaaacuuaacgauugggacuuuguagugacuacggauauuuccgaaaugggggccaauuucaaggcggaccguguuauagauccgcggagaugccugaagccugugauccucaccgacggacccgagagggucauuuuggcaggcccaaugcccgugacaguugccucagcugcccagcgccgagguagaguggggcggaacccucagaaagagaaugaucaauauaucuucacuggccagccacugaacaaugacgaagaccaugcucacuggaccgaggcaaagaugcuccuggauaacaucaauacacccgaaggaauuauaccugcccuuuuugagccggaaagggagaaaagugcugccaucgacggcgaguaccgccuaaagggggaaagccguaaaaccuucgucgagcugaugagacggggagauuugccagugugguuagcacauaagguagcguccgaagguauuaaauauacugacaggaaguggugcuuugauggcgagcgcaacaaucagauccuggaagagaacauggacguggagauuuggacgaaggaaggggagaaaaagaaacuccgacccagauggcuggaugcccggaccuacucugacccucuugcucugaaggaguucaaagauuuugccgcaggaaggaagucgaucgcucucgacuugguuacagagauaggccgcguccccagccaccuggcccacagaacuaggaaugcacuagauaaccuggugaugcuccauaccucagaacacggugggcgggccuaucgucaugcuguggaggagcuuccagaaacaauggagacccuguuauugcugggccucaugauccugcuuacuggaggcgcgaugcuguuccucauuuccgggaagggagucgguaaaacaaguaucggcuugauuuguguuguggccucuagcgggaugcuguggauggcagacaucccuuuacaguggauagcuuccgccauuguacuagaauuuuucaugauggugcugcucauccccgagccagagaagcaacgcacgccucaggauaaucagcuugccuacgucgugauuggaauccugaccuuggcagcuauaguugccgcgaacgaaaugggccugcucgagacuacaaaacgagaccuggguaugucaaaggaaccggggguggucucucccaccagcuaucuugacguagaucuccacccagcuagugccuggacccuguacgcaguggccacaacuguuaucacgccuauguugagacacaccauugaaaauuccacagcuaacgugagccuggcagccaucgcgaaccaagcugucguguuaaugggccuagacaaaggauggcccauuucuaagauggaucugggcgucccacuccuugcccuggggugcuacucacaggugaauccuuugacucugaccgcagccguucuccugcuugugacacauuaugcuaucauaggacccggcuuacaggccaaggcaaccagggaagcucagaaacggacugccgcggguauuaugaagaacccgacgguagacgggaucaugacaaucgaucuggacccagugauuuacgauuccaaauuugagaagcaacucggacaggucauguugcugguucuaugugccgugcagcugcuccuuaugcgcaccaguugggcauucugcgaggcucugacuuuggccaccggcccuaucacaacucugugggaagguagccccggcaaauuuuggaauaccacaauagcagucucgauggcuaacauuuucagagggucuuaucucgccggagccggccuggcguuuuccaucaugaaaagcguggggacgggaaagaggggcaccgguucacagggggagacuuuaggagaaaaauggaagaagaaacuuaaucaacugagucggaaagaguucgaccucuacaagaaaucuggcauuacagaaguagaucgaaccgaggcuaaagagggucuaaagagaggcgaaaucacucaccaugcagugucccgcgggagcgccaaacugcagugguucguugagaggaacauggugauaccagaaggacgggucaucgacuugggcugugggcguggaggcuggucauauuacugcgcuggucugaagaaagugacagaggucagaggguauaccaagggaggccccggccacgaagaaccugugccgaugaguacguacggguggaauauuguuaaacucaugagcggaaaggauguauuuuaccuucccccagagaagugugacacccuguugugcgauaucggugaauccucuccuagccccacaguggaggaauccaggacuauucgcguccugaaaaugguggagccuuggcucaagaacaaucaguucuguaucaaaguuuuaaacccauauaugcccaccgugauugagcaucuggaacggcuucagcgaaagcacggcgggaugcuggucagaaauccucuaucaaggaacucuacacacgagauguacuggaucaguaauggaacuggcaacauagugucgagcguaaauauggugucccgccuccuguugaaccgguuuaccaugacauauagacguccaaccauugaaaaagacguugaccugggugccgggacuaggcaugucaacgcagagcccgaaacgccgaauauggaugugaucggagagcggauccgccgaauuaaggaggaacacucuucaacauggcauuacgacgaugagaacccuuauaagaccugggccuaccacggcagcuaugaagugaaagcuacuggcuccgcgaguucuaugauaaauggggucguuaagcuccuuaccaaaccaugggacgugguacccacagugacgcaaauggccaugaccgauacuacaccuuucggacagcagagagucuuuaaggagaaaguggacaccaggacuccaaagcccaugccggguacacggaagguuauggaaaucaccgcagaguggcuguggcgcacauuaggcagaaacaaaaggccucgacugugcacucgggaggaguucaccaagaaagugcguacgaaugcugccaugggggcagucuuuaccgaggaaaaccaaugggauagcgccagagcugccguggaggacgaagaguucuggaaguugguagaucgcgagagggaacuccacaaacugggaaaguguggcucaugcguuuacaauaugauggguaaacgggagaagaagcuaggggaauuuggaaaagcgaagggcuccagagcaauuugguacauguggcuuggcgcccgcuaucuggaguucgaggcucucggguuucugaacgaagaccauugguucaguagggagaauagcuacucuggaguggaaggugagggcuugcacaaacugggguauauccuccgagauauuuccaagauccccggaggcgccauguacgcagacgacacagcugguugggauacucggauaaccgaagacgaucuucauaacgaggagaaaaucacacagcagauggacccagaacacagacagcuggccaaugcuauuuuuaaguuaacuuaucaaaacaaggucgugaaagugcagaggccuacccccaaggggacggucauggauaucauuucacgcaaagaccagcguggaagcggccagguuggcacauacgggcugaauaccuucacuaacauggaggcccaauugauccggcagauggaaggagagggugugcucucgaagacagaucuggaaaauccacaucuacuugagaaaaagauaacccaguggcuggagacuaagggcguagaaagacucaaaaggauggcaauuucuggggacgauugcguggucaagcccaucgacgaucgcuucgcgaacgcccuguuggcuuuaaacgacaugggaaaagugcgaaaggauaucccucaguggcaaccaaguaaaggcuggcacgacuggcagcagguuccguuuuguucccaccauuuccacgagcugauuaugaaggacggucggaagcucgugguccccugcagaccucaggaugaacuuauagggagggcccgcaucagccaaggagcaggcuggucacugaaagagaccgcuugucuaggcaaggccuaugcacagaugugggcccugauguacuuucauagacgggaccucagguuggcguccaaugcuauuugcucugccgugccaguacacuggguucccacaagccguacgaccuggaguauccacgcacaucaccaguggaugacuacagaagauaugcugaccguguggaaccgagucuggauugaggacaauccuuggauggaggauaaaacuccagugacaaccugggaagacguucccuaccuugggaagcgcgaggaucaaugguguggaucccugaucggucucacgagcagagccacaugggcucagaacauauuaaccgccauccaacaggugcggucucugauuggcaaugaagaguucuuggacuauaugccuucaaugaaaagguuucgcaaggaggaagagagugaaggggcaaucugguga

SEQ ID NO: 15650 - RNA, 9873 nt, Artificial Sequence
  derived and/or modified CDS sequence (opt3) from DENV-3__KJ737429__SS-prME
acaagccugugccucaugaugaugcuucccgcaacacuggcuuuccacuugacuuccagagacggagaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaccgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucagcuugccacacugaggaaauuguguauugagggaaagaucaccaacauuacgaccgauagccggugcccuacacagggcgaagcuauccucccagaggaacaggaccagaauuaugucuguaaacacacuuacguugaucgcgguugggggaacggaugcggccuguucggcaaggggaguuuagugaccugcgccaaguuucaaugucuggagcccauagagggaaaaguagugcaguaugaaaaucucaaguacacagucauuaucacugugcacaccggugaccagcaucagguuggcaacgacacacaaggggugaccgucgagauuacuccucaggcauccacgguggaagcuguacuuccagaguauggaacacugggcuuggaaugcucuccgcgaaccggucuagauuucaaugagaugauccugcucacuaugaaaaacaaggccuggaugguucacagacagugguuuuucgaccugccccuuccuuggaccagcggggcgacaaccgagacuccaacauggaauaggaaagaacuguuggugacguuuaagaacgcccaugccaagaagcaagaggucgugguccucggcucccaggaaggagcuaugcacaccgcccugacuggcgcuacagagauccaaaauucagggggaaccaguauuuucgccggucacuuaaagugucggcugaaaauggauaagcuagaacucaaaggcaugagcuacgcaaugugccugaacacauuugugcuuaagaaagagguuucugagacucagcaugggaccauauugaucaagguggaauacaagggagaggacgcccccuguaaaauuccuuucuccacggaagauggccaagguaaggcucacaacgggcgucugaucaccgcgaauccaguagucaccaagaaggaggagcccgugaacauagaagcagagccgccuuucggcgaaucaaauauuguuaucggaaucggcgacaaagcccucaagauuaacugguauaagaaagggagcaguaucggaaagauguuugaggcuacugcccgcggugcaagaaggauggccauucugggcgauaccgcuugggacuucgggucugugggaggcguccuuaauucccuggguaaaauggugcaucagauauuugggagcgccuacacagcauuguucucgggcguaucuuggaucaugaagauuggaaucggcgugcuccugacuuggaucggguuaaacuccaaaaauaccucaaugaguuuuagcugcauuguuauaggaaucauuacgcuguaucuaggcgcggucgugcaggcugauauggguugugugaucaacuggaaggggaaggaacucaaaugcggauccggcauuuucgucacaaaugagguucacaccuggacugagcaguacaaguuucaagccgacucucccaaacggcuggcaacagccaucgcuggugccugggaaaacggcgugugugggauacgaagcaccacucgcauggagaaucuuuuguggaagcagaucgcaaacgaacugaauuauauucucugggagaacaauaucaaacugaccgugguagucggagauauuaucggcguguuagaacaggggaagagaacacugacgccacagccuauggagcuuaaauacucauggaagaccuggggaaaggcuaaaauaguuacugccgagacacaaaacaguuccuucauuaucgacggccccaacaccccagaaugccccagcgcgucuagggccuggaaugugugggaggucgaagacuaugguuuugggguguucacaacuaacauuugguugaagcuccgggagguuuacacccagucaugugaucaucgccugaugagugcugcaaucaaagacgaaagagccgugcacgcugauaugggauacuggauagagagccagaagaauggcuccuggaaacuagagaaggccucuuuuaucgaaguaaagacgugcacauggccuaaaucgcacacccuguggagcaacgguguccucgaguccgacaugauuaucccaaagucacuggcaggcccgauuagucagcauaaucacaggcccggguaucauacucaaaccgcgggaccuuggcaccuuggcaaauuggaacuggauuucaacuacugcgaggggacaacuguggugaucaccgagaauuguggaacacguggcccaucuuuacggacgaccacugucagcgguaagcucauacacgaauggugcugucgauccugcacacugcccccucuuagauauaugggggaggacggauguugguacggcauggaaauuaggccaaucaacgagaaagaagagaauaugguuaagucacuggugagcgccgguucuggcaagguagauaacuuuaccauggggguguugugccucgcuauccuguucgaggaagucaugcgcggaaaauucggcaagaaacauaugauugccggggugcuauuuacuuucguucugcuccuguccggacagaucacauggcgggacauggcacacacccuuauuaugauaggcaguaaugcuagcgauagaauggguaugggggugacguauuuggcccugaucgcaacuuuuaagauucagcccuucuuagcccucggauuuuuccugaggaaacuuaccucucgcgagaaccugcuacucggcgucggccuggcuauggcgacaaccuugcaacugccggaagacaucgagcagauggccaaugggauugcauuaggacucaugacucugaaacuuaucacacaguuugaaaccuaccagcuguggacagcuuuggugucccucacuuguucaaacaccauauucacgcugacaguugccuggcgaaccgccacucuaauccuggcuggugugagucuucucccucugugccaaagcucguccaugcggaagaccgauugguugccaaugacagucgcagccaugggcguacccccucugcccuuauuuauuuucucucucaaagacacuccaaagcguagaagcuggccucugaaugagggggugauggcgguuggacuugugucaauccuggcuaguuccuugcucaggaacgauguccccauggccggcccacugguggccggugggcuacugauugccuguuauguaaucaccggaacgucugcugaccuuacaguggagaaagcagccgacgucaccugggaagaggaagcggagcagacuggcguuagccauaaccucaugauaacaguggaugacgauggcaccaugcgcauuaaggacgaugaaacugagaauauccugacaguguuguuaaaaaccgcucugcucaucgucuccgggauuuuuccguacucaauaccugccacgcugcuuguguggcacacuuggcagaagcagacccaacggagcggaguucugugggacguacccaguccacccgagacacagaaagcagaauuggaggaagguguguacagaaucaagcagcagggcauuuucgggaagacccaagucggagugggcguucagaaagaggguguguuucauacaauguggcacgucacucgaggggcagugcuaacccacaacggaaagaggcuggagccuaauugggcuucugucaagaaggaucucaucuccuauggcggcggguggcgccugagcgcccaguggcaaaaaggagaagagguccaggugauugcaguugaaccagguaagaaccccaagaauuuccagacgaugccuggcaucuuccagacaacuaccggggagauaggagcuaucgcccuugacuuuaaaccgggcacaucggguucaccaauuaucaaccgggaagggaagguggucggauuauacggcaauggcgugguuaccaaaaacgggggauaugugucugguauugcgcaaacuaaugccgagcccgauggcccuaccccagagcuggaagaggaaauguucaagaaaagaaaccucacaaucauggacuugcaucccgggaguggaaagacgaggaaguaccugccugcaauaguccgugaggcuauuaaacgccggcucagaacucugauccuugccccgaccagggugguagcugcagaaauggaggaggcccugaagggcuugcccauccgauaucagacaaccgccacuaaauccgaacacacaggucgggagauuguggaucuaaugugccaugcuaccuuuacgaugcgccugcucagcccaguuagagucccuaauuacaacuuaaucauaauggacgaagcgcacuucacugaucccgcaucuauugccgcuaggggguauaucagcacacgggugggaaugggcgaggccgcagccauuuuuaugaccgcuaccccaccuggcacugcggaagccuucccccaguccaaugcaccaauccaggacgaggagcgagacauaccggaaagaucauggaacagugggaaugaguggauuacagauuuugugggaaagaccgucugguucguaccuagcaucaaagcugguaacgacaucgccaacugucugcgcaagaauggcaagaaagugauucaacuuucuaggaagacauuugauacugaauaccagaaaacgcgucugaacgacugggauuucguugugaccacagacaucuccgagaugggggcaaauuuuaaggccgaucgggucauugaccccagaaggugccucaaaccagugauauugacugauggacccgagcgcguuauccuggcuggcccuaugccagugaccgccgcgucagcagcccagcgaagaggucgggucgggaggaacccccagaaggaaaaugaccaauacauuuucacaggccagccucucaacaaugaugaggaccaugcucacuggaccgaagccaagaugcugcuugacaacaucaauacuccggagggaaucauuccagcucuauucgaacccgagcgcgagaaaagugcagccauagauggcgaauaucgucugaagggggagagcagaaaaacguuuguggaauugaugcggaggggagacuuaccuguauggcuggcucacaagguggccuccgaggguaucaaauacaccgaucgcaaguggugcuucgacggcgaacgaaacaaucagauucucgaggagaacauggauguugaaaucuggacaaaagagggggaaagaaagaagcugcggcccagguggcuugacgcacgcacuuauucugauccacuggcgcucaaagaguuuaaggacuucgccgcuggaagaaaaucgauugccuuggaucuggucaccgaaaucggcagggugccuagccaucuagcacaccggacacguaaugcucuggacaaccucgugaugcuucauaccucagagcacggugggcgcgccuaccgacacgcagucgaggaacugcccgagacuauggaaacauuauugcugcucggccugaugauacuucugacgggaggcgccaugcucuuuuugaucuccgggaagggaauugguaaaaccaguaucggccugauuuguguuaucgugucuagcgggauguuauggauggcugauguaccacuacaguggauagcguccgccauugugcuggaguucuuuaugaugguccuccuuaucccugagccggaaaagcaaagaacuccccaggacaaucagcuggcauaugugguuauuggaaucuugacacuggcugccauaguggccgcaaacgagaugggccuccuggaaaccaccaagagggaucuugguaugucaaaagagccaggggucguaucuccuacaagcuaccucgacguggaccugcaucccgcuagugccuggacuuuguaugcgguugcuacgaccgugaucacaccaaugcugcggcacacuauugaaaauuccaccgccaacgucagcuuagcagccaucgcuaaccaagcagugguccuaaugggccuggauaagggauggccuauuucuaaaauggaccucggcgugccccuucuggccuuggggugcuacucacagguuaauccgcugacacucaccgcggcugugcugcuuuuaguaacucauuacgccaucauaggaccaggccugcaggcaaaggccacgcgcgaggcucagaaaagaacagccgcagguauuaugaagaacccuaccguggaugggaucaugacuaucgaccucgaucccgucauuuaugacuccaaguucgagaaacaauugggacagguuaugcugcuagugcugugugcuguccagcuccuucugaugaggaccaguugggccuugugcgaagcgcugacacucgccacuggcccaaucaccacacugugggaggguagccccggcaaguuuuggaauacgaccauagcagugucgauggcuaacauuuuccgggggucuuacuuagccggagcaggccuugcuuuuuccaucaugaaaagcguagggacuggacgaagaggcacagguucacagggggaaacccugggagagaaguggaaaaagaagcucaaucaacuaagucgcaaagaguucgaucuguauaagaaaucuggcauuacugagguggacaggacagaggccaaggaagguuugaaacggggcgagaccacgcaccaugccguuucccgugggagcgcgaagcugcagugguuuguggaaagaaacauggucaucccugagggaagggugauagaucucggcugugggcgcggaggcuggucauacuauugcgcuggucuuaaaaaggucaccgaagugcggggguacacaaagggaggcccgggccacgaggagcccguuccaaugaguacuuauggguggaauaucguaaaacugaugagcggaaaggacguguucuacuugccucccgaaaaaugugauacccugcucugcgacauuggugaguccucuccuagcccaacagucgaagagucccgaacuaucagaguguuaaagaugguugagcccuggcugaaaaacaaucaguucuguauuaaggugcuuaacccuuacaugccaaccgucaucgaacaccuggagaggcuacagcgcaaguauggcgggaugcucgugcggaauccccugucaagaaacucuacacaugaaauguacuggauuaguaauggaaccggcaacaucguaucgagcgugaauaugguuucccguuugcugcucaacagguuuacuaugacgcaccggcgcccgacaauagagaaagaugucgaccuuggugcagggacccgacaugugaacgccgaaccugagacuccaaauauggacgugauuggagagagaaucaagaggaucaaagaagaacacucuucaaccuggcacuaugaugacgaaaaccccuacaagacaugggcuuaucauggcagcuacgaggucaaagccacgggcuccgcaaguucuaugauuaaugggguugugaagcuguuaaccaagccuugggauguagugccaauggucacucaaauggccaugacagacaccacucccuucggacagcagcggguguuuaaagaaaagguugauacacgcaccccgagaccuaugcccgguacaaggaaagugauggagauaacugcugaguggcuguggcgaaccuugggccggaacaagaaaccacgucucugcacgagagaagaguucaccaagaagguccgcacaaaugcggccaugggggcaguguuuacugaagagaaccaaugggacagcgcuagggccgcaguagaagaugaggaguucuggaaacugguugaccgggaaagagagcuacacaaacuuggaaaauguggcucaugcguguauaauaugauggguaagcgcgagaaaaagcugggggaguuuggaaaagccaagggcuccagggcuaucugguacauguggcucggcgcccgauaccuggaguucgaagcguugggguuucugaacgaggaucauugguucagucgggaaaauagcuauucuggagucgagggugaaggccuccacaaacuuggguacauucugagagacaucuccaaaauuccuggaggcgcaauguaugccgaugacaccgcugguugggacacaaggaucacugaggaugacuuacauaacgaggaaaagauaacccagcagauggaucccgagcaccgccagcuggccaaugcaaucuuuaaauugacguaccaaaacaagguggugaaaguccagcguccaacacccaaggggaccguuauggacauuaucucacggaaggaucagagaggaagcggccaggugggcacuuaugggcucaauacauucaccaacauggaagcucaacugguaaggcagauggagggagaaggugugcuaucgaaagccgaccuugagaauccucaucugcucgagaagaaaauuacucaguggcuggaaaccaagggcgucgagcgcuugaaacgaauggcuaucucuggggaugacugcgugguuaagccaauagaugaccgguuugccaacgcauuacuggcgcucaacgauaugggaaaggugagaaaagacauuccgcaguggcaacccaguaagggcuggcaugauuggcagcaggucccuuucuguucccaccauuuccacgaacuuaucaugaaagacgguaggaagcuggugguaccaugccgcccccaggacgagcuaaucgggagagcccggauuagccaaggagcuggcuggucacugaaagaaacagccugucucggcaaggcauacgcucagaugugguccuugauguauuuucacaggcgugaucugcgacuugccucuaaugcaauaugcagcgccguuccugugcauugggucccaacgagucgcaccacuugguccauccacgcgcaucaccaguggaugacaaccgaggacaugcugacuguguggaacagaguuuggauugaggauaaucccuggauggaagacaagacaccugugaccacgugggaggaugucccguaccucgggaaacgggaagaccaaugguguggcagcuuaaucggucugacaucuagggcuaccugggcccagaacauuuugacugcaauccaacaggugcgcucacugauaggcgaugaggaguuccucgacuacaugccaaguaugaagagauuucggaaagaagaggaauccgagggggccaucugguga

SEQ ID NO: 15651 - RNA, 9873 nt, Artificial Sequence
  derived and/or modified CDS sequence (opt3) from DENV-3__DQ863638__SS-prME
accucacugugccucaugaugaugcuucccgccacucuggcuuuccacuugacuuccagagacggcgaaccuaggaugaucguggggaagaaugaacggggaaaaucuuuacuguuuaagacggcaucagguauuaauauguguacccuaauagccauggaucucggcgagaugugcgacgauaccgucacuuacaaauguccacauaucgcggaaguugagccggaagacauugauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauccucgcccuguuucuggcucauuacauuggcacaucucucacucagaagguugugaucuucauauuacugauccuugucaccccaucgauggccaugcgcugugugggcguagggaacagagacuuuguugaaggauugucaggugcgacauggguggaugucgugcuggagcacggcgggugcgugaccacgauggcaaagaauaaacccacucuagacauugagcuccagaagacagaagccacccaacuggcuacucuuaggaaacuguguaucgagggaaagauuacaaacaucaccacggauagccggugcccuacccagggcgaagccauauugccagaggaacaggaccagaauuaugucuguaaacacacauacguugaucgcgguugggggaacggaugcggccucuucggcaaggggagucuggugacuugcgcaaaguuucaauguuuagaguccauugagggaaaaguagugcagcaugaaaaucugaaguauaccgucaucauuacagugcacacuggugaccagcaucagguuggcaacgagacccaaggggugacagcugaaaucacaccccaggccucuacugucgaggcgauccucccugaauacggaacgcuuggccuggagugcagcccacgaacagguuuggacuucaaugagaugauucuacugaccaugaaaaacaaggccuggauggugcacagacagugguuuuucgaucucccgcugcccuggacuuccggggcaaccacagaaaccccuacuuggaauaggaaagagcuucugguaacauuuaagaacgcucacgccaaaaagcaagaaguuguggucuugggcucacaggagggagcuaugcauacggcccucaccggcgcaacugaaauacagaauagugggggaacaagcaucuucgccggucaccugaagugucgguuaaaaauggacaagcuggagcuaaaaggcaugucuuaugcuaugugccucaacaccuuugugcugaagaaagaggucuccgaaacacagcaugggacuauucuuaucaagguggaguacaagggagaagaugcgccauguaaaauacccuucucaaccgaggacggccaagguaaggcacacaacgggcguuugauuacggccaauccuguugugaccaaaaaggaggaaccaguaaacaucgaggcugaacccccguucggcgagagcaauaucgucauuggaaucggcgauaaagcccugaagauuaacugguacaagaaagggaguucuauaggaaagauguuugaagcaacagcccgcggugcuagaaggauggccauccucggcgacacugcaugggauuucggguccgugggaggcguucugaauagccuugguaaaauggugcaucagauuuuugggucggcguauaccgcucuguucucuggcgucuccuggaucaugaagaucggaauuggcguguugcucacauggauagggcugaacagcaagaauacaaguaugagcuuuuccugcaucgccauuggaaucauuaccuuauaccugggcgcaguagugcaggccgacauggguuguguuaucaacuggaaggggaaggagcuaaaaugcggaucuggcauauucgucacgaaugaggugcacacauggaccgaacaguauaaguuucaagcugauagcccuaaacggcucgccacugcaaucgcuggugccugggagaacggcgugugugggauucgaucaacaacccgcauggaaaaucugcuuuggaagcagaucgcgaacgaguugaauuacauucugugggaaaacaauaucaaacucacugucguugugggagacauaauuggcgugcuggagcaggggaagagaaccuuaacaccccagccaauggagcugaaauauaguuggaagacguggggaaaggccaaaaucguaaccgcugaaacucaaaacuccagcuucauuaucgauggcccucacacacccgagugcccaagggcaucucgggccuggaacgucugggaaguggaggacuacgguuuugggguuuucaccacaaauauauggcuuaaguugcgcgaagaguauacucagcucugugaccauagacugaugucagcugccgugaaagaugagagggcaguccacgcggacaugggauacuggaucgaaagucagaagaacggcagcuggaaacuagagaaggccucccugauugaagugaagaccugcacguggcccaaaucucauacacucuggucgaaugguguucuggagagcgauaugaucauuccuaagucccuugcuggcccaaucucacagcacaaccaccguccgggguaccauacccaaacugccggacccuggcacuugggcaaacuggaguuagacuuuaauuauugcgaagggaccacagugguaauaacugagaacuguggaacccggggcccuagucuccgaacaacgaccgucucugguaagcugauucaugaauggugcuguagaagcugcacucuuccaccccugagguacaugggggaggauggauguugguauggcauggaaauccgcccuaucaaugagaaagaggaaaacauggugaaguccuuggcaucagcugguagcggcaagguggacaauuucacaaugggguuucucugccuggccauucuauucgaggaagucaugcggggaaaauucggcaagaaacacaugaucgcagggguuuuucugaccuuccuccugcuuuugucuggacagauuacuuggagagauauggcccauacacugauaaugaucggcuccaacgcuagugacaggauggguaugggggugaccuacuuagcgcucauugccacguuuaagauccagccauuccuggcacuuggauuuuuccugcgcaaacuaacuagccgagagaauuuucuccugggcguaggcuuggcuauggccaccacacugcaauuacccgaagauauugagcagauggccaacgggaucgcucucggacugauggcacuuaagcugauaacccaguucgagacuuaucaguuguggacagcccucgugucucugaccuguuccaauacaaucuuuacucuaaccgucgcguggcggacggcuacacugauucuugccggugugucacuccugccgguuugccaaaguagcucgaugcguaagaccgacugguugccuauggcaguggccgcuaugggcgucccaccccugccuuuauucaucuuuucccucaaagauacucugaagagaaggucuuggccccuuaacgaaggggugauggcaguuggacuggugagcauuuuggccucaagucuccugcgcaaugacgucccaauggcgggcccucuaguagcuggugggcugcuuaucgccuguuacgugauaaccggaacauccgcagaucucacuguugagaaagccgcugacgugaccugggaagaggaagccgagcagacgggcgucucucacaaccugaugauuacaguggacgaugacggcaccaugcggaucaaggaugacgagacugaaaacaucuugacaguauuacugaaaaccgcacuccugauugugagcgggauauuccccuauuccaucccagcuacucuucuggucuggcacacauggcagaagcagacccaaagaucaggaguuuugugggaugugccgagcccucccgagacgcagaaagccgaacuagaggaggguguguacaggauuaagcagcagggcaucuuugggaagacucaagucggagugggcguucagaaagaagguguauuccauaccauguggcacgugacacgaggggcgguccugacccauaauggaaagcgccucgagccaaacugggccagugugaaaaaggaccugauuucuuacggcggcggguggcggcuuuccgcacaguggcaaaaaggagaagagguucaggugaucgcugucgaacccgguaagaauccuaagaacuuccagacaaugccaggcauauuucagacuaccacgggggagaucggagccauugcuuuagauuucaaacccggcacaagcgguucgccuaucauuaauagagaggggaaggugguaggacuguauggcaacggcgucgugacuaaaaaugggggauacguuucagguaucgcacaaaccaacgccgaaccggacggcccaacacccgagcucgaagaggaaauguuuaagaaaaggaauuugaccauaauggaucugcacccugggucuggaaagacucguaaguaucucccagccauugugcgcgaggcuaucaaacggagacugaggacccuuauccuggcgcccacacgagucguggcagccgagauggaagaggcuuugaagggccuaccuauucgguaccagacgacugccaccaaaagugaacauacaggucgcgagaucguugaccugaugugccacgcaaccuucacuaugagacucuuauccccggugaggguccccaacuauaaucugauaauuauggaugaagcccacuuuacagacccagcuagcaucgcggcccggggguacauuucuacccgagugggaaugggcgaggcagcugccaucuucaugacggcaacuccucccggcacagccgaugcuuuuccacagagcaacgccccuauacaggacgaggaaagagacauucccgagcgcuccuggaacucagggaacgaauggaucaccgauuucguaggaaagaccgugugguuuguuccaaguaucaaagcggguaaugacauugcaaacugucuuaggaagaacggcaagaaagucauccaacugagccguaagacuuucgauacagaguaucagaaaaccaagcucaaugacugggauuuuguggugacaacugacauuucugagaugggggccaacuucaaagcugaucgggucauagacccgagaaggugcuugaagccuguaauccugacggauggacccgaacgcgugauucucgccggcccaaugcccguuaccgcugcauccgccgcucagcgaagaggucggguggggaggaauccucagaaggagaacgaccaauacaucuuccgcggccagccacugaauaacgaugaagaccaugcccacuggacagaggcaaaaaugcuucuagacaauaucaacacucccgaaggaauuauaccugcgcuguuugagccggagcgugaaaagucagccgcuaucgauggcgaguacagauugaaaggggaaagucggaagaccuucgucgaguuaaugaggcgcggagaccugccaguguggcucgcccauaaaguugcaagcgaagguauuaaguauacagaucgaaaauggugcuuugacggcgagagaaauaaccagauccuggaggaaaauauggauguggagauuuggaccaaggaaggggagaagaagaaacuucggcccagguggcuggacgcucgcacuuacuccgauccucucgccuugaaagaguucaaagacuuugcagccggaagaaaaucuaucgcucuggaucuagucacggagauaggcagggugcccucgcaccuggcgcaccggacccguaacgcccucgacaaucuuguaaugcugcauacaagcgagcacggugggcgcgcauaucgacaugcuguggaagaguuaccagaaacuauggagaccuugcugcuccugggccuuaugauccugcucacaggaggcgccauguuguuccugauuucagggaagggaaucgguaagaccuccauuggcuuaaucuguguuauagccaguucugggaugcuauggauggcagaugucccucugcaguggauugcuagcgccaucgugcucgaguuuuucaugauggugcuucugauucccgaaccagagaaacaaagaacuccucaggacaaccaguuggcguacgucguuaucggaauacugacacucgcugccaucguggcagccaaugaaaugggccugcuugagacgaccaagagggaucucgguauguccaaagaaccggggguagugucacccacuucuuaucuggacgucgacuugcacccagcuagcgcauggacacuguacgccguggcgaccaccguuauuacaccuauguuacggcauacuaucgagaacaguacggcuaaugugucccuagccgcaauugccaaccaagcugucguacugaugggccucgauaagggauggcccaucagcaaaauggaccuuggcgugccacuguuggcccuggggugcuauucucagguuaacccucucacccugacagcagcugugcuuuuacuggccacucacuacgcgauaauuggacccggccuccaggccaaggcaacccgcgaggcucagaagagaacagccgcagguaucaccaaaaauccgacugucgaugggaucaugacgauugacuuggauccagugaucuacgacucaaaguuugaaaaacaacugggacaggucaugcuacuggugcucugugcuguucagcuucuguugaugaggacauccugggcccugugcgaggcccucacccuggcgacuggcccuauaaccacauuaugggaagguagucccggcaaguucuggaacacuaccauugcugugagcauggcaaauaucuuucgggggucguaucuugccggagcuggccuggccuucucuauuaugaaauccguagggacaggaaagcgaggcacggguagccagggggagacccucggagaaaaguggaaaaagaaacuaaaccaacugucaagaaaggaguuugauuuguacaaaaagaguggcaucacugagguggaccgcacagaagcaaaagagggucugaagaggggcgaaauaacccggcacgccgucucucguggguccgcuaagcuccagugguucguugagagaaauauggugaucccagaaggaagggucauugaucuuggcugugggcgcggaggcuggagcuauuacugcgcgggucugaaaaaggugacugagguacggggguauacaaaaggaggccccggccaugaggaaccugugccgaugucaaccuacggguggaacaucguuaaguugaugaguggaaaagacguguucuaucugcccccagagaagugugauacgcucuuaugcgacauuggugaaagcuccccuucucccaccgucgaggagagccgaacaaucagagugcugaagauggucgaaccuuggcuuaaaaauaaccaguuuuguauuaaggugcugaauccauacaugcccacuguuaucgagcaccuagaaaggcuccagcgcaaacauggcgggaugcugguacggaacccuuuguccagaaauucaacccacgagauguacuggauaucuaacggaacaggcaauauugugaguucggucaacauggugagccgucugcuccuuaauagguucacuaugacccaccggcgcccaacaaucgaaaaggauguugaccugggugccgggacccgacaugugaacgcagagcccgagacuccgaacauggacgucaucggagaaagaauuaaaaggauaaaggaggaacacaauuccacguggcauuaugaugacgagaacccuuacaagacaugggcuuaucacggcucuuacgaagugaaagccaccggcucagcaagcuccaugaucaaugggguagugaaguuacugacuaaaccaugggauguuguccccauggugauucaaauggccaugaccgacacaacgccuuuuggacagcagcggguguucaaggagaaagucgauacccgcacuccaagacccaugccggguacaaggaagguuauggagaucaccgcugaaugguuguggcgaacucucggccggaacaagcguccuagacugugcacacgcgaggaauuuaccaaaaaggugaggacaaaugccgcgaugggggcaguauucacugaggaaaaccaaugggacagugcccgggcugccguggaggaugaggaauuuuggaagcuagucgacagagagcgcgaacuucauaagcugggaaaauguggcucuugcguguauaauaugauggguaagagggagaaaaagcucggggaguucggaaaggcaaaaggcagccgagcuauuugguacauguggcugggcgcccgguauuuggaauuugaggcucugggguucuuuaacgaagaucacugguucucaagagaaaauuccuacaguggaguugaaggugagggccuccacaaacuuggguacauccugagggacauaagcaaaauccccggaggcgccauguaugcagaugacaccgcggguugggacacgcgcauuaccgaggaugacuuacauaacgaagagaagaucacacagcagauggauccagaacaccgucagcuggccaaugcuauuuuuaaauugacuuaccaaaacaagguggucaaggugcagcggccuacccccaaagggacaguaauggacaucauaucuagaaaggaucagaggggauccggccagguuggcacuuaugggcucaauaccuucacgaacauggaggcccaacuggugcgccagauggaaggagaggguguccuaucaaaagcagaccuugagaauccacaucugcucgaaaagaaaauuacacaguggcuggagaccaagggcguggaacgauugaagcggauggcuaucagcggggaugacugcguggucaaacccaucgaugacagauucgccaacgcauuacuggcccucaacgauaugggaaagguuaggaaagacauuccucaguggcaaccaucgaagggcuggcacgauuggcaacaggugccguuuuguucucaccauuuccacgagcuuauaaugaaagacggucgcaagcugguagugcccugcagaccucaggacgaacuaaucgggcgggcgaggauuagucguggagcuggcuggucccugaaggagacugccugucucggcaaagcauacgcccaaauguggagcuugauguauuuucaucgacgcgaucugagacuugcuucaaaugccaucugcuccgcagucccagugcacuggguucccacaucucggaccacuuggagcauucaugcucaccaccaguggaugaccacagaggacaugcugacgguguggaacagggucuggaucgaagauaauccuuggauggaggacaagaccccagugacuacaugggaagauguacccuaccucgggaaacgcgaggaccagugguguggaaguuuaauaggucugaccuccagagccacuugggcgcaaaacaucuugacagcuauucagcagguucggagccugaucggcaaugaggaguuccucgauuauaugccuucuaugaagagguuuaaaaaggaggaagagucagaaggggccauuugguga

SEQ ID NO: 15652 - RNA, 9873 nt, Artificial Sequence
  derived and/or modified CDS sequence (opt3) from DENV-3__KJ737430__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgauggccaugcgcugugugggcguagggaacagagacuuuguugaaggacugucaggugcgacauggguggaugucgugcuagagcauggcgggugcgugaccacgauggcaaagaauaaacccacucucgacaucgagcugcagaagacagaagccacccaacuugcuacucugaggaaauuguguauugagggaaagaucacaaacauuaccacggauagccggugcccuacccagggcgaagccauccucccagaggaacaggaccagaauuaugucuguaaacacacauacguugaucgcgguugggggaacggaugcggccuguucggcaaggggaguuuagugacuugcgcaaaguuucaaugucuggaguccauagagggaaaaguagugcagcacgaaaaucucaaguauaccgucauuaucacagugcauacuggugaccagcaccagguuggcaacgacacccaaggggugacagucgagauuaccccccaggcuucuacuguggaagccauccuuccugaguacggaacgcugggcuuggaaugcagcccacgaacaggucuagauuucaaugagaugauccugcucaccaugaaaaacaaggcguggaugguacauagacagugguuuuucgaccugccgcuucccuggacuuccggggccaccacagagaccccuacuuggaauaggaaagaacuguugguuacauuuaagaacgcacacgcuaaaaagcaagagguggucgugcucggcucacaggaaggagccaugcacacggcucugaccggcgccacugagauucagaauagugggggaacaagcauauucgcaggucauuuaaagugucggcugaaaauggauaagcuagaacucaaaggcaugucuuaugccaugugccugaacaccuuuguccuuaagaaagagguguccgagacacagcacgggacuaucuugauuaagguugaauacaagggagaggacgcuccauguaaaauccccuucucaaccgaagauggccaagguaaggcgcauaacgggcgucugauaacggcaaauccugugguaaccaaaaaggaggagccagucaacauugaagccgagcccccguucggcgaaagcaauaucgugaucggaauuggcgacaaagcucucaagaucaacugguacaagaaagggaguucuauuggaaagauguuugaggccacagcacgcggugccagaaggauggcuauacugggcgauacugccugggacuucggguccguuggaggcgugcuuaauagccuggguaaaaugguccaccagaucuuugggucggcauauaccgcguuguucucuggcguguccuggauuaugaagaucggaaucggcguacuccugacauggauuggguuaaacucaaaaaauacuaguaugagcuuuuccugcauagcuaucggaauuaucacccuguaccuaggcgccgugguucaggcagauauggguugugucauuaacuggaaggggaaggaacucaaaugcggaucuggcaucuucgugacgaaugaggugcauacauggaccgagcaguauaaguuucaagccgacagcccuaaacggcuggcuacugccauagcaggugcuugggaaaacggcgucugugggauccgaucaacaacccgcauggagaaucuuuuguggaagcagauugccaacgaacugaauuacauccucugggagaacaauauuaaacugacuguuguggugggagauaucauaggcguauuagaacaggggaagagaacccugacaccccagccaauggagcuuaaauauaguuggaagacguggggaaaggcgaaaauugucaccgccgagacucaaaacuccagcuucaucauugacggcccuaacacacccgaaugcccaucugcuucaagggcauggaaugugugggagguugaagacuacgguuuugggguguucaccacaaacaucugguugaagcuccgggaggucuauacucagaguugugaucaccgccugaugagcgccgcuauaaaagacgaaagagccgugcacgcagauaugggauacuggaucgagucccagaagaauggcucuuggaaacuagagaaggcgucguuuauugaaguuaagaccugcacguggcccaaaagccauacacugugguccaacggugugcucgagucagacaugaucauuccuaagagucuggccggcccaaucucucagcacaaucauaggccgggguaccacacccaaacugcuggacccuggcaccuuggcaaauuggaacuggauuucaacuauugcgaggggaccacaguagucauaacugagaauuguggaacccguggcccuagcuuacggacaacgaccguguccgguaagcucauucaugaauggugcugucgaucaugcacucugccaccccuuagauacaugggggaggacggauguugguauggcauggaaaucaggccuaucaacgagaaagaagagaauauggugaagagccuggucucugccgguuccggcaagguugauaacuuuacaauggggguguugugccucgcaauucuguucgaggaaguaaugcgcggaaaauucggcaagaaacacaugaucgcuggggugcuauuuaccuucguccugcuccugaguggacagauuacuuggcgggacauggcccauacacuuauaaugaucggcagcaaugcaucugauagaauggguaugggggugaccuacuuggcccugauugcuacguuuaagauccagccauucuuagcgcucggauuuuuccugaggaaacuuacuucccgcgagaaccugcuacucggcguuggccuggccauggcaaccacauugcaacugcccgaagacauugagcagauggcuaaugggaucgccuuaggacucauggcccugaagcuuauaacccaguuugaaacuuaucagcuguggacagcuuuggugucacucaccuguaguaacacaaucuucacucugaccgucgcauggcgaacggccacacuaauucuggcgggugugagccuucucccgguuugccaaucguccucuaugcggaagaccgauuggcugccuauggcuguggccgcaaugggcgucccacccuugccucuguuuaucuucagcuuaaaagacacucucaagcguagaucauggccccugaaugaggggguaauggccgugggacuuguuaguauucuggcuuccucuuugcucaggaacgaugugccaauggcaggcccucuggucgccggugggcuacugaucgcguguuacgugauaaccggaacaagcgcugaccuuacuguagagaaagccgcagacgugaccugggaagaggaagccgagcagacgggcgucucccacaaccucaugauuacaguugaugacgauggcaccaugcgcaucaaggacgaugaaacugagaauauccugacaguguuguuaaaaaccgcucugcucauugugucagggauauuucccuauagcaucccagccacucugcuugucuggcauacauggcagaagcagacccaacggaguggagugcugugggacguuccgucuccucccgagacgcagaaagcagaauuggaggaagguguauacagaauuaagcagcagggcaucuucgggaagacucaagugggagucggcgugcagaaagaggguguuuuucacaccauguggcacgugacaaggggggcuguccuaacccauaacggaaagcgacuggagccaaauugggccuccgugaaaaaggaucucauuagcuacggcggcggguggcgccugucggcgcaguggcaaaaaggagaagagguacaggucaucgccguggaacccgguaagaacccuaagaauuuccagacaaugccaggcauauuccagacuaccacgggggagaucggagcaauugcucuugacuuuaaacccggcacaucagguucuccuaucauuaaccgggaagggaagguugugggauuauauggcaauggcgucgugacuaaaaacgggggauacguuagugguaucgcccaaaccaaugcugagccggauggcccaacacccgagcuggaagaggaaauguucaagaaaagaaaccucaccauaauggacuugcacccuggguccggaaagacuaggaaguaucugccagcaauugugcgugaggccaucaaacgccggcucagaacccugauccuugcccccacaagggucguggcugcggaaauggaggaggcacugaagggcuugccuauucgauaccagacgacugccaccaaaagcgaacauacaggucgggagaucguagaucuaaugugccacgcuaccuuuacuaugcgccugcucucuccggugagaguucccaauuauaacuuaauaauuauggacgaagcccauuucacagauccagcaagcaucgccgcuaggggguacauuuccacccgggucggaaugggcgaggcggccgcaaucuuuaugacggcuacuccucccggcacagccgaagcauucccacagucaaaugccccuauacaggacgaggagcgagacauucccgaaagaaguuggaacagcgggaaugaguggaucaccgauuuugugggaaagaccgugugguucgucccaucuaucaaagcugguaacgacauugccaacugucugcgcaagaauggcaagaaaguaauccaacuuuccaggaagacuuuugauacagaauaucagaaaaccaagcugaacgacugggauuucgugguuacaacugacauuucagagaugggggcgaauuuuaaagcagaucgugugauagacccgcggagaugccucaagccugucaucuugacggauggacccgagagggugauucuggccggcccaaugcccguuaccgcugccagugcugcacagcgccgagguagaguggggcggaacccucagaaggaaaaugaccaauacaucuucacaggccagccacucaacaaugaugaggaccacgcccacuggacugaagcuaaaaugcugcuugacaacaucaauacccccgagggaauuauaccugcccuauucgaaccggagagggagaagagcgcagcgaucgauggcgaauaccgccugaaaggggagucccguaagacauuugucgaauugaugagacggggagacuuaccaguguggcuggcccauaaaguagcuucugaggguauuaaguauaccgauaggaaauggugcuucgacggcgaacgcaacaaucagauccucgaggagaacauggauguggaaauuuggacuaaggagggggaacgaaagaaacugagaccccgguggcuugacgccaggacguacucggauccucuggcacucaaggaguuuaaagacuucgcugccggacgcaagagcaucgcauuggaucugguuaccgaaauaggcagaguccccucacaccuagcccauaggacacggaaugcucuggacaaccucgugaugcuucacacuuccgagcacggugggcgugcguaucgccaugccguggaggaacugccagagaccauggaaacauuauugcugcucggccugaugauccuucugaccggaggcgcaaugcucuuuuugauuagugggaaaggaaucgguaagacuucuauuggccugaucugugucauaguuagcuccgggauguuauggauggcugaugugccucuacaguggauugccucagccaucguacuggaguucuuuaugauggugcuccuuauucccgagccagaaaagcaacgaacaccucaggacaaucagcuggcauacgucgugaucggaauauugacgcuggcugccaucguugcggcuaacgagaugggccuccuggaaaccacuaaaagagaucuugguaugucuaaggagccggggguggucagccccacaaguuaucucgacguagaccugcacccagccuccgcauggaccuuguacgccguggcuaccacaguuauuacuccuaugcugaggcauacgaucgaaaauagcaccgcaaacgugucuuuagccgcgauugcuaaccaagccgucgugcuaaugggccuggauaaaggauggcccaucucaaagauggaccucggcgucccacuucuggcauuggggugcuauucccaggugaauccucugacacucacugccgcuguucugcuuuuagugacccacuacgccauaauuggacccggccugcaggcaaaagcuacacgggaggcccagaagcgcaccgcggccgguaucaugaagaacccgacuguagaugggaucaugacgauugaccucgauccagugaucuacgacaguaaauucgagaagcaauugggacaggucaugcugcuaguucugugugcagugcagcuccuucugaugagaacaagcugggcuuugugcgaagcccugacccucgcaacuggcccuauaaccacacugugggaggguucgcccggcaaauuuuggaauacuaccauugcugucucuauggccaacaucuucaggggguccuauuuagccggagcgggccuugcuuuuagcauuaugaagucaguggggacaggaaaacggggcacggguagucagggggaaacccugggagagaaguggaagaaaaagcucaaucaacuaucucgaaaagaauucgaucuguacaagaaauccggcaucacugagguagacagaacagaggcaaaggaagguuugaaacgcggcgagaccacucaucacgccgugagcagggggucagcuaagcugcagugguuuguugaacggaacauggugauaccagagggacgugucaucgaucucggcugugggagaggaggcuggaguuauuacugcgccggucuuaagaaagugacagaagucaggggguauaccaagggaggccccggccacgaggagccugugccgaugagcacguacggguggaauauuguuaaacugauguccggaaaggacguauucuauuugcccccagaaaaaugugauacccugcucugcgacaucggugagucuagcccuucccccacaguggaagagucacgcacuauucgggucuuaaagaugguggagccuuggcugaagaacaaucaguucuguaucaaaguucuuaacccauacaugcccaccgugauugaacaucuggagcgacuacagagaaaguacggcgggaugcucgucaggaauccucugucucgcaacaguacacacgaaauguauuggaucucgaauggaacuggcaacauagugagcuccguaaauauggugucucgguugcugcucaacagauuuaccaugacacaucguaggccaaccauugagaaagauguugaccuuggugcagggacucggcacgucaacgccgaacccgagacgccgaauauggacgugaucggagagcgcaucaagcgaauuaaagaagagcacucaagcacauggcauuacgaugacgaaaacccuuauaagaccugggcuuaccacggcuccuaugaggugaaggcgacuggcagugccucuagcaugauaaauggggucguuaaacuguuaaccaagccaugggaugugguacccauggugauccaaauggcaaugacagacacgaccccuuucggacagcagagagucuuuaaagaaaagguggauacuaggacaccacggcccaugccggguacccgcaaaguuauggagauuacugcugaguggcuguggagaacauugggcaggaacaagcgaccucggcucugcacccgugaagaguucacaaagaaagugagaacuaaugccgcaaugggggccgucuuuaccgaagagaaccaaugggacucagcucgcgccgcgguggaagaugaggaguucuggaagcugguagacagggaacgggagcuacauaaacuuggaaaguguggcuccugcguuuacaauaugauggguaaaagagaaaagaaacugggggaguuuggaaaggcaaagggcagucgcgccaucugguauauguggcucggcgcuagguaccuggaguucgaagccuugggguuucugaacgaggaucacugguucagccgagaaaauucuuacuccggaguggagggugaaggccuccauaaacuuggguauauucugcgggacaucucaaagauacccggaggcgcaauguacgcugaugacacggccgguugggacaccagaaucacagaggaugacuuacacaacgaggaaaaaauuacucagcagauggauccagagcacaggcagcuggcuaaugccaucuuuaaguugaccuaucaaaacaaagucgugaaggugcagcgcccuacacccaaggggacugucauggacauuaucagccguaaagaucagcggggaucgggccagguuggcaccuacgggcucaauacguucacaaacauggaagcacaacuggugagacagauggagggagaagguguacuaucuaaggcggaccuugagaauccacaucugcucgagaaaaagauaacccaguggcuggaaacuaaaggcguggagagguugaagcgcauggccauuaguggggaugacugcgucgugaagcccaucgaugaccgauuugcuaacgccuuacuggcacucaacgauaugggaaaaguucggaaggacaucccucaguggcaaccauccaaaggcuggcacgauuggcagcaggugccguucuguagccaucacuuccacgaacuuauuaugaaggacgguagaaaacuggucgugcccugcaggccucaggacgagcuaauagggcgcgcuagaaucucacaaggagccggcuggucccugaaggaaacagcaugucucggcaaggccuaugcgcagauguggucuuugauguacuuucaucggagggaucugcgucuugcuagcaaugccauuugcagugcaguaccaguucacugggugcccaccucccgaacuaccuggagcauccaugcccaccaucaguggaugacaacggaggacaugcugaccgucuggaaccgcguguggauugaggauaauccuuggauggaagacaaaacuccaguuacaaccugggaggaugugcccuaucucgggaagagagaagaccaaugguguggaucuuuaaucggucugacuucacgggcuacaugggcccagaacauauugaccgcaauccagcaggucaggagucugauuggcgaugaggaguuccucgacuacaugccuuccaugaaacgcuuuagaaaggaagaggaaagcgagggggcuaucugguga

SEQ ID NO: 15653 - RNA, 9873 nt, Artificial Sequence
  derived and/or modified CDS sequence (opt3) from DENV-3__AY858040__SS-prME
accagccugugccucaugaugaugcuucccgcaacacuggcuuuccacuugacuuccagggacggagaaccuaggaugaucguggggaagaacgaacggggaaagucuuuacuguuuaagacggcaucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcuaaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagccggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcguacuggagcaggggaaacgcacauuaacgccccagccaauggagcugaaguauaguuggaagaccuggggaaaagcgaagauugucacugccgaaaaacaaaauuccagcuuuaucauugauggcccuaacacacccgagugcccaaacgcuucuagagcauggaaugugugggaaguugaggacuacgguuucgggguguuuaccacaaacaucuggcuuaaguugagggaaauguauacucagcucugugaccaccggcugaugucagccgcugucaaagaugagcgcgccgugcacgcagacaugggauacuggauagagagucagaagaauggcagcuggaagcuagaaaaagcgucccugaucgagguuaagaccugcacguggcccaaaucucauacacucuggucgaacggugugcuggaaagcgauaugauuaucccuaagucccuugccggcccaauuucacagcacaauuacagaccgggguaucauacccaaacugcuggacccuggcacuugggcaaacuggaguuagacuucaacuacugcgaggggaccacaguagucaucacugaaaauuguggaaccaggggcccuagucuccguacaacgaccgugucugguaagcugauacacgaguggugcugucggagcugcacucuuccaccccugcgauauaugggggaagauggauguugguacggcauggagauuagaccuaucaacgaaaaggaggagaauauggugaaauccuuggucucagccgguagcggcaagguugacaacuuuacaaugggggugcucugccuggcaauccuauucgaagagguaaugaggggaaaauucggcaagaaacauaugauugcuggggugcuguuuaccuucguccuccugcuuucuggacagaucacuuggcgcgauauggcccggacauugauuaugauaggcuccaaugcaagugacagaauggguaugggggugaccuaucuggccuuaaucgcuacguuuaagauucagccauuccucgcgcugggauuuuuccuuaggaagcugacuagccgcgaaaaccuacuccugggcguuggcuuggccauggcaaccacacugcaauuacccgaggauaucgaacagauggcuaaugggauugcccucggacugauggcccuuaaacugaucacccaguuugagacuuaccaguuguggacagcucucgugucucugauguguuccaacaccauauucacacuaacugucgcauggcgaaccgccacgcugauccuugcggguauuucacucaugccggugugccaaaguagcucgaugcggaagacagacuggcugccuaugaccguugcugccaugggcgugccacccuugccucuguuuaucuucuccuuaaaagauacucucaagcguagaucuuggccccugaaugagggggucauggcaguaggacuugugagcauucuggccucaaguuugcucaggaacgacguuccaauggcuggcccucugguggccggugggcuacugaucgccuguuaugucauaaccggaacauccgcggaucuuacuguggaaaaagcugccgacguaaccugggaggaagaggcagaacagacgggcgugucucacaaccucaugauuacagucgacgaugacggcaccaugcgcaucaaggaugacgagacugagaauauccugacaguuuuguuaaaaaccgcccugcucauugugagcgggauauuucccuacuccaucccagcuacucugcuuguguggcauacauggcagaagcagacccaacggucaggaguccugugggaugugccgagcccucccgaaacgcagaaggccgaguuggaagaggguguuuacagaauuaaacagcagggcaucuucgggaagacucaaguaggagugggcguccagaaagaggguguguuucacaccauguggcauguuacaagaggggcagugcuaaccuauaacggaaagcgacuggaaccaaauugggcuagugucaaaaaggaccucauuucuuacggcggcggguggcgccuguccgccuauuggcagaagggagaggaagugcaaguaaucgcggucgagcccgguaaaaacccuaagaauuuccagacaaugccaggcauauuccagacuaccacgggggaaaucggagccauugcacuugauuuuaaacccggcacaagcgguucgccuaucauuaaccgggaggggaaggugguuggauuauacggcaauggcguggucacuaaaaacgggggauaugugucagguaucgcucagaccaaugccgagccggacggcccaacacccgaacuggaggaagagauguucaagaagagaaaccucaccauaauggauuugcacccugggucuggaaaaacuaggaaguaccugccagcuauuguucgugaagcaaucaaacgccggcucagaacccugauccuugcccccacaaggguggucgccgcugagauggaggaagcgcugaagggcuugccugugcgauaucaaacgacugcaaccaaaagugagcacacagguaaggaaauuguagaccuaaugugccaugccaccuuuacuaugcggcugcucuccccggugcgcguucccaauuacaacuuaaucauaauggaugaggcucacuucacagacccagccagcauugcagccagaggguacaucucuaccagggucggaaugggcgaagcugcggccauuuuuaugacggcaacuccucccggcacagcugaugccuucccacagagcaaugcaccuauccaggacgaggagcgggacauacccgaacgauccuggaacucagggaaugauuggauuaccgacuuugccggaaagaccgugugguucgugccaaguaucaaagcugguaacgauaucgccaacugucugagaaagaauggcaaaaaggucauucagcuuagccgcaaaacuuuugacacagaguaucaaaagaccaagcugaacgauugggacuucguagugacaacugauaucucugaaaugggggcgaauuuuaaagcagacaggguuauugauccgcgucggugccucaagccugugauauugacggacggacccgagagagucauccuggccggcccaaugcccgugaccguugcuuccgccgcucagaggcgcggucgaguggggagaaacccucagaaagagaaugaucaguacauuuucacaggccaaccacucaacaaugacgaagaccaugcacacuggacugaggccaagaugcugcuugauaacaucaauacccccgaaggaaucauuccugcucuauucgagccggaacgggagaaaucagccgcaauagacggcgaguauaggccaaagggggaaagucgcaaaacauuugucgagcugaugcguagaggagauuugcccgugugguuagcgcauaagguagccagcgaagguaucaaguacaccgaccggaaauggugcuucgauggcgagaggaacaaucagauucuggaagagaacauggacguggagaucuggacuaaggaaggggagaaaaagaaacuccgcccucgauggcuggaugcuagaacguauuccgacccccuugcccugaaggaauuuaaggauuucgcagcuggacggaaaucuauugcccucgacuugguuaccgagaucggcagggucccaucgcaccuggcacaccgcacaagaaaugcccuagauaaccuggugaugcuccauacuagcgaacacggugggagggcuuaccggcaugcgguggaggagcuuccugaaaccauggagacacuguuauugcugggccucaugauacugcuuaccggaggcgccaugcuguuucucaucucagggaagggagucgguaaaacuuccauuggcuugaucuguguuguggcaaguucugggaugcuguggauggcugacauucccuuacaguggaucgccagcgccauaguacuagaguucuuuaugauggugcugcucauuccagagccugagaagcagcguacaccgcaagauaaucagcuugcauaugucgugaucggcauucugacguuggcugccaucguugcggcuaacgaaaugggccugcucgagaccacuaaacgcgaccuggguauguccaaggaacccgggguggucucaccaacaucuuaccuugacguagaucuccacccugccagcgcauggacccuguacgccguggcuaccacaguuauaacucccauguugcgacacacgaucgagaauaguaccgcaaacgugucccuggccgcgauugcuaaccaggccgucguguuaaugggccuagacaagggauggccaaucagcaaaauggaucugggcgucccucuccuugcacuggggugcuauucucaagugaaucccuugacacugacugccgcuguucuccugcuugugacccauuacgccauuaucggaccgggcuuacaggcaaaggcuacaagagaagcccagaaaaggaccgcggccgguauaaugaagaacccaacuguagacgggauuaugacgaucgaucuggacccugugaucuaugauucaaaauucgagaagcagcucggacaagucauguugcugguucuaugugcagugcagcugcuccuuaugcggacauccugggcuuuuugcgaggcccugaccuuggcaacuggccccauuaccacacugugggaagguaguccaggcaaguucuggaauacuaccaucgcugucagcauggccaacauauuucgcgggucguaccucgccggagcgggccuggcuuucucuauuaugaaauccguggggacaggaaagagaggcacggguagccagggggagaccuuaggagaaaaauggaagaagaaacuuaaucagcugucaaggaaagaguuugaccucuauaaaaagaguggcaucacugaaguagaucggacagaggcaaaagagggucuaaagcgaggcgaaauuacccaccaugccgugucuagaggguccgcuaaacugcaaugguucguugagcgcaacauggugauccccgaaggaagggucauagacuugggcugugggcggggaggcuggagcuacuauugcgccggucugaagaaagugacugagguccguggguacacaaagggaggcccuggccacgaagaaccggugcccaugucaaccuacggguggaauaucguuaagcucaugaguggaaaagauguauucuaucuuccaccugagaagugugacacgcuguugugcgauauuggugaaagcucccccucuccuaccguggaggaaagcagaacaaucaggguccugaaaaugguggagccauggcucaagaacaaucaguuuuguauuaaaguuuuaaaccccuacaugccuacugugaucgagcaucuggaacgccuucagcggaagcacggcgggaugcugguccgaaauccacuauccagaaacucaacccacgagauguauuggauuucuaauggaacaggcaacaucgugaguucgguaaauauggugagcaggcuccuguugaaccgcuucacuaugaccuaccggagacccacaauagaaaaggacguugaccugggugcagggacccgucaugucaacgccgagccggaaacuccuaauauggaugugauuggagagaggauccggcgcaucaaagaggaacacuccucuacguggcauuaugacgaugagaacccauacaagacaugggcuuaucacggcucauacgaagugaaagcgaccggcagcgccuccaguaugauuaauggggucguuaagcuccuuacuaaacccugggacgugguaccuaccgugacacagauggcaaugacggauaccacuccauuuggacaacagcgagucuucaaggagaagguggacacaagaacccccaaaccgaugccugguacuaggaagguuauggaaauaacagcugaguggcuguggcggaccuuaggccgcaacaaaagacccaggcugugcacacgagaggaauuuacuaagaaagugcggaccaaugccgcaaugggggccgucuucacggaggaaaaccagugggauucugcucgugccgcgguggaggacgaagaguuuuggaaguugguagauagagagcgcgaacuccacaaacugggaaaguguggcagcugcguuuacaauaugauggguaagagggagaaaaagcuaggggaguucggaaaagcaaagggcucacgggccaucugguauauguggcuuggcgcuagauaccuggaguuugaggcccucggguuccugaacgaagaccauugguuuucccgcgagaauaguuauagcggaguggaaggugagggcuugcacaaacugggguacauucucagggauaucucuaagauuccaggaggcgcaauguaugcugacgacaccgccgguugggauacacgaaucacugaagacgaucuucauaacgaggagaagauaacccaacagauggaaccugagcaccggcagcuggcuaaugccaucuucaaauuaacauaccagaacaaggucgugaaagugcaaagacccacuccaaaggggaccgucauggacauuaucuccaggaaagaucagcgcggaucaggccagguuggcacguaugggcugaauacauuuaccaacauggaagcacaguugauucgucaaauggagggagaagacgugcucagcaagacugaucuggagaauccccaucuacuugagaagaaaaucacacaguggcuggaaaccaaggguguagagcggcucaaaagaauggcgauaucgggcgacgauugcguggucaagccuauugacgauagguucgccaacgcucuguuggccuuaaacgacauggggaaagugcgcaaggauaucccacaguggcagccgucuaagggauggcacgacuggcaacagguucccuucuguagucaccauuuucacgaacugaucaugaaagacggccgaaagcucguggucccuugccggccacaggaugagcuuauugguagagcaaggauaucccagggggcuggauggagccugaaagaaacugccugucuaggcaaggcauacgcccaaaugugggcgcugauguacuuccaucgcagagaccuccgguuggcuucaaaugccaucugcuccgcagugcccguacacuggguuccuaccucuaggacaacguggagcauucacgcccaucaccaguggaugaccacugaggauaugcugacaguguggaaccgugucuggaucgaggacaauccauggauggaagauaaaacccccgugacuacaugggaggacguuccuuaucuuggcaagcgagaagaucaguggugugggagucugauuggacucaccucccgcgcuacgugggcccaaaacaucuuaacagcaauacaacaggugagaagccugaucgguaaugaggaguuuuuggacuacaugccgucuaugaagcgguucaggaaagaagaggaaucagagggcgcuauuugguga

SEQ ID NO: 15654 - RNA, 9873 nt, Artificial Sequence
  derived and/or modified CDS sequence (opt3) from DENV-3__AY858041__SS-prME
accagccugugccucaugaugaugcuucccgcaacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccacacgugggcauggguuuggauaccagagcacagacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaaggucaggcacauaacgggcgguugaucaccgccaacccugugguaacuaagaaggaggaaccagucaauauagaggcugaaagccccuuuggcgagaguaacauuaucaucggaauuggcgauaaagcccugaagaucaauugguacaagaaagggucuuccauuggaaagauguucgaagcaacugcccguggugcucgcagaauggccauacucggcgacaccgcaugggauuuugggagcgugggaggcguucugaacucgcuugguaaaauggugcaccagaucuucgggucugcguauacagcucuguuuuccggcgucucauggauuaugaagaucggaaucggcguguugcucacuuggauugggcugaauaguaaaaacaccagcauguccuucucuugcauaguaaucggaauuaucacguuauaccugggcgccgugguucaggcagacauggguugugucauuaauuggaaggggaaggagcuaaaaugcggaagcggcaucuuugugacaaacgaggugcauaccuggacugaacaauauaaguuccaggccgauucaccgaaaaggcucgcuacagccauagccggugcuugggagaauggcgucugugggauccggaguaccacucgaauggaaaaccugcuuuggaagcagauugccaaugaguugaacuacauccugugggaaaauaacauuaaacucaccguuguggugggagacaucauaggcguacuggagcaggggaagcgcacauuaacgccucaacccauggagcugaaauauuccuggaagaccuggggaaaggcgaaaauugucacugccgaaauccagaauagcucuuuuauuaucgauggcccaaacacaccugagugccccaacgcuucaagagcauggaaugugugggaaguugaggacuacgguuucgggguguuuaccacaaacauauggcuuaaguugagggaaauguauacucagcucugugaccaccggcugaugagugccgcugucaaagaugagcgcgccgugcacgcagacaugggauacuggaucgagagccagaagaauggcuccuggaaacuagaaaaggcgucucugauugagguuaagaccugcacguggccaaaaucgcauacacucuggagcaacggugugcuggaauccgauaugaucauucccaagucacuugccggcccuaucagucaacacaauuacagaccaggguaucauacccagacugcuggaccguggcacuugggcaaacuggaguuagacuucaacuacugcgaggggaccacaguagucauaacugaaaauuguggaaccaggggccccucucuccguacaacgaccgugagcgguaagcugauucacgaguggugcugucgguccugcacucuuccuccacugcgauauaugggggaugacggauguugguacggcauggaaaucagacccaucaacgagaaagaagagaauauggugaagucauuggucagcgccgguucuggcaagguugauaacuuuacaaugggggugcucugccuggcaauucuauucgaggaaguaaugaggggaaaauucggcaagaaacauaugaucgcuggggugcuguuuauguucguccuccugcuuuccggacagauuaccuggcgcgacauggcccggacuuugauaaugaucggcaguaaugcaagcgauagaauggguaugggggugacauaucuggccuuaauugcuaccuuuaagauccaaccuuuccucgcgcugggauuuuuccuuaggaaacugacgucucgcgagaaccuacuccugggcguuggcuuggccauggcaacuacccugcaguuaccagaagacauugagcagauggcuaaugggaucgcccucggacugauggcccuuaagcugauaacacaguuugaaaccuaccaauuguggacugcucucgugucccugacauguucaaacaccaucuucacacuaacugucgcauggcgaaccgccacgcugauucuugcggguaucagucuccugcccgugugccagagcucguccaugcggaagacagauugguugccgaugaccguugcugccaugggcgugccuccacugcccuuauuuauuuucucucucaaagacacucugaagcguagaagcuggccucuuaaugagggggucauggcaguaggacuggugucaaucuuggccaguucccuccugaggaacgauguucccauggcuggcccccuaguggccggugggcugcuuauagccuguuaugucauuaccggaacaucugcggaccucacuguggagaaagcugccgacguaaccugggaagaggaagcagagcagacgggcgugagccacaaccugaugaucacagucgaugacgauggcaccaugcgcaucaaggacgaugaaacugagaauauuuugacaguuuuacugaaaaccgcccuccugauaguguccgggaucuuuccuuacucaauucccgcuacucuucugguguggcauacauggcagaagcaaacccagcggagcggagucuugugggacgugccaaguccgccugagacgcagaaagccgaacuagaggaagguguuuacagaaucaagcagcaaggcauuuucgggaagacucagguaggagugggcguccagaaagaggguguguuucacaccauguggcauguuacaagaggggcagugcugaccuauaacggaaagcgacucgagcccaauugggcuucugucaaaaaggaucugaucuccuacggcggcggguggcgccuuagcgcccaauggaaaaagggagaagaggugcagguaauagcggucgaaccagguaagaaccccaaaaauuuccagacaaugccuggcaucuuccagacuaccacgggggagauuggagccaucgcauuagacuuuaagccaggcacaucggguucacccauuaucaaccgggaagggaaagugguuggacuguauggcaauggcguggucacuaagaacgggggauacgugucugguauagcucaaaccaaugccgagccugauggcccgacaccagagcucgaagaggaaauguucaaaaagagaaacuugaccauuauggaccugcaccccgggaguggaaagacuaggaaauaucucccugcuaucguucgugaggcaaucaagcgccggcugagaacccuuauucuggccccaacaaggguggucgccgcugaaauggaggaggcguugaaaggccuacccauccgauaccagacgacugcaaccaaguccgaacacacagguaaagagauaguggaucugaugugccaugccaccuuuacuaugcggcucuuaagcccuguacgcgugccgaauuauaaccugauuaucauggacgaagcucacuucacagaucccgccucuauugcagccagaggguacaucagcaccaggguuggaaugggcgaggcugcggccauauuuaugacggcaacuccaccuggcacagcugacgccuucccccaguccaaugcaccaauucaggacgaggaacgggauaucccugagcgaucauggaacagugggaaugacuggaucaccgauuuugccggaaagaccgucugguucgugcccagcauuaaggcugguaacgacaucgccaacugucuuaggaaaaauggcaagaaagugauucaacugucucgcaagacuuuugauacagaauaccagaaaaccaagcucaacgacugggauuucgucguaacaacugacauauccgagaugggggcgaauuuuaaggcagauagggugaucgacccacgucggugcuugaaaccgguuauucugacggauggaccugaaagagugauccucgccggccccaugccagucaccguggcuucagccgcucagaggcgcggucgaguugggagaaacccccagaaggagaaugaccaauauaucuucacaggccagccucugaacaaugacgaggaucaugcacacuggacugaagccaaaaugcuucuagacaacauuaauaccccagagggaauaauccccgcucuguucgaaccugagcgggaaaagagugccgcaauugauggcgaguacagguugaaaggggagagccgcaagacauuuguggaauuaaugcguagaggagaccugccggucuggcucgcgcauaaaguggccuccgaggguaucaaguauaccgaucggaaguggugcuucgacggcgaaaggaacaaucagauucuggaggaaaacauggauguagagaucuggacuaaagagggggaaaagaagaaacuucgcccacgauggcuggacgcuagaacguacucugauccccucgccuugaaagaguuuaaagacuucgcagcuggacggaagucgauagcccuggaucuagugaccgaaaucggcaggguuccuagccaccuggcacaccgcacaagaaaugcccucgacaaccuugucaugcugcauacuucagagcacggugggagggcuuaucggcaugcgguggaagaguuacccgagaccauggaaacauugcugcuccugggccuuaugauucugcucaccggaggcgccauguuguuucugaucuccgggaaaggaguggguaagacaaguauuggcuuaaucugugucguugcaucuagcgggaugcuauggauggcugauauaccacugcaguggauugccuccgccaucgugcucgaguucuuuaugaugguacuucugauuccugaacccgagaaacaacguacaccacaggacaaucaguuggcauacguggucaucggaauacugacgcucgcugccaucguggcggcuaacgagaugggccugcuugaaaccacuaagcgcgaccucgguaugucaaaagagccugggguugugucuagcacaaguuaucuggaugucgacuugcacccggccuccgcauggacccuguacgccguagcuaccacagugauuacucccauguuacgacacacgaucgaaaauagcaccgcaaacguuucucuagccgcgauugcuaaccaagccgugguccugaugggccucgauaagggauggccaaucucaaagauggaccuuggcgugccucuguuggcacuggggugcuacucccaggucaauccccucacacugacugccgcugugcuuuuacugguuacccauuaugccauaauuggaccaggccuccaggcaaaagcuacaagagaggcccagaagaggaccgcggccgguaucaugaaaaacccuacuguggaugggaucaugacgauugacuuggaucccguaaucuacgacaguaaguucgaaaaacaacugggacaggugaugcuacugguccucugugcaguucagcuucuguugaugcggacaagcugggcuuuuugcgaggcccugacccucgcaacuggcccgauaaccacacugugggaggguucgccaggcaaguucuggaauacuaccauugcugugucuauggccaacaucuuucgcggguccuauuuagccggagcgggccuugcuuucagcauuaugaagucagucgggacaggaaaaagaggcacggguagucagggggaaacccugggagagaaguggaaaaagaaacucaaucaacuaucuaggaaggaauuugaucuguacaaaaaguccggcaucacugagguggaccggacagaagcaaaggaggguuugaaacgaggcgagauaacccaccaugccguaagcagagggucagcuaagcugcagugguucguggaacgcaacaugguuaucccugagggaagggugauugaucucggcugugggcggggaggcuggaguuauuacugcgccggucuuaaaaaggucacugaagugcguggguauacaaaaggaggccccggccacgaggaaccaguccccaugagcaccuacggguggaauaucgugaagcugauguccggaaaggacguuuucuacuugccuccggagaaaugugauacgcugcucugcgacauuggugagucuagccccuccccaaccguagaagagucaagaacaaucaggguguuaaagauggucgaaccuuggcugaaaaacaaucaguuuuguauuaaggugcuuaaccccuauaugccuacuguuaucgagcaucuggagcgccuacagcggaaacacggcgggaugcucgugcgaaauccacugucuagaaacaguacccacgaaauguacuggauaucgaauggaacaggcaacauugucagcuccgugaauaugguaucuagguugcugcucaaccgcuucacuaugaccuaucggagacccacaaucgagaaggacguggaucuuggugcagggacccgucauguuaacgccgaaccugagacuccaaauauggacgucaucggagaaaggauucggcgcauaaaggaggagcacucaagcacguggcauuacgaugacgaaaaccccuauaaaacaugggcuuaccacggcuccuaugaggugaaggcgaccggcagugccucuagcaugaucaaugggguggucaaacuguuaacuaagccgugggauguugugccuaccguaacacaaauggcaaugacggacaccacuccauuuggacagcagcgaguguucaaagaaaaggucgauacaagaacccccaagccuaugccagguacuaggaaagugauggagauuacagcugaauggcuguggcggaccuugggccgcaacaagagacccaggcucugcacacgagaggaguuuacuaaaaagguucggaccaaugccgcaaugggggccguguucacggaagagaaccaaugggacucagcucgugccgcggucgaagaugaggaauuuuggaaacugguggacagagagcgcgagcuacacaagcagggaaaauguggcuccugcguauacaauaugauggguaagagggaaaagaaacuuggggaguucggaaaggcaaaaggcagucgggccaucugguacauguggcugggcgcuagauaucucgaauuugaggcccugggguucuugaacgaggaucauugguuuagccgcgaaaauucuuacuccggaguugagggugaaggccugcacaagcucggguauauucuuagggacaucucaaaaauaccgggaggcgcaauguacgcugacgauaccgccgguugggacacacgaaucacugaggaugaccugcauaacgaagagaagauuacccagcagauggauccugagcaccggcaauuagcuaaugccaucuucaagcugacauaucagaacaaaguggucaaggugcagagacccacuccaaaagggaccgugauggacauuaucagcaggaaggaucagcgcggaucgggccaagucggcacguacggguugaauacauuuaccaacauggaagcacagcucauacgucagauggagggagaagguguucugucuaaaacugaccuagagaauccucaucuucuggaaaagaagauuacacaguggcucgagaccaaaggcguggagcggcugaagagaauggcgaucaguggggaugacugcguagugaaacccaucgaugacagguucgccaacgcuuuguuagcccugaacgauaugggaaagguccgcaaagacauuccacaauggcagcccuccaagggcuggcacgacuggcaacaggugccuuucuguagccaccauuuucacgaacucauaaugaaggauggucgaaaacuuguugugccaugccggccgcaagacgagcugaucgggagagcaaggauuucacagggagcuggcuggucccuaaaggaaacugccugucugggcaaagcauaugcccagaugugggcgcucauguacuuccaucgcagagauuugcggcuggcuucuaaugccaucugcagcgcaguccccgugcacuggguaccuaccaguaggacaacgugguccauucacgcccaucaccaauggaugaccacugaggacaugcuuacaguuuggaaccguguguggaucgaagauaauccauggauggaggacaagacccccgucacuacaugggaggaugugccuuaccuggggaaacgagaagaccagugguguggaagccucauagguuuaaccucucgcgcuacgugggcccagaacauccugacagcaauucagcaaguuagaucauugaucggcaaugaggaauuucuggauuauaugccaaguaugaagcgguucaggaaggaggaggaauccgagggggcuauuugguga

SEQ ID NO: 15655 - RNA, 9873 nt, Artificial Sequence
  derived and/or modified CDS sequence (opt3) from DENV-3__KC261634__SS-prME
accagcaucugccugaugaugaugcuccccgccacacuugcuuuccaccugacuuccagagacggcgagccuaggaugauuguggggaagaacgaacggggaaaaucuuuguuauuuaagacggcaucagguauaaauauguguacccugaucgccauggaucuaggcgagaugugcgacgauacagucacuuacaaauguccacucauugcggaaguugagccggaagacaucgauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauucaccauucucgcccuguuucuggcucacuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcauggcgggugcgugacgacuauggcgaagaauaggcccacacuagacauugagcuccagaaaaccgaagcaacucaacuggccacacuucggaagcuguguaucgagggaaaaauuaccaacaucacgaccgauagccgcugcccuacacagggcgaagcugucuugccagaggaacaggaccagaauuauguuuguaagcacacuuacguggaucgagguugggggaacggaugcggccucuucggcaaagggagucugguaaccugcgccaaguuucaauguuuagagcccauagagggaaaggugguccaguaugaaaaucugaaauacacagugauuaucacuguucacaccggugaccagcaucaggugggcaacgacacacaaggggucaccguggagauuacuccucaggcauccacgguagaagcuguucucccagaguauggaacacuuggccuggaaugcucuccgagaaccgguuuggauuucaaugagaugauccuacugacuaugaagaacaaagccuggauggugcacaggcagugguuuuucgaccucccccugccuuggaccagcggggcgacaaccgagacuccaacauggaaucggaaggaacuucuggucacguuuaaaaacgcccaugcaaagaaacaagagguggucguguugggcucccaggaaggagcuaugcacaccgcccucacuggcgcuacagagauccagaauucagggggaaccaguauuuucgccggucaccugaagugucguuuaaagauggauaaacuggaacuaaagggcaugagcuacgcaaugugccucaacacauuuguucugaaaaaggaggugucugagacucagcaugggaccauacuuauccgcguagaauacaaaggagaggacgcccccuguaagauuccuuucuccacggaagauggccaagguaaggcucacaacgggagauugaucaccgcgaauccagucgugacaaaaaaggaggagcccguuaacauagaagcagagccgccuuucggcgaaucaaauauugugaucggaacuggcgacaaagcccugaagaucaacugguauaaaaaggggagcaguauuggaaagauguuugaggcuaccgccaggggugcacggcgaauggccauccucggcgauacagcuugggacuucgggucugucggaggcgugcugaauucccuugguaaaauggcccaucagauuuuugggagcgcauacacugcgcuguucucgggcguaucuuggauaaugaagaucggaauuggcguguugcucaccuggaucgggcugaacuccaaaaauacgucaaugaguuuuagcugcaucguuauuggaauaaucacauuauaucugggcgcugucgugcaggccgauauggguugugugauuaacuggaaggggaaagaacuaaagugcggauccggcaucuucgucaccaaugagguucacacuuggacagagcaguacaaguuucaagcagacucucccaaacgccucgccaccgcuauugccggugcaugggaaaacggcgugugugggaucagaagcacuaccaggauggagaaucugcuuuggaagcagauagcuaacgaauugaauuauauccugugggagaacaauauuaaacucacagugguagucggagauaucauuggcgugcuggaacaggggaagcggacguuaaccccacagccuauggagcugaaauacucauggaagacuuggggaaaagccaagaucguuacagcggagauacaaaacaguuccuucauuaucgacggccccaacaccccagaaugccccagcgccucucgcgcuuggaaugugugggaggucgaagacuaugguuuugggguguucacaacuaacauuuggcuuaaguugagagagguuuacacccagucaugugaucauaggcucaugagugcagccaucaaagacgaacgugcugugcacgccgauaugggauacuggauagagagccagaagaauggcuccuggaaacuggagaaggcaucuuuuaucgaaguaaaaacgugcacauggccuaagucgcacacccuauggagcaacgguguccuggaguccgacaugauuaucccaaagucacucgcgggcccgauuagucagcauaaucaccggcccggguaucauacucaaaccgccggaccuuggcaccugggcaaacuugaauuggauuucaacuacugcgaggggacaacuguggugaucaccgagaauuguggaacacgaggcccaucucugagaacgaccacugucagcgguaaguuaauacacgaauggugcuguagguccugcacacuccccccucugcgcuauaugggggaggacggauguugguacggcauggaaauucggccaaucaacgagaaagaagagaauaugguuaagucacuugugagcgcugguucuggcaaaguagauaacuuuaccaugggggugcugugcuuggccauccucuucgaggaagucaugagaggaaaguucggcaagaaacauaugauuguggggguucuguuuacuuucgugcuacugcucuccggacagaucacauggagggacaugacccacacgcugauuaugauaggcaguaaugcaagcgaucgcauggguaugggggucacuuaucuugcuuugaucgccaccuuuaagauucagcccuuccuggcauuaggauuuuuccuccgaaaacugacaucucgggagaaccuucugcuaggcgugggccucgccauggcuaccacucugcaauugccggaagacaucgagcagauggcgaaugggauugcccugggauuaaugacacucaagcugaucacccaguuugaaacauaccagcuuuggacugcacugguuuccuugaccuguucaaacacgauauucacacucaccguggcuuggcguacugccacccugauccuagccggugucagucugcuuccucucugccaaagcucguccaugagaaaaacagauuggcugccaaugacuguagcugcaaugggcgugcccccuuugccccuguuuauuuucucuuuaaaggacgccccaaagaaaaggagcuggccucucaaugaggggguuauggcggugggacuggucucaauccuugcuaguucccuguugcgcaacgaugugcccauggccggcccacucguagcaggugggcugcuaauugccuguuaugugaucaccggaacgucugcugaccugacagucgagaaggcagccgacguuaccugggaagaggaagcggagcagacuggcgugagccauaaccuuaugauaacaguggaugacgauggcaccaugcggauuaaagacgaugaaacugagaauauccucacaguccuguugaagaccgcuuuacugaucguguccgggauuuuuccguacucaauaccugccacgcuccugguuuggcacacuuggcagaaacagacccaaagaagcggaguacuuugggacgugcccaguccacccgagacacagaaggcagaacuggaggaaggugucuacaggaucaaacagcagggcauuuucgggaagacccaagugggaguuggcgugcagaaggagggugucuuucauacaauguggcacgugacucgaggggccguauugacccacaacggaaaacgccuagagccuaauugggcuucugucaagaaagaucugaucuccuauggcggcggguggcggcucagcgcccaguggcaaaagggagaagaggugcagguuauugcaguggaaccagguaaaaaccccaagaauuuccagacgaugccuggcaucuuccagacaacuaccggggagauaggagcuaucgcccuggacuuuaagccgggcacaucggguucaccaauuaucaacagagaagggaaagucgugggacuuuacggcaauggcguugugaccaagaacgggggauaugucucugguauugcgcaaacuaaugccgagcccgauggcccuaccccagaguuagaagaggaaauguucaaaaagaggaaccugacaaucauggaccuccaucccgggaguggaaaaacgcguaaguacuugccugcaauagugcgcgaggcuauuaagcggagacugaggacucucauccuggccccgacccgaguaguggcugcagaaauggaggaggcccuuaaaggccugcccauccgguaucagacaaccgccacuaaguccgaacacacaggucgcgagauuguugauuugaugugccaugcuaccuuuacgaugagacuacugagcccagucagggugccuaauuacaaccucaucauaauggacgaagcgcacuucacugaucccgcaucuauugccgcucggggguauaucagcacacgagugggaaugggcgaggccgcagccauuuuuaugaccgcuaccccaccuggcacugcggaagccuucccccaguccaaugcaccaauccaggacgaggagagagacauaccggaacgcucauggaacagugggaaugaguggauuacagauuuugucggaaaaaccguaugguucgugccuagcaucaaggcugguaacgacaucgccaacuguuuaaggaaaaauggcaagaagguuauucaacugucucguaaaacauuugauacugaauaccagaagacgcggcuuaacgacugggauuucguggucaccacagacaucuccgagaugggggcaaauuuuaaagccgauagagugauugaccccaggcgcugccugaagccaguuauacucacugauggacccgagcgagugaucuuggcuggcccuaugccagucaccgccgcgucagcagcccagagacgggguaggguggggcgcaacccccagaaagaaaaugaccaauacauuuucacaggccagccucugaacaaugaugaggaccaugcucacuggaccgaagccaagaugcuccuggacaacaucaauacuccggagggaaucauuccagcucuuuucgaacccgagcgugagaagagugcagccauagauggcgaauauagacuaaaaggggagagccggaagacguuuguagaacugaugaggcgcggagacuugccugugugguuagcucacaaaguugccuccgaggguaucaaguacaccgaucgaaaauggugcuucgacggcgaaagaaacaaucagauucuggaggagaacauggaugucgaaaucuggacaaaggagggggaacggaaaaagcucaggccccgcuggcuggacgcaagaacuuauucugauccacuugcgcugaaggaguuuaaagacuucgccgcuggaaggaagucgauugcccucgauuuggugaccgaaaucggccgggugccuagccaucuggcacaccguacacgcaaugcucuagacaaccuggucaugcuccauaccucagagcacggugggcgagccuacagacacgcaguugaggaacuucccgagacuauggaaacacuguuauugcugggccucaugauacugcuuacgggaggcgccaugcuguuucucaucuccgggaaaggaauugguaagaccaguaucggcuugauuugugugaucguaucuagcgggaugcuguggauggcugaugugccauuacaguggauagcguccgccauuguccuagaguucuuuaugauggugcugcucaucccugagccggaaaaacaaaggacuccccaggacaaucagcuugcauauguugugauuggaauccugacauuggcugccauagucgccgcaaacgagaugggccugcucgaaaccaccaagcgggaucuggguaugucaaaggagccaggggcuguaucuagcacaaguuaccuugacguggaccuccauccugccuccgcguggacucuguaugcuguugccacgaccgugaucacacccauguugcgccacacuauugaaaauagcaccgcaaacgucucucuggccgcuaucgcaaaccaagccguggucuuaaugggccuagauaaaggauggccaauuucaaagauggaccugggcgugccucuccuugcgcuggggugcuacucccagguuaaucccuugacacugaccgcugccgugcuccugcuuguaacucauuacgcaaucauaggaccgggcuuacaggccaaagcuacgagagaggcccagaagaggacagcagcugguauuaugaaaaacccaaccguggaugggaucaugacuaucgaccuggauccugucauuuaugacaguaaguucgagaagcaacucggacagguuauguugcuggugcuaugugccguccagcugcuccuuaugcggaccagcugggcgcugugcgaagccuugacacuggcaacuggccccaucaccacacucugggaggguucgccaggcaaauuuuggaauacgaccauagcugugucuauggccaacauuuuccgaggguccuaccuggcaggagcuggcuuagccuuuagcaucaugaagucaguagggacuggaagacgcggcacagguagucagggggaaacccuuggagagaaauggaagaaaaggcugaaucaacucucucggaaggaauucgaucuauauaagaaauccggcauuacugagguggaccguacagaggccaaggaaggucugaaaagaggcgagaccacgcaccaugcgguuagcagggggucagcuaaguugcagugguuuguggaacgcaacauggucauccccgagggacgggugauagaucugggcugugggcgaggaggcuggaguuacuauugcgcaggucucaaaaaggucaccgaagugagaggguacacaaaaggaggcccuggccacgaggagccgguucccaugagcacuuauggguggaauaucguaaagcuuauguccggaaaggacguguucuaccugccaccugaaaaaugugauaccuugcugugcgacauuggugagucuagccccuccccuacagucgaagagucaaggacuauccgcgugcucaagaugguugagccaugguuaaaaaacaaucaguucuguauuaaggugcugaaccccuacaugccuaccgucaucgaacaccuugagcggcugcagagaaaauauggcgggaugcuagugcguaauccacucucuaggaacaguacacaugaaauguacuggauuucgaauggaaccggcaacaucguaagcuccgugaauaugguuucucggcuguugcugaaccgcuuuacuaugacgcaccgaagacccacaauggagaaggaugucgaccucggugccgggaccaggcaugugaacgcugaaccggagacuccuaauauggacgugauaggagagcggauuaagcgcaucaaagaagagcacucaagcaccuggcacuaugaugacgaaaacccauacaagacaugggccuaucauggcuccuacgaggucaaagcaacgggcagugccucuagcaugaucaaugggguugugaagcuucugaccaaacccugggauguagugccuauggucacucaaauggcuaugacagacaccacuccauucggacagcagagaguguuuaaggaaaagguugauacaaggaccccccgaccgaugccugguacacggaaagugauggagauuacugcggagugguuauggcguacccugggcagaaacaagaaaccccgcuugugcacgagggaagaguucaccaagaaaguccggacaaaugccgcaaugggggcuguguuuacugaagagaaccaaugggacucagccagagcagccguagaagaugaggaguucuggaagcucguugaccgcgaaagggagcugcaccgacuaggaaaguguggcuccugcguguauaauaugauggguaaacgggaaaagaaacuuggggaguuuggaaaggcuaaaggcaguagagccauaugguacauguggcugggcgcgagguaccucgaguucgaagcacugggguuuuugaacgaggaucauugguucagccgcgaaaauucuuauuccggagucgagggugaaggccugcacaagcucggguacauccuucgugacauuucaaaaaucccaggaggcgccauguaugcugaugacaccgccgguugggacacacggauuacugaggaugaccugcauaacgaggaaaagaucacccagcagauggauccugagcacagaagguuagcaagcgcuauauuuaagcugacguaccagaauaaaguggugaagguccaacgccccacaccaaaagggaccguuauggacaucauuucgcgaaaggaucagcggggaucuggccaggugggcacuuauggguugaacacauucaccaauauggaagcccagcucguaagacaaauggagggagaaggugugcugaguaaagcugaccuagaggauccccaccuucuggagaagaagaucacucaguggcucgaaaccaaaggcgucgagaggcugaagcgcauggccauuuccggggacgauugcgugguuaaaccuaucgacgauagauuugcaaacgcguuguuagcccugaaugacaugggaaaggugcggaaagauauaccacaguggcagccgagcaagggcuggcaugacuggcaacagguccccuucuguucacaccauuuccacgaacucauuaugaaggacgguaggaaacuugugguaccuugccguccacaggaugagcugaucgggcgagcucgcaucucccagggagccggcuggucucuaaaggaaacagcaugucugggcaaagcuuacgcccaaauguggagccucauguauuuucacagacgggacuugaggcuggcaaguaacgccauuugcuccgcgguucccgugcauugggucccuacgagccgcaccacuuggucuauacacgcucaucaccaguggaugacaaccgaggauaugcuuacuguguggaacagaguuuggaucgaggacaauccauggauggaagauaagacacccgugaccacgugggaggacgucccuuaccuggggaaacgggaagaucagugguguggaucacucauugguuuaacaaguagggccaccugggcacaaaacauccugacugccauucagcaggugcgauccuugaucggcgacgaggaguuccuggauuacaugccgagcaugaagcguuuuagaaaggaagaggaaucugagggggcuauaugguga

SEQ ID NO: 15656 - RNA, 9873 nt, Artificial Sequence
  derived and/or modified CDS sequence (opt3) from DENV-3__JN662391__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccaaacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucagaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggaguacaagggagaagaugcucccuguaaaaucccuuucuccacagaggacgagcaaggcaaggcgcauaacggucgucuuauaacugcaaauccaguugugaccaaaaaggaagagcccguaaacauugaagccgagccgccuuucggggaaucaaauaucgucaucggcauuggagauaacgcuuugaaaaucaauugguauaagaagggcagcaguauugggaaaauguuugaggccacagcacgcggagccagaaggauggcuauacugggugacacugccugggauuucggcucuguggggggaguucucaacucccugggcaagauggugcaccagaucuuugguagcgcauacaccgcgcuuuucucgggggucucuugggugaugaaaauuggcaucggaguacuguugacguggaucggccucaauuccaagaacacaucaaugaguuuuagcugcauugcuauagggaucauuacccuguauuuaggagccgugguucaggcagacaugggcugugucaucaauuggaaagguaaggagcugaagugcggguccggaauuuucgugacuaacgaagugcauacauggaccgagcaguacaaauuucaagccgauucucccaagcggcuagcuacugccaucgcaggcgcuugggaaaauggugucuguggcauacgaagcaccacacgcauggagaaccuccuguggaaacagaucgccaaugaacuuaacuauauuuugugggagaauaacaucaagcugacgguuguggugggggacaccauuggaguacucgagcagggcaaaagaacucugacaccacagccuauggaauuaaaguacucauggaaaaccugggggaaggcgaagaucgucacagccgagacucaaaacaguuccuucauaauugauggacccaauaccccagaaugccccagcgcuucuagggcauggaacgugugggagguugaagacuauggcuuugguguguucacgacaaauaucuggcugaaacuucgggaggucuacacccagaugugugaccaccgcuugaugucagccgcugugaaggaugagagagccguucacgcagacaugggguacuggauugaaagucagaaaaacggaagcuggaagcucgagaaagcgucccugaucgaagugaagacuugcaccuggccuaagucucauacacuauggucgaauggcguacuggagagcgauaugauaaucccaaaaucccucgccgguccgauuucacagcacaacuauaggcccggcuaccauacucaaaccgcugggccuuggcaccugggaaagcuugaguuggacuuuaauuauugcgaaggcacaacggucgugaucaccgagaacugugggacucguggaccaagucugcggacaaccacugugucuggcaaauuaauucacgaauggugcugucgaagcugcacacuccccccucugagauacaugggugaggauggguguugguauggaauggaaaucaggccaauauccgagaaggaggaaaauauggucaaaucacuuguuagcgccggcucugguaagguggacaacuucaccaugggcguacugugcuuggcaauucucuuugaggaagugaugcgcgggaaguucggaaaaaagcauaugaucgcuggcgucuuccugacguuuaugcuacugcucuccgggcagaucacuuggcgggauauggcccacacccugauuaugaucggaaguaaugcaagcgacagaaugggcaugggugugacauaccuugccuugauugcuaccuucaaaauacagcccuuucuggcguuaggguucuuucucaggaagcugacuucucgcgagaaccuucugcuaggaguuggccucgccauggcaacaaccauccaacugccggaagauauugagcagauggcuaauggcaucgccuuggggcugauggccuuaaaacucauuacacaguucgagacuuaucagcuguggaccgcucuuaucucccugacguguucaaacacaauauuuaccuugacuguggcauggcgaaccgccacacucauccuggcgggagucagucuacugccugugugccaaagcucguccaugcggaagacugacuggcuuccaaugaccguugcugccaugggugugcccccucucccccuguucauuuuuucuuugaaggauacgcugaaacguagaagcuggccauuaaaugaaggcgucauggcaguagggcucgugucaauccuggccaguucccuucugaggaacgacguuccuauggcuggacccuugguggcaggcggucuccugauugccuguuacgucaucacagggaccucugcggaucuaacuguggagaaggcugccgacguaacaugggaagaggaagcagagcagaccggagugagccauaaccugaugauaacugucgacgaugacggcacaaugcgcauuaaagaugacgagaccgaaaauauccuuacgguucuccugaagacugccuuguuaaucguguccggcauuuucccauacucaauaccggcuacccugcucguguggcacacauggcagaaacagacccaacggagcgggguccugugggaugugccuagucccccagagacacagaaggccgaacuugaggagggaguuuauagaaucaaacagcaggguauucugggcaagacucaaguaggggugggaguccagaaggaaggcguguuucauaccauguggcacguuacgaggggugcaguguugacacacaacgggaaacgacuagagcccaauugggcuucugucaagaaagaccugaucuccuacggaggcggcuggcgccucagcgcccaguggcaaaagggggaagaggugcagguaauugcggucgaaccuggaaaaaacccaaagaauuuccagacuaugcccgguaccuuucagacaaccacuggcgagaucggggccauagcacuggauuucaagccuggaaccucgggcucaccgaucauuaaccgggaggguaaagugguugggcuuuauggaaauggcguggucacaaagaacggcggguacgugucuggaaucgcucaaacgaaugccgaaccagacggucccacuccugaguuagaagaggaaauguucaaaaagagaaaccugaccauuauggaucuccauccaggcagugggaaaacaaggaaguauuugcccgcuaucguucgugaggcaauaaagcgccggcugagaacccucauucuggccccuacuaggguggucgccgcugagauggaagaggcgcuuaaaggacugccgauccgauaccagacaaccgcaacgaaguccgaacacacuggccgggagaucguggacuugaugugccaugccacauuuaccaugcgccuacugagccccguaagagugccaaauuauaaccucauuaucauggaugaagcucacuucaccgacccugccucuauagcagccagggguuacauuagcacucggguugggaugggagaggcugcggccaucuuuaugacagcaacccccccaggcacagcugaugccuucccucaguccaaugcacccauucaggacgaggaacgagacaucccagagagaucauggaacaguggcaaugaauggauaacugauuuugccgggaaaacggucugguucgugccgagcauuaaggcuggaaacgacaucgccaacuguuuacgcaaaaaugguaagaaggugauccaacugucuaggaaaaccuuugauacagaguaccagaagacuaaacuuaacgacugggauuucgucguaaccacagacauuuccgagaugggcgcgaauuuuaaggcagaucgugugaucgacccucggagaugccugaaacccguuauucucaccgaugggccagaaagggugauauuggccggacccaugccugucacuguggcuucagccgcucagcgccgaggcagaguuggucggaacccacagaaggagaaugaccaauauaucuucacggggcagccccugaacaaugaugaagaccaugcacacuggaccgaggccaagaugcuccuggacaacauuaauacaccugaaggcaucaucccggcucuuuuugagccagagagggaaaaaagugccgcaauugauggagaguaccgccuaaagggcgaaagccguaaaacuuucguggagcugaugagacggggggacuugcccgucugguuagcgcacaagguggccuccgaaggaauaaaauauaccgauaggaaguggugcuucgacggucagcgcaacaaucagauccuggaggagaacauggauguagaaauuuggacaaaagagggcgaaaagaagaaacuccgaccuagauggcuggacgcucggaccuacucugauccccuugcccugaaggaguuuaaagacuucgcagcugggaggaagucgaucgcccucgauuuggugacugaaauuggacgcguuccaagccaucuggcacacagaacaaggaaugcccuagacaaccuggucaugcuccauacgucagagcacggcggucgggcuuaucgucacgcgguggaggaacuuccugagaccauggaaacucuguuauugcuggggcucaugauccugcuuacaggcggagccaugcuguuucucauauccggcaaagggaucggaaagaccaguauugguuugaucugugugauugcaucuagcggcaugcuguggauggcugagauccccuuacaauggauagccuccgccauuguccuagaguucuuuaugaugguucugcucaucccagaaccugagaagcagcgcaccccgcaggauaaucaacuugcauacgugguaauugggauccugacauuggcugccauaaucgcggcuaacgaaaugggacugcucgagacuacgaaacgagaccugggcaugucaaaggaacccgguguggucucuccaaccagcuaucuugauguggaccuccauccugccagugcauggacacuguacgccguugcuacuaccgugauuacacccauguugagacacaccaucgagaauuccacugcaaacgucagccuggccgcgauugcuaaccaggccguaguguuaauggggcuagacaaaggcuggccaaucucuaagauggaucugggaguuccucuccuugcacugggcugcuacucacaggugaaucccuugacgcugacagccgcuguccuccugcuugugacccauuaugccauaauugggccgggauuacaggcaaaagcuacuagggaggcccaaaagcggaccgcggccggcaucaugaagaacccaacagucgacgguaucauuacuaucgaucuggacccugugauauacgauuccaaauucgaaaagcagcucgggcagguuauguugcuggugcuaugugcaguacagcugcuccuuaugcgcaccaguugggcucugugcgaggccuugacacuggcaacgggacccauuaccacucucugggaaggcagcccagguaaauuuuggaauacaaccaucgcugugucgauggccaacauuuucagaggcucuuaucuggccggggcgggauuagcuuuuuccaucaugaagagcgucggcacugggaaaaggggaacaggcucacaaggugagacccuuggggaaaaguggaagaaaaagcugaaucagcucagucggaaagaguucgaccuauacaagaaaucuggaauaacggagguugaucgaaccgaagcaaaggagggccugaaaagaggugaaacaacucaccaugccgugucccgcggcagcgcuaaguugcagugguuugucgagaggaacauggugauccccgaagggcggguaauugaccugggauguggccgugggggauggucauauuacugcgccggccucaagaaagugaccgagguuagagguuauacaaaggggggaccuggccacgaggaaccggugcccaugaguacucacggcuggaauaucgucaaacuuaugagcgggaaggauguguucuaccugccaccugagaaaugugacaccuugcugugcgauauuggagaauccucucccagcccuacagucgaggaguccaggaccauccgcgugcucaagaugguugaaccaugguuaaagaacaaucaguuuuguauuaaaguacugaaccccuacaugccugcagugaucgagcaucuugaacggcugcaacgaaagcacgguggcaugcuagucagaaauccacucucaaggaacucuacucaugagauguauuggauaaguaaugggacgggaaacauugugucgagcguuaauauggugucccgccuguugcugaaccgguucacaaugacccacagacgucccacuaucgaaaaagacgucgaucucggcgccgguaccaggcacgugaacgcugagccggagacaccuaauauggacguaaucggggaacggauucgccgaauaaaggaggaacauaacucuacguggcacuacgacgaugagaauccauauaaaaccugggcguaccauggaucauaugaagugaaggccacuggcagcgcauccaguaugaucaacggcguugucaagcuucugacaaaacccugggacguggugccuauggucacccagauggcuaugacugauacaaccccauucgggcagcaaagaguuuuuaaggagaaaguggacacaaggacuccccggccgaugccuggaacccgcaagguaauggagauuacggccgaaugguuauggagaacccuggguaggaauaaacgaccccgguugugcacacgugaggaauucacuaagaaggugagaaccaacgcagccaugggcgcugucuuuacagaggaaaaucagugggauucugccaaagcggcaguggaggacgaggaauucuggaagcucguugaucgcgagagggaacugcacaaacuagggaaguguggaagcugcguguacaacaugaugggcaaacgggagaagaaacuuggugaguuugggaaggccaagggaucaagagcuaucugguauauguggcugggcgcccgcuaccucgaauucgaggcacugggcuuuuugaaugaagaccauugguucuccagggagaacaguuacagcggggucgaaggagagggucugcacaaacucggcuauauucuucgagauaucucuaagauaccagggggagcuauguacgccgacgauacugcuggcugggacacccggaucacggaggacgaucugcacaaugaagagaaaauuacacagcagaugaacccugaacauagauuacuggccaaugcaaucuuuaaguugaccuaucaaaacaaagugguaaagguucagaggcccacuccaacagguaccgugauggacauuaucucccgcaaggaucagcgugggucaggacaggucggcacuuacggccucaauaccuucacaaacauggaggcgcaacuggugcggcagauggaaggggagggagugcuaagcaaagccgaccuugagaacccccaccugccugaaaagaaaauaacgcaguggcucgagaccaagggugucgaaagacugaaaaggauggcuauuucgggcgaugacugcguugugaagccaaucgaugaccgcuuugccaaugcauuguuagcucugaacgauauggggaagguacgaaaagacaucccgcaguggcaacccucuaagggauggcaugauuggcagcaggugccuuucuguagucaccacuuucaugagcucauuaugaaagacggccggaagcuugucgugccaugcagaccccaggaugaacugauagguagggcccgcaucucccaaggggcaggauggagccuaagagagacugccugucugggcaaagcguaugcucagauguggucacucauguacuuccaccggagggacuugcgucuggccuccaaugcaauuugcucugccguuccugugcauugggucccaacaagccgaaccacuuggaguauccacgcucaucaccaguggaugacaaccgaggacaugcuuacgguguggaaccgcguauggauugaagauaaucccuggauggaggacaagacaccuguuaccacuugggaaaacgugccguaucugggcaagagagaggaucaauggugugggucccucaucggauuaaccagccgggccacaugggcacagaauauaucuacugcuauccagcaggucaggucacugauugguaacgaggaauucuuggacuacaugccaaguaugaaacgcuuuagaaaggaggaagaguccgaaggcgccaucugguga

SEQ ID NO: 15657 - RNA, 9873 nt, Artificial Sequence
  derived and/or modified CDS sequence (opt3) from DENV-3__AY858043__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggcagaaaaagucgagacuugggcccuccggcauccuggauucaccauccuggcucuguuucucgcccacuacauuggcacaucuuuaacucagaaggugguuaucuucauacugcuuauguuggugaccccaucgaugacaaugcgcugugucggcguggggaacagagacuuuguagaaggacugucaggugcgaccuggguugaugugguccuagagcauggcgggugcgugacgacuauggcaaagaauaaacccacacucgacaucgagcugcagaagaccgaagccacucaacuugcuacacugaggaaauuguguauugagggaaagaucaccaacgugacgaccgauagccggugcccuacacagggcgaagccauucucccagaggaacaggaccagaauuaugucugucgccacacuuacguugaucgagguugggggaacggaugcggccuguucggcaaagggaguuuagugaccugcgcaaaguuucaaugucuggagcucaucgagggaaagguagugcagcacgaaaaucuuaaauauacagucauaauuacugugcauaccggugaccagcaccagguuggcaacgagacacaaggggugaccgcugaaaucacuccccaggccuccacggucgaggcgauucugccugaauacggaacauugggccuagagugcucuccaagaaccggucuggacuucaaugagaugauccuccugacuaugaagaacaaagccuggauggugcauaggcagugguuuuucgaucuuccgcugcccuggaccagcggggcaacaaccgaaacuccuacauggaauaagaaagaguugcucguaacguuuaagaacgcucacgccaaaaagcaagaaguugugguccugggcucccaggagggagcuaugcacaccgccuuaacuggcgcaacagaaauccagaccucagggggaacaaguauuuucgccggucaucugaagugucggcuaaaaauggacaagcucgagcugaaaggcaugagcuaugcuaugugcucuaaugcguuugugcuuaagaaagaggucuccgaaacucagcacgggaccauauugaucaagguggaguacaagggagaagaugcaccauguaaaauucccuucucaacggaggacggccaagguaagguucauaacgggcgucugaucaccgccaacccugugguaacaaaaaaggaggaaccagucaauauagaggcugaacccccguucggcgagagcaacauuaucaucggaauuggcgauaaagcccucaagaucaauugguacaagaaagggaguucuauuggaaagauguuugaagcaacugcccgcggugcuagaaggauggccauacugggcgacaccgcaugggauuucggguccgugggaggcguucuuaacagccuggguaaaauggugcaccagaucuuugggucggcguauacagcuuuguucucuggcgucuccuggauuaugaagaucggaaucggcgugcuccugacuuggauuggguuaaauucaaaaaacaccaguaugagcuuuuccugcauaguaaucggaauuaucacgcuguaccuaggcgccgugguucaggcagacauggguugugucauuaauuggaaggggaaggagcucaaaugcggaucuggcaucuucgugacaaacgaggugcauaccuggacugaacaguauaaguuucaagccgauagcccuaaacggcuggcuacagccauagcaggugcuugggagaauggcgucugugggauccgaucaaccacucgcauggaaaaccuuuuguggaagcagauugccaaugagcugaacuacauccucugggaaaauaacauuaaacugaccguuguggugggagacaucauaggcguauuagagcaggggaagagaacacugacgccccagccaauggagcuuaaauauaguuggaagaccuggggaaaggcgaaagucgugacugccgaaauucaaaauuccagcuucaucauugauggcccuaacacacccgagugcccaaacgcuucuagggcauggaauguuugggaaguggaggacuacgguuuuggggucuucaccacaaacaucugguugaagcuccgggaaauguauacucagcugugugaccaccgccuaaugucagccgcugugaaagaugagagagccguucacgcagacaugggauacuggauagagagucagaagaauggcagcuggaaacuggaaaaggcgucccucaucgaggugaagaccugcacguggcccaaaucucauacacuguggucgaacgguguacuugaaagcgauaugauuaucccuaaguccuuggccggcccaauuucacagcacaauuacaggccgggguaucauacccaaacugcuggacccuggcaccugggcaaauuagagcucgacuuuaacuacugcgaggggaccacagucgugaucacugaaaauuguggaacccguggcccuagucugcggacaacgaccgugucugguaagcuuauacacgaguggugcugucgaagcugcacucugccacccuugagauauaugggggaagauggauguugguacggcauggagauuaggccuaucaacgaaaaagaggagaauauggucaagucccucguuucagccgguagcggcaagguggacaacuucacaauggggguacugugccuagcaauccuguuugaagaggugaugcgcggaaaauucggcaagaaacauaugauugcugggguccucuucauguuugugcugcuuuugucuggacagaucaccuggcgggauauggccagaacucugauuaugauaggcuccaaugcaagugacaggauggguauggggguuacauauuuagcccucaucgcuaccuucaagauucagccauuucuggcgcuuggauucuuucugcgcaaacuaacgagccgagaaaaccuccuguugggcgugggccuggccauggcaacuaccuuacaacuccccgaggauaucgaacagauggcuaaugggauugcccugggacuuauggcccugaaguugaucacacaguucgagaccuaccagcucuggacugcucuggucucucuaacauguuccaacaccauauuuacacugacuguggcauggcggaccgccacgcuuauccucgcggguauuucacuguugccgguuugccaaaguagcucgaugcguaagacagacuggcugccuaugaccguggcugccaugggcgucccacccuuaccucucuucaucuuuucccugaaagauacucuuaagagaaggucuuggccccugaaugaggggguaauggcagugggauugguuagcauucucgccucaagucugcuacgcaacgacgugccaauggcuggcccucuggucgcaggugggcuucucaucgccuguuaugugauaaccggaacauccgcggaucugacuguagaaaaagcugccgacgugaccugggaggaagaggcagaacagacgggcgucucucacaacuugaugauuacaguugacgaugacggcaccaugcggaucaaggaugacgagacugagaauaucuuaacagugcugcucaaaaccgcccugcuuauugugagcgggauauuccccuacuccaucccagcuacucuguuggucuggcauacauggcagaagcagacccaaagaucaggagugcuaugggauguuccgagcccucccgaaacgcagaaagccgagcuggaagaggguguauacaggauuaagcagcagggcaucuuugggaagacucaagugggagucggcgugcagaaagaggguguuuuccacaccauguggcaugugacacgaggggcaguccucaccuauaacggaaagcgccuggaaccaaauugggcuagugugaaaaaggaccuuauuucuuacggcggcggguggcgguuauccgcccaguggagaaaaggagaggaaguacaagucaucgcgguggagcccgguaagaacccuaagaauuuucagacaaugccaggcauauuccagacuaccacgggggaaaucggagccauugcacuggauuucaaacccggcacaagcgguucgccuaucauuaacagggaggggaagguugugggacucuauggcaauggcgucgugacuaaaaacgggggauacguuucagguaucgcucagaccaaugccgagccggacggcccaacacccgaauuggaggaagagauguuuaagaaacguaaccugaccauaauggaucuccacccugggucuggaaagacucgcaaguaucugccagcuauugugcgggaagcaaucaaaagaaggcuucgaacccugaucuuggcccccacacgggucguggccgcugagauggaggaagcgcuaaagggccugccuauucgcuaccaaacgacugcaaccaaaagugagcacacagguaaggaaaucguagaccucaugugccaugccaccuucacuaugagauuacuguccccggugaggguucccaauuauaaccuuauaauuauggaugaggcucacuuuacagacccagccagcaucgcagcccggggguacauuucuacccgagucggaaugggcgaagcugcggccaucuucaugacggcaacuccucccggcacagcugaugccuuuccacagagcaaugcaccuauacaggacgaggagagagacauucccgaacgcuccuggaacucagggaaugauuggaucaccgacuucgccggaaaaaccgugugguuugugccaaguaucaaggcugguaacgauauugccaacugucugaggaagaauggcaaaaaggucauccagcucagccguaaaacuuucgacacagaguaccaaaagaccaaauugaacgauugggacuuuguagugacaacugauauuucugaaaugggggcgaauuucaaggcagaccggguuauagauccgagaaggugccugaagccugugauccucacggacggacccgagcgcgucauucuggccggcccaaugcccgugaccguugcuuccgccgcucagcgaagaggucggguggggaggaacccucagaaagagaaugaucaguauaucuuuacaggccaaccacuuaacaaugacgaagaccaugcacacuggacugaggccaagaugcuacuggauaacaucaauacccccgaaggaauuauaccugcuuuguucgagccggaacgcgagaaaucagccgcaaucgacggcgaguaccguuuaaagggggaaaguagaaaaacauucgucgagcugaugcggaggggagaucucccaguguggcuggcgcauaagguagccagcgaagguauuaaauauaccgaccgcaaguggugcuuugauggcgagcgaaacaaucagauccuugaagagaacauggacguggagauuuggacuaaggaaggggagaaaaagaaacugagaccccgguggcucgaugcuaggacguacuccgacccuuuggcccugaaggaauucaaagauuuugcagcuggacgcaagucuaucgcccuagaccugguuaccgagauaggcagaguccccucgcaccucgcacacaggacacggaaugcccuugauaaccuggugauguuacauacuagcgaacacggugggcgugcuuaucgccaugcgguggaggaguugccagaaaccauggagacauuccugcuccugggccuuaugauccugcucaccggaggcgccauguuguuucugauuucagggaagggagucgguaaaacuuccaucggcuuaauuuguguuguggcaaguucugggaugcuauggauggcugacaucccucugcaguggauagccagcgccauuguacucgaauucuuuaugauggugcuucugauccccgagccagagaagcagcgaacaccucaagauaaucaguuggcauacgucgugauuggaauccugacgcucgcugccauaguugcggcuaacgaaaugggccugcuugagaccacuaaaagagaccucgguauguccaaggaaccggggguggucucacccacaucuuaucuggacguagauuugcacccagccagcgcauggacccuguacgccguggcuaccacaguuaucacuccuauguuaaggcacacgauugagaauaguaccgcaaacgugucccuagccgcgaucgcuaaccaggccgucgugcugaugggccucgacaaaggauggcccauuagcaagauggaucuuggcgucccacuguuggcacuggggugcuacucucaagugaauccucucacacugacugccgcuguucuuuuacuggugacccauuaugccaucauaggacccggccuccaggcaaaggcuacacgggaagcccagaaacgcaccgcggccgguauuaugaagaacccgacuguagacgggaucaugacgaucgauuuggacccagugauuuacgauucaaaauucgagaagcagcugggacaagucaugcuacugguucucugugcagugcagcuucuguugaugagaacauccugggcuuuuugcgaggcccugacccucgcaacuggcccuaucaccacacugugggaagguagucccggcaaauucuggaauacuaccauagcugucagcauggccaacauuuuuagggggucguauuuagccggagcgggccuugcuuucucuaucaugaaguccguggggacaggaaagcggggcacggguagccagggggagacccugggagaaaaauggaagaaaaagcucaaucagcuaucacgaaaagaguuugaccuguacaagaaaaguggcauuacugaaguagauagaacagaggcaaaggaggguuugaagcgcggcgaaaccacucaccaugccgugucuaggggguccgcuaaacugcaaugguucguugagcggaacauggugaucccagaaggacgugucauagaccucggcugugggagaggaggcuggagcuauuacugcgccggucuuaagaaagugacagaggucaggggguauaccaagggaggccccggccacgaagagccugugccgaugucaacguacggguggaauaucguuaaacugaugaguggaaaggauguauucuacuugcccccagagaagugugacacccugcucugcgauauuggugaaagcuccccuucucccacaguggaggaaagccgcacuauccgggucuuaaaaaugguggagccuuggcugaagaacaaucaguuuuguauuaaaguucuuaacccauauaugcccaccgugaucgagcaucuggaacgacuacagagaaagcacggcgggaugcucgucaggaauccucugucccgcaacucaacacacgagauguacuggauuucuaauggaacuggcaacaucgugaguucgguaaauauggugagccgguugcugcucaacagauucaccaugacauaucguaggccaaccauagaaaaagacguugaccuuggugcagggacucggcaugucaacgccgagcccgaaacgccgaauauggaugugauuggagagcgcauccgaagaaucaaggaggaacacuccucuacauggcauuacgacgaugagaacccuuauaagaccugggcuuaccacggcucauaugaagugaaagcgacuggcagcgccuccaguaugauuaauggggucguuaagcuguuaaccaaaccaugggacgugguacccacagugacgcagauggcaaugaccgauacuacaccuuuuggacaacagagggucuucaaggagaaaguggacacccggacuccaaagcccaugccggguacacgcaagguuauggaaauaaccgcugaguggcuguggagaacauugggcaggaacaaacgaccucggcucugcacucgugaggaauuuaccaagaaagugagaacgaaugccgcaaugggggccgucuucaccgaggaaaaccagugggauucugcucgcgccgcgguggaggacgaagaguuuuggaagcugguagauagggagcgggaacuacacaaacaaggaaaguguggcagcugcguuuacaauaugauggguaaaagagagaagaagcuuggggaauucggaaaagcaaagggcucacgcgccaucugguacauguggcugggcgcuagguaucucgaguuugaggcccugggguucuugaacgaagaccauugguuuucccgagagaauaguuacagcggaguggaaggugagggccugcacaaacucggguauauucuucgggauaucucuaagauucccggaggcgcaauguacgcugacgacacagccgguugggauacuagaaucaccgaagacgaucugcauaacgaggagaaaauaacacagcagauggacccagaacacaggcaguuagcuaaugccaucuucaagcugacuuaucaaaacaaggucgugaaagugcagcgcccuacccccaaggggacggucauggauauuaucucccguaaagaccagcggggaucaggccagguuggcacauacggguugaauaccuuuacuaacauggaggcacaacucauuagacagauggaaggagagggugugcugagcaagacagaucuagaaaauccacaucuucuggagaaaaagaucauacaguggcucgagaccaagggcguagaaaggcugaaacgcauggcgauuucgggggacgauugcguggucaagcccaucgacgaucgauucgccaacgcuuuguuagcccugaacgacaugggaaaagugcggaaggauaucccucaguggcaaccaucuagaggcuggcacgacuggcagcagguuccguucuguagucaccauuuucacgagcucauuaugaaagacgguaggaagcuugugguccccugccgcccucaggaugaacugauagggagagcacggaucucccaaggagcuggcuggagccuaaaggagacugccugucugggcaaagcauaugcccagaugugggcgcucauguacuuccauaggcgugacuugcgacuggcuucaaaugccauuugcuccgcagugccaguacacuggguucccaccucucgcacaacguggagcauccacgcccaucaccaguggaugaccacugaagauaugcuuacaguguggaacagagucuggauugaggacaauccuuggauggaggauaagaccccagugacuacaugggaagacguucccuaccuggggaaacgggaggaucaaugguguggaagucucaucgguuuaaccuccagggcuacgugggcccagaacauacugacagcaauccagcaggugcgcagcuugauuggcaaugaagaguuucuggacuauaugccuucuaugaagagauuccggaaagaggaagagucagaaggggcuaucugguga

SEQ ID NO: 15658 - RNA, 9873 nt, Artificial Sequence
  derived and/or modified CDS sequence (opt3) from DENV-3__AY858044__SS-prME
accagccugugccucaugaugaugcuucccgcaacacuggcuuuccacuugacuuccagagacggcgagccuagaaugaucguggggaagaacgaacggggaaaaucuuuacuguuuaagacggcaucagguauuaauauguguacccugauagccauggaucucggcgagaugugcgacgauacaaucacuuacaaauguccacugauuaccgaagucgagccggaagacaucgauugcugguguaaccuuacaaguaccuggguuacuuaugggacaugcaaucaggcgggagagcaucgccgagacaagcguagcguggcucuggcaccccacguaggcauggguuuggauaccagagcacaaacguggauguccgccgagggggcuuggagacagguggaaaaagucgagacuugggcauuccggcauccuggauuuaccauucucgcccuguuccuggcucacuacaucggcacaucucucacucagaaggugguuauauuuaucuuacugaugcuugugaccccaucgaugacaaugcgcugugucggcguggggaacagagacuucguagaaggauugucaggugccaccuggguugaugugguccuggagcauggcgggugcgugacgacuauggcgaagaauaaacccacacuagacauugagcuccagaagaccgaagcaacucaacuggccacacuuaggaaacuguguaucgagggaaagauuaccaacgugacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcugauagagggaaaaguagugcagcacgaaaaucucaaguauacagucauuaucacugugcauaccggugaccagcaccagguuggcaacgagacacaaggggugaccgcagaaauuacuccccaggcuuccacggucgaggccauccuuccugaauacggaacacugggcuuggagugcucuccacgaaccggucuagacuuuaaugagaugauccugcucacuaugaaaaacaaggcguggauggugcauagacagugguucuuugaucugccgcuucccuggaccagcggggccacaaccgaaacuccuacauggaauaaaaaggagcuguugguaacguucaaaaacgcacacgcuaagaagcaagaaguugugguccucggcucccaggagggagccaugcacaccgcucugacuggcgccacagaaauucagaccucagggggaacaaguauauuugcaggucauuuaaaauguaggcugaagauggacaaacuagagcucaagggcaugagcuaugccaugugcucuaaugcuuucgugcugaaaaaggaggucuccgaaacucagcacgggaccauccuuauuaagguggaguacaaaggagaagaugcgccauguaagauccccuucucaacggaggacggccaagguaaagcacauaacgggcgguugauaaccgccaacccuguugugacaaagaaagaggaaccaguaaauauugaggcugaacccccguuuggcgagagcaacaucaucauuggaaucggcgauaaggcccugaagauuaauugguacaaaaaggggaguucuauaggaaaaauguucgaagcaacugcccguggugcucgcagaauggccauccucggcgacaccgcaugggauuuuggguccgucggaggcgugcugaacagccuugguaagaugguucaccagauuuucgggucggcguauacagcucuguuuucuggcguguccuggaucaugaaaaucggaauuggcgucuugcucacuuggauagggcuaaauucaaagaacaccaguaugagcuucuccugcaucgugauuggaaucauuacguuauaccugggcgccguagugcaggcagacauggguuguguuaucaauuggaaggggaaagagcuaaagugcggaucuggcauauuugucacaaacgaggugcauaccuggacugaacaguauaaauuccaagccgauagcccuaagaggcucgcuacagccaucgccggugcuugggagaauggcgugugugggauucggucaaccacucgaauggaaaaccugcuuuggaaacagaucgccaaugaguugaacuacauucugugggaaaauaacaucaagcucaccgucguugugggagacauaauuggcgugcuggagcaggggaaacgcacauuaacgccccagccaauggagcugaaguauaguuggaagaccuggggaaaagcgaagaucguaacugccgaaauucaaaauuccagcuuuaucauagauggcccuaacacacccgagugcccaaacgcuucuagagcauggaaugucugggaaguggaggacuacgguuucgggguuuuuaccacaaacaucuggcuuaaauugagggaaauguauacucagcucugugaccaccggcugaugucagccgcugugaaggaugagcgcgccguccacgcagacaugggauacuggauugagagucagaaaaauggcagcuggaagcuagaaaaggcgucccugaucgaggugaaaaccugcacguggcccaagucucauacacucuggucgaacgguguucuggaaagcgauaugauuaucccuaaaucccuugccggcccaauaucacagcacaauuacagaccgggguaucauacccaaacugcuggacccuggcacuugggcaagcuggaguuagacuucaacuacugcgaggggaccacagugguaauuacugaaaauuguggaaccaggggcccuagucuccguacaacgaccgucucugguaaacugauccacgaguggugcugucggagcugcacucuuccaccccugcgauauaugggggaagauggauguugguacggcauggagaucagaccuauuaacgaaaaggaggagaauauggugaaguccuuggugucagccgguagcggcaaagucgacaacuuuacaauggggguucucugccuggcaauccuauucgaagaggugaugaggggaaaguucggcaaaaagcauaugauugcugggguacuguuuauguucgugcuccugcuuucuggacagauaaccuggcgcgauauggcccggacuuugaucaugauuggcuccaaugcaagugacagaauggguaugggggucacauaucuggccuuaaucgcuaccuuuaaaauucagccauuccucgcgcugggauuuuuccuuaggaagcugacgagccgcgaaaaccuacuccugggcgugggcuuggccauggcaacuacccugcaauuacccgaggauaucgaacagauggcuaaugggauagcccucggacugauggcccuuaagcugaucacacaguuugagaccuaccaguuguggacugcucucguuucucugacauguuccaacaccauuuucacacuaacuguggcauggcgaaccgccacgcugauccuugcggguauuucacuccugccggucugccaaaguagcucgaugcggaaaacagacugguugccuaugaccguggcugccaugggcguuccaccccugccuuuauuuaucuucucccucaaggauacucugaaacguagaucuuggccccuuaaugagggggugauggcagucggacugguaagcauauuggccucaagucuccugaggaacgacgugccaauggcuggcccucuaguugccggugggcugcuuauugccuguuaugugaucaccggaacauccgcggaucucacugucgaaaaggcugccgacgugaccugggaggaagaggcagaacagacgggcguaucucacaaccugaugaucacaguggacgaugacggcaccaugcgcauuaaagaugacgagacugagaauauauugacagucuuacugaagaccgcccuccugaucguuagcgggauuuuucccuacuccaucccagcuacucuucugguguggcauacauggcagaaacagacccaacggucaggaguguugugggaugucccgagcccucccgaaacgcagaaggccgagcuagaagaggguguguacagaauuaagcagcagggcaucuucgggaaaacucaaguuggaguaggcgugcagaaggagggugucuuucacaccauguggcaugugacaagaggggcaguucugaccuauaacggaaaacgacucgaaccaaauugggcuagugugaagaaagaccugauaucuuacggcggcggguggcgccuuuccgcccaguggcaaaagggagaggaaguccaggugaucgcgguagagcccgguaagaacccuaaaaauuuccagacaaugccaggcauuuuccagacuaccacgggggaaaucggagccauugcauuagauuuuaagcccggcacaagcgguucgccuaucauaaaccgggaggggaaagucgugggacuguauggcaauggcguugugacuaagaacgggggauacgucucagguauugcucaaaccaaugccgagccggacggcccaacacccgaacucgaggaagagauguucaaaaagagaaacuugaccaucauggaucugcacccugggucuggaaagacuaggaaauaucucccagcuaucgugcgugaagcaauuaagcgccggcugagaacccuuauccuggcccccacaaggguuguggccgcugagauggaggaagcguugaaaggccuaccuauacgauaccagacgacugcaaccaagagugagcacacagguaaagaaauugucgaccugaugugccaugccaccuuuacuaugcggcucuuauccccggugcgcguacccaauuauaaccugaucauuauggaugaggcucacuucacagacccagccagcaucgcagccagaggguacauaucuaccagggugggaaugggcgaagcugcggccauuuuuaugacggcaacuccucccggcacagcugaugccuucccacagagcaaugcaccuauccaggacgaggagcgggacauccccgaacgauccuggaacucagggaaugauuggauuaccgacuuugccggaaagaccguuugguucgucccaaguaucaaggcugguaacgauauugccaacugucuuaggaagaauggcaagaaagugauacaacugagccgcaagacuuuugacacagaguaccagaaaaccaagcucaacgauugggacuucguggucacaacugauaucucugaaaugggggcgaauuuuaaggcagacaggguaauugauccgcgucggugcuugaaaccugugauccugacggacggacccgagagaguuauccucgccggcccaaugcccgugaccgucgcuuccgccgcucagaggcgcggucgaguggggagaaacccucagaaggagaaugaucaauauauuuucacaggccagccacugaacaaugacgaagaccaugcacacuggacugaggccaaaaugcuucuagauaacauaaauacccccgaaggaaucauuccugcucuguucgagccggaacgggagaagucagccgcaaucgacggcgaguacagguugaaaggggaaagucgcaagacauuuguugaguuaaugcguagaggagaucugccaguguggcucgcgcauaaagucgccagcgaagguauuaaguauaccgaccggaaguggugcuucgauggcgagaggaacaaucagauccuggaagagaacauggacguggagauauggacuaaagaaggggagaagaagaaacuucgcccccgauggcuggaugcuagaacguacuccgacccucucgccuugaaagaauuuaaagauuucgcagcuggacggaagucuaucgcccuggaccuaguaaccgagauuggcagggugcccucgcaccuggcacaccgcacaagaaaugcccucgauaaccuuguuaugcugcauacuagcgaacacggugggagggcuuaucggcaugcggucgaggaguuaccagaaaccauggagacauugcugcuccugggccuuaugauccugcucaccggaggcgccauguuguuucugauuucagggaaaggaguggguaagacuuccaucggcuuaauauguguggucgcaaguucugggaugcuauggauggcugacauuccucugcaguggaucgccagcgccauuguucucgaguucuuuaugauggugcuucugauccccgagccagagaaacaacguacaccucaggauaaucaguuggcauacguagugauaggaauccugacgcucgcugccauugucgcggcuaacgaaaugggccugcuugagaccacuaagcgcgaccucgguauguccaaagaaccgggggugguuucacccacaucuuaucuggacguggauuugcacccagccagcgcauggacccuguacgccgucgcuaccacaguaaucacuccuauguuacgacacacgauugagaauaguaccgcaaacgugucccuagccgcgaucgcuaaccaagccguugugcugaugggccucgacaagggauggcccauaagcaagauggaucuuggcgucccacuguuggcacuggggugcuacucucaggugaauccucucacacugacugccgcuguccuuuuacuggugacccauuaugccauuaucggacccggccuccaggcaaaagcuacaagagaagcccagaagaggaccgcggccgguaucaugaaaaacccgacuguugacgggauuaugacgaucgauuuggacccagugauauacgauucaaaguucgagaaacaacugggacagguaaugcuacuggugcucugugcaguccagcuucuguugaugcggacauccugggcuuuuugcgaggcccugacccucgcaacuggcccuauuaccacacugugggaagguagucccggcaaguucuggaauacuaccaucgcuguuagcauggccaacauuuuucgcgggucguauuuagccggagcgggccuugcuuucucuaucaugaaguccguggggacaggaaaaagaggcacggguagccagggggagacccugggagaaaaguggaaaaagaaacucaaucaacuaucaaggaaggaguuugaccuguacaaaaagaguggcauaacugaagucgaucggacagaggcaaaggaggguuugaaacgaggcgaaaccacucaccaugccgugucuagaggguccgcuaagcugcagugguucguagagcgcaacauggugaucccagaaggaaggguuauugaccucggcugugggcggggaggcuggagcuauuacugcgccggucuuaaaaaggugacagagguccguggguauaccaaaggaggccccggccacgaagaaccugugccgaugucaacguacggguggaauaucgucaagcugaugaguggaaaggauguguucuacuugcccccagagaaaugugacacccugcucugcgauauuggugaaagcuccccuucucccacaguugaggaaagcagaacuaucaggguauuaaagaugguggagccuuggcugaaaaacaaucaguuuuguauuaagguccuuaacccauauaugcccaccgugaucgagcaucuggaacgccuacagcggaaacacggcgggaugcucguucgaaauccucuguccagaaacucaacacacgagauguacuggauaucuaauggaacuggcaacauugugaguucggucaauauggugagcagguugcugcucaaccgcuucaccaugacauaucggagaccaaccaucgaaaaggacguagaccuuggugcagggacucgucaugugaacgccgagcccgaaacgccgaauauggauguuaucggagagaggauucggcgcauaaaggaggaacacuccucuacauggcauuacgacgaugagaacccuuauaaaaccugggcuuaccacggcucauaugaagucaaggcgacuggcagcgccuccaguaugaucaaugggguggugaaacuguuaaccaagccaugggacgucguucccacagugacgcaaauggcaaugaccgauacuacaccuuuuggacagcagcgaguauucaaagagaagguggacaccagaacuccaaagcccaugccggguacaaggaaagucauggaaauuaccgcuggcuggcuguggcggacauuggggcgcaacaagagaccuaggcucugcacucgagaggaguuuaccaaaaaggugcggacgaaugccgcaaugggagccguuuucaccgaagagaaccaaugggauucugcucgugccgcgguggaagacgaggaauuuuggaaacuggucgauagagagcgcgagcuacacaagcagggcaaaugugguagcugcguguacaauaugauggggaagagggaaaagaaacuuggagaguucggcaaggcaaaaggcucacgggccaucugguacauguggcugggggcuagauaucucgaauuugaggcccugggauucuugaacgaggaccauugguuuucccgcgaaaauaguuacagcgguguagagggcgaagggcugcacaagcucggauauauucuuagggauaucucuaaaauacccggcggugcaauguacgcugacgacacagccgggugggauacucgaaucaccgaggacgaucugcauaacgaagagaagauuacacagcagauggacccagagcaccggcaauuagcuaaugccaucuucaagcugacuuaucagaacaaaguugugaagguccagagaccuacccccaaaggaacggugauggauauuaucuccaggaaggaccagcgcggcucaggccaaguggggacauacggauugaauaccuuuacuaacauggaagcacagcucauacgucagauggagggugaaggcguccugagcaaaacagaucuagagaauccacaucuucuggaaaagaagauuacccaguggcucgagacuaaagggguugagcggcugaagagaauggcgaucucgggagacgauugcgugguaaaacccaucgacgauagguucgccaacgcuuuguuagcccugaacgacaugggcaaggugcgcaaagauauuccucaauggcagccaucuaaggguuggcacgacuggcagcaggucccguucuguagucaccauuuucacgaacucauaaugaaggacgggcgaaaacuugugguucccugccggccucaagaugagcugaucggaagggcaaggauuucccagggcgcuggcuggagccuaaaggaaaccgccugucuggggaaagcauaugcccagaugugggcgcucauguacuuccaucgcagagacuugcggcuggcuucaaaugccaucugcuccgcagugccaguccacugggugcccacaucuaggacgaccuggagcauucacgcccaucaccaauggaugacuacagaggauaugcuuaccguauggaaccguguuuggaucgaagacaauccuuggauggaggauaagacuccagugacaaccugggaggacguccccuaccugggaaaacgagaagaucaguggugugguagucucauaggcuuaacgucccgcgcuacaugggcccagaacauccugaccgcaauucagcaagugaggagcuugaucgggaaugaggaauuucuggacuauaugccuucuaugaagcgguucaggaaggaggaggaaucagagggagcuauuugguga

SEQ ID NO: 15659 - RNA, 9873 nt, Artificial Sequence
  derived and/or modified CDS sequence (opt3) from DENV-3__AY858045__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacaaucacuuacaaauguccacugauuaccgaagucgagccggaagacaucgauugcugguguaaccuuacaaguaccuggguuacuuaugggacaugcaaucaggcgggagagcaucgccgagacaagcguagcguggcucuggccccccacguaggcauggguuuggauaccagagcacaaacguggauguccgccgagggggcuuggaggcagguggaaaaagucgagacuugggcauuccggcauccuggauuuaccauucucgcccuguuccuggcucacuacaucggcacaucucucacucagaaggugguuauauuuaucuuacugaugcuugugaccccaucgaugacaaugcgcugugucggcguggggaacagagacuucguagaaggauugucaggugccaccuggguugaugugguccuggagcauggcgggugcgugacgacuauggcgaagaauaaacccacacuagacauugagcuccagaagaccgaagcaacucaacuggccacacuuaggaaacuguguaucgagggaaagauuaccaacgugacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcugauagagggaaaaguagugcagcacgaaaaucucaaguauacagucauuaucacugugcauaccggugaccagcaccagguuggcaacgagacacaaggggugaccgcagaaauuacuccccaggcuuccacggucgaggccauccuuccugaauacggaacacugggcuuggagugcucuccacgaaccggucuagacuuuaaugagaugauccugcucacuaugaaaaacaaggcguggauggugcauagacagugguucuuugaucugccgcuucccuggaccagcggggccacaaccgaaacuccuacauggaauaaaaaggagcuguugguaacguucaaaaacgcacacgcuaagaagcaagaaguugugguccucggcucccaggagggagccaugcacaccgcucugacuggcgccacagaaauucagaccucagggggaacaaguauauuugcaggucauuuaaaauguaggcugaagauggacaaacuagagcucaagggcaugagcuaugccaugugcucuaaugcuuucgugcugaaaaaggaggucuccgaaacucagcacgggaccauccuuauuaagguggaguacaaaggagaagaugcgccauguaagauccccuucucaacggaggacggccaagguaaagcacauaacgggcgguugauaaccgccaacccuguugugacaaagaaagaggaaccaguaaauauugaggcugaacccccguuuggcgagagcaacaucaucauuggaaucggcgauaaggcccugaagauuaauugguacaaaaaggggaguucuauaggaaaaauguucgaagcaacugcccguggugcucgcagaauggccauccucggcgacaccgcaugggauuuuggguccgucggaggcgugcugaacagccuugguaagaugguucaccagauuuucgggucggcguauacagcuaucuuuucuggcguguccuggaucaugaaaauuggaauaggcguccuguugacuuggaucgggcucaauucaaagaacaccaguaugagcuucuccugcauugugaucggaauuaucacgcuguacuuaggcgccguagugcaggcagacauggguuguguuauaaauuggaaggggaaagagcugaagugcggaucuggcaucuuugucacaaacgaggugcauaccuggacugaacaguauaaauuccaagccgauagcccuaagaggcuagcuacagccauugcaggugcuugggagaauggcgugugugggauccggucaaccacucgaauggaaaaccuccuguggaaacagauugccaaugagcuuaacuacaucuugugggaaaauaacauaaagcugaccgucguugugggagacauuaucggcgugcucgagcaggggaaacgcacacugacgccccagccaauggaguuaaaguauaguuggaagaccuggggaaaagcgaagauuguaacugccgaaauccaaaauuccagcuuuauaaucgauggcccuaacacacccgagugcccaaacgcuucuagagcauggaaugucugggaaguggaggacuacgguuucgggguuuuuaccacaaacauuuggcugaaacuuagggaaauguauacucaguugugugaccaccggcucaugucagccgcugugaaggaugagcgcgccguccacgcagacaugggauacuggaucgagagucagaaaaauggcagcuggaagcuggaaaaggcgucccuaauugaggugaaaaccugcacguggcccaagucucauacacuguggucgaacgguguucucgaaagcgauaugaucauaccuaaaucccuggccggcccaauuucacagcacaauuacagaccgggguaucauacccaaacugcuggacccuggcaccuuggcaaguuggagcuggacuucaacuacugcgaggggaccacagugguaaucacugaaaauuguggaaccaggggcccuaguuuacguacaacgaccgucucugguaaacucauccacgaguggugcugucggagcugcacucugccaccccuucgauauaugggggaagauggauguugguacggcauggagauuagaccuaucaacgaaaaggaggagaauauggugaagucccuggugucagccgguagcggcaaagucgacaacuuuacaauggggguuuugugccucgcaauucuguucgaagaggugaugaggggaaaguucggcaaaaagcauaugauagcugggguacuauuuauguucgugcugcuccugucuggacagaucaccuggcgcgauauggcccggacucuuauuaugaucggcuccaaugcaagugacagaauggguaugggggucacauauuuggcccugauugcuaccuuugaaauccagccauucuuagcgcucggauuuuuccugaggaaacuuacgagccgcgagaaccugcuacucggcgugggccuggccauggcaacuaccuugcaacugcccgaagauauagagcagauggcuaaugggaucgccuuaggacucauggcccugaagcuuauuacacaguuugagaccuaccagcuguggacugcuuugguuucucucacauguuccaacaccaucuucacacugacuguggcauggcgaaccgccacgcuaauucuggcggguaucucacuucucccggucugccaaaguagcucgaugcggaagacagacuggcugccuaugaccguggcugccaugggcguuccacccuugccucuguuuauauucuccuuaaaagauacucucaagcguagaucuuggccccugaaugaaggggugauggcagucggacuuguaagcauucuggccucaaguuugcucaggaacgacgugccaauggcuggcccucugguugcaggugggcuacugaucgccuguuaugugaucaccggaacauccgcggaucuuacugucgagaaagcugccgacgugaccugggaagaggaagcagagcagacgggcguaucucacaaccucaugauuacaguggacgaugacggcaccaugcgcauaaaggaugacgagacugaaaauauccugacagucuuguuaaaaaccgcccugcucauuguuagcgggaucuuucccuacuccauuccagcuacucugcuuguguggcauacauggcagaagcagacccaacggucaggagugcugugggaugucccgagcccucccgagacgcagaaagccgaauuggaggaggguguguacagaaucaagcagcagggcauauucgggaagacucaaguuggaguaggcgugcagaaagaaggugucuuucacaccauguggcaugugacaaggggggcaguucuaaccuauaacggaaagcgacuggagccaaauugggcuagugugaaaaaggaccucaucucuuacggcggcggguggcgccuguccgcccaguggcaaaaaggagaagagguccaggugauugcgguagaacccgguaagaacccuaagaauuuccagacaaugccaggcaucuuccagacuaccacgggggagauuggagccaucgcacuugauuuuaaacccggcacaagcgguucgccuauaauuaaccgggaggggaaggucgugggauuauauggcaauggcguugugacuaaaaacgggggauacgucucagguaucgcucaaaccaaugccgaaccggacggcccaacacccgagcuggaagaggaaauguucaagaaaagaaaccucaccaucauggauuugcacccugggucuggaaagacuaggaaguaucugccagcuauugugcgugaggcaaucaaacgccggcucagaacccugauacuugcccccacaaggguuguggccgcugagauggaagaggcgcugaagggcuugccuauucgauaccagacgacugcaaccaaaagugaacacacagguaaggagaucgucgaccuaaugugccaugccaccuuuacuaugcggcugcucuccccggugcgcguacccaauuauaacuuaauuaucauggaugaagcucacuucacagacccagccagcauagcagccagaggguacauuucuaccagggugggaaugggcgaggcugcggccaucuuuaugacggcaacuccucccggcacagcugaugccuucccacagagcaaugcaccuauccaggacgaggaacgggacauucccgagcgauccuggaacucagggaaugauuggaucaccgacuuugccggaaaaaccguuugguucgucccaaguauuaaggcugguaacgauauagccaacugucugagaaagaauggcaaaaaggugauccaacuuagccgcaaaacuuuugacacagaauaccagaagaccaaacugaacgauugggacuucguggucacaacugauauuucugagaugggggcgaauuuuaaggcagacaggguaaucgauccgcgucggugccucaagccugugaucuugacggacggacccgagagaguuauucuggccggcccaaugcccgugaccgucgcuuccgccgcucagaggcgcggucgaguggggagaaacccucagaaagaaaaugaucaauauauauucacaggccagccacucaacaaugacgaggaccaugcacacuggacugaagccaagaugcugcuugauaacaucaauacccccgagggaauuaucccugcucuauucgaaccggagcgggagaaaucagccgcaauugacggcgaauacaggcugaagggggagagucgcaaaacauuuguugaauugaugcguagaggagauuuaccaguguggcuggcgcauaaggucgccagcgaggguaucaaauauaccgaccggaaguggugcuucgauggcgaaaggaacaaucagauacucgaggagaacauggacguggaaaucuggacuaaggagggggaaaaaaagaaacugcgcccccgauggcuugaugcuagaacguacuccgacccucuggcccucaaggaguuuaaagauuucgcagcuggacggaagucuauugccuuggaccugguaaccgaaaucggcagggugcccucgcaccuagcacaccgcacaagaaaugcccuggauaaccucguuaugcuucauacuagcgagcacggugggagggcuuaucggcaugcggucgaggaacugccagagaccauggaaacauuauugcugcucggccugaugauucuucugaccggaggcgccaugcucuuuuugaucucagggaagggaguggguaaaacuuccauaggccugauuuguguggucgcaaguucugggauguuauggauggcugacaucccucuacaguggauugccagcgccaucguucuggaguucuuuaugauggugcuccuuauacccgagccagaaaagcaacguacaccucaggauaaucagcuggcauacguagugaucggaauuuugacgcuggcugccaucgucgcggcuaacgagaugggccuccuggaaaccacuaaacgcgaccuugguauguccaaggagccgggggugguuucacccacaucuuaucucgacguggaucugcacccagccagcgcauggaccuuguacgccgucgcuaccacaguaauuacuccuaugcugcgacacacgaucgaaaauaguaccgcaaacguguccuuagccgcgauagcuaaccaagccguugugcuaaugggccuggacaaaggauggcccauuagcaagauggaucucggcgucccacuucuggcauuggggugcuacucucaggugaauccucugacacucacugccgcuguccugcuuuuagugacccauuaugccaucaucggacccggccugcaggcaaaggcuacaagagaggcccagaaaaggaccgcggccgguauuaugaagaacccgacuguugacgggaucaugacgauagaucucgacccagugauuuacgauucaaaauucgagaagcaauugggacagguaaugcugcuagugcugugugcaguccagcuccuucugaugcggacauccugggcuuuuugcgaagccuugacccuggcaacuggcccuaucaccacacucugggaggguagucccggcaaauucuggaauacuaccauugcuguuagcauggccaacaucuuucgcgggucguaucuggccggagcgggcuuagcuuucucuauaaugaaguccguggggacaggaaagagaggcacggguagccagggggaaacccuuggagagaaauggaagaaaaggcugaaucaacucucacggaaggaauuugaccuauacaaaaagaguggcaucacugaggucgaucgaacagaggcaaaagaaggucugaagagaggcgagauuacccaccaugccgugucucgcggguccgcuaaguugcagugguucguagaaaggaacauggugaucccagagggacggguuauugaccugggcugugggcguggaggcuggagcuauuacugcgccggucucaaaaaggugacugaagucagaggguauacaaaaggaggccccggccacgaggagccugugccgaugucaaccuacggguggaauaucgucaagcuuaugaguggaaaagauguguucuaccugcccccagaaaagugugacacguugcugugcgauauuggugagagcuccccuucucccaccguugaagagagcaggacaauccgcguacucaagaugguggagccuugguuaaaaaacaaucaguuuuguauaaagguccugaacccauauaugcccacugugauugaacaucuugagcggcugcagcgaaaacacggcgggaugcuaguuagaaauccucucuccaggaacucaacccacgaaauguacuggaucucuaauggaacaggcaacaucgugaguucggucaauauggugagccgccuguugcugaaccgguucacuaugaccuauagacguccaacaauugagaaggacguagaccucggugcagggaccaggcaugugaacgccgaacccgagacuccgaauauggauguuauaggagagcggauccgccgaauuaaagaagagcacuccucuacguggcauuacgacgaugaaaacccuuauaagacaugggcuuaccacggcucauaugaggucaaggcgaccggcagcgccuccaguaugaucaaugggguggugaaacuucugacuaagccaugggacgucguucccaccgugacacaaauggcaaugacggauaccacuccuuuuggacagcagagaguauucaaagaaaagguggacacaaggaccccaaaacccaugccggguacucggaaggucauggagauuacagcuggcugguuauggcgcacccuggggagaaacaagaggccucgauugugcacacgggaggaauuuacuaaaaaggugcguaccaaugccgcaaugggagccguuuucacggaggaaaaccaaugggauucugcuagagccgcgguggaggacgaagaguuuuggaaacucgucgaucgcgagagggaacugcacaagcagggcaaaugugguagcugcguguacaauaugauggggaagcgggagaaaaagcuaggagaauucggcaaggcaaaaggcucaagagccaucugguacauguggcuuggggcucgcuaucuggaguuugaggcccucggauuccugaacgaagaccauugguuuuccagggagaauaguuacagcgguguagaaggcgagggguugcacaagcugggauauauacuccgagauaucucuaaaauucccggcggugcaauguacgcugacgacaccgccgggugggauacacggaucacugaagacgaucuucauaacgaggagaagauuacccagcagauggacccagaacacagacaacuggcuaaugccaucuucaaauuaacauaucagaacaagguugugaagguccagaggccuacucccaaaggaaccgugauggauauaauuucccgcaaggaccagcguggcucaggccaaguggggacguacggacugaauacauuuaccaacauggaggcacaguugauccggcagauggaaggugagggcguccucagcaaaacugaucuggaaaauccacaucuacuugagaagaaaaucacacaguggcuggagaccaaggggguugaaagacucaagaggauggcgauuucgggagacgauugcgugguaaaacccauagacgaucgcuucgccaacgcucuguuggccuuaaacgacaugggcaaggugcgaaaagauaucccucaauggcagccaucuaaggguuggcacgacuggcagcaggucccguucuguagucaccauuuucacgagcugauuaugaaagacgggcggaagcucgugguucccugcagaccucaagaugaacuuaucggaagggcacgcauuucccagggcgcuggcuggagccugaaggagacugccugucuagggaaagcauaugcccagaugugggcgcugauguacuuccauagacgggaccucagguuggcuucaaaugccaucugcuccgcagugccaguccacugggugcccaccucucguacaacguggagcauacacgcccaucaccaauggaugaccacugaagauaugcugacaguauggaaccgaguuuggaucgaggacaauccuuggauggaggauaagaccccagugacuacaugggaagacguccccuaccuuggaaaacgcgaggaucaguggugugguagucugauuggccucaccuccagagcuacgugggcccagaacaucuuaacagcaauucagcaagugcggagccugaucgggaaugaagaguuuuuggacuauaugccuucuaugaagagguuccgcaaagaggaagagucagaaggagcuauuugguga

SEQ ID NO: 15660 - RNA, 9873 nt, Artificial Sequence
  derived and/or modified CDS sequence (opt3) from DENV-3__AY858046__SS-prME
accagccugugccucaugaugaugcuucccgccacacuggcuuuccacuugacuuccagagacggcgaaccuaggaugaucguggggaagaacgaacggggaaaaucuuuacuguuuaagacggcaucagguauuaauauguguacccugauagccauggaucucggcgaaaugugcgacgauacaaucacuuacaaauguccacugauuaccgaagucgagccggaagacaucgauugcugguguaaccuuacaaguaccuggguuacuuaugggacaugcaaucaggugggagagcaucgccgagacaagcguagcguagcgcuggcuccccacgugggcauggguuuggauaccagagcccagacguggauguccgcagagggggccuggaggcaggucgaaaaaguggagacuugggcuuuccggcauccuggauuuaccauucucgcacuguuccuggcccacuacaucggcacaucucucacucagaagguugugauauuuaucuuacugaugcuugucaccccaucgaugacaaugcgcugugugggcguagggaacagagacuucguugaaggauugucaggugcuaccuggguggaugucgugcuggagcauggcgggugcgugacgacuauggccaagaauaaacccacacuagacauugagcuccagaagaccgaagcgacucaacuggcaacacuuaggaaacuguguaucgagggaaagauuaccaacgucacgaccgauagccggugcccuacacagggcgaagccaucuugccagaggaacaggaccagaauuauguuuguaaacacacuuacguggaucgcgguugggggaacggaugcggccucuuuggcaaggggagucugguaaccugcgcuaaguuccaauguuuagagcugauagagggaaaagugguccagcacgaaaaucucaaguauacagugauuaucacuguucauaccggugaccagcaccaggugggcaacgagacacaaggggucaccgccgaaauuacuccccaggcauccacgguggaggcuauccuuccugaauacggaacacugggcuuggagugcucuccacgaaccggucuagacuuuaaugagaugauccugcucacuaugaaaaacaaggccuggaugguacauagacagugguucuuugaucugccgcuucccuggaccagcggggcgacaaccgaaacuccuacauggaauaaaaaggagcuguugguuacguucaaaaacgcccacgcaaagaagcaagaaguggucgugcucggcucccaggagggagcuaugcacaccgcccugacuggcgcuacagaaauucagaccucagggggaacaaguauauuugccggucauuuaaaauguaggcugaagauggacaaacuagagcucaagggcaugagcuaugcaaugugcucuaaugccuucguccugaaaaaggagguguccgaaacucagcacgggaccauccuuauuaagguugaguacaaaggagaagaugcuccauguaagauccccuucucaacggaggacggccaagguaaagcgcauaacgggcgguugauaaccgcaaacccugugguaacaaagaaagaggaaccagucaauauugaggccgaacccccguuuggcgagagcaacaucaucauuggaaucggcgauaaggcucugaagauuaauugguacaaaaaggggaguucuauaggaaaaauguucgaagccacugcacguggugcccgcagaauggcuauccucggcgacaccgccugggauuuuggguccgugggaggcguucugaacagccuugguaagauggugcaccagauuuucgggucggcauauacagcgcuguuuucuggcgucuccuggaucaugaaaaucggaauuggcguguugcucacuuggauagggcuaaauucaaagaacaccaguaugagcuucuccugcaucguaauuggaaucauuacguuauaccugggcgcugugguucaggccgacauggguugugucaucaauuggaaggggaaagagcuaaagugcggaucuggcauauuugugacaaacgaggugcauaccuggacugaacaguauaaauuccaagcagauagcccuaagaggcucgccacagcuaucgccggugcaugggagaauggcgucugugggauucggucaaccacucgaauggaaaaccugcuuuggaaacagaucgcuaaugaguugaacuacauucugugggaaaauaacaucaagcucaccguuguggugggagacauaauuggcguacuggagcaggggaaacgcacauuaacgccccagccaauggagcugaaguauaguuggaagaccuggggaaaagccaagaucgucacugcggaaauucaaaauuccagcuuuaucauagauggcccuaacacacccgagugcccaaacgccucuagagcuuggaaugugugggaaguugaggacuacgguuucgggguguuuaccacaaacaucuggcuuaaauugagggaaauguauacucagcucugugaccaccggcugaugucagcagccgucaaggaugagcgcgcugugcacgccgacaugggauacuggauugagagucagaaaaauggcagcuggaagcuagaaaaggcaucccugaucgagguuaaaaccugcacguggcccaagucucauacacucuggucgaacggugugcuggaaagcgauaugauuaucccuaaaucccuugcgggcccaauaucacagcacaauuacagaccgggguaucauacccaaacugccggacccuggcacuugggcaagcuggaguuagacuucaacuacugcgaggggaccacaguagucauuacugaaaauuguggaaccaggggcccuagucuccguacaacgaccgugucugguaaacugauccacgaguggugcugucggagcugcacucuuccaccccugcgauauaugggggaagauggauguugguacggcauggagaucagaccuauuaacgaaaaggaggagaauauggugaaguccuuggucucagcugguagcggcaaaguugacaacuuuacaaugggggugcucugccuggccauccuauucgaagagguaaugaggggaaaguucggcaaaaagcauaugauugcaggggugcuguuuauguucguccuccugcuuucuggacagauaaccuggcgcgauauggcucggacuuugaucaugauuggcuccaaugccagugacagaauggguaugggggugacauaucuggcauuaaucgccaccuuuaaaauucagccauuccucgcucugggauuuuuccuuaggaagcugacgagccgcgaaaaccuacuccugggcguuggcuuggcgauggccacuacccugcaauuacccgaggauaucgaacagauggcaaaugggauagcucucggacugauggcccuuaagcugaucacacaguuugagaccuaccaguuguggacugcccucgugucucugacauguuccaacaccauuuucacacuaacugucgcuuggcgaaccgcaacgcugauccuugccgguauuucacuccugccggugugccaaaguagcucgaugcggaaaacagacugguugccuaugaccguugcggcuaugggcgugccaccccugccuuuauuuaucuucucccucaaggauacucugaaacguagaucuuggccccuuaaugagggggucauggccguaggacuggugagcauauuggcaucaagucuccugaggaacgacguuccaauggccggcccucuaguggcuggugggcugcuuauugcauguuaugucaucaccggaacauccgccgaucucacuguggaaaaggcggcugacguaaccugggaggaagaggccgaacagacgggcgugucucacaaccugaugaucacagucgacgaugacggcaccaugcgcauuaaagaugacgagacugagaauauauugacaguuuuacugaagaccgcacuccugaucgugagcgggauuuuucccuacuccaucccagccacucuucugguguggcauacauggcagaaacagacccaacggucaggagucuugugggaugugccgagcccucccgaaacgcagaaggcugagcuagaagaggguguuuacagaauuaagcagcagggcaucuucgggaaaacucaaguaggagugggcguccagaaggaggguguguuucacaccauguggcauguuacaagaggggccgugcugaccuauaacggaaaacgacucgaaccaaauugggcaagugucaagaaagaccugauaucuuacggcggcggguggcgccuuuccgcucaguggcaaaagggagaggaagugcagguaaucgccgucgagcccgguaagaacccuaaaaauuuccagacaaugccaggcauuuuccagacuaccacgggggaaaucggagcgauugccuuagauuuuaagcccggcacaagcgguucgccuaucauaaaccgggaggggaaagugguuggacuguauggcaauggcguggucacuaagaacgggggauacgugucagguauugcacaaaccaaugcugagccggacggcccaacacccgaacucgaggaagagauguucaaaaagagaaacuugaccaucauggaucugcacccugggucuggaaagacuaggaaauaucucccagccaucguucgugaagcuauuaagcgccggcugagaacccuuauccuggcacccacaaggguggucgccgccgagauggaggaggcuuugaaaggccuaccuauacgauaccagacgacugcgaccaagagugagcacacagguaaagaaauuguggaccugaugugccaugcaaccuuuacuaugcggcucuuauccccgguacgcgugcccaauuauaaccugaucauuauggaugaggcccacuucacagacccagcuagcaucgccgcaagaggguacauaucuaccaggguuggaaugggcgaagccgcugcgauuuuuaugacggccacuccucccggcacagcagaugcuuucccacagagcaaugccccuauccaggacgaggagcgggacauccccgaacgauccuggaacucagggaaugauuggauuaccgacuuugcaggaaagaccgucugguucgugccaaguaucaaggccgguaacgauauugcuaacugucuuaggaagaauggcaagaaagugauacaacugagccgcaagacuuuugacacagaguaccagaaaaccaagcucaacgauugggacuucgucguaacaacugauaucucugaaaugggggccaauuuuaaggcggacagggugauugauccgcgucggugcuugaaaccuguuauccugacggacggacccgagagagugauccucgcaggcccaaugcccgucaccguggccuccgcugcccagaggcgcggucgaguugggagaaacccucagaaggagaaugaucaauauauuuucacaggccagccacugaacaaugacgaagaccaugcucacuggacugaggcaaaaaugcuucuagauaacauaaauacccccgaaggaaucauuccugcccuguucgagccggaacgggagaagucagcugccaucgacggcgaguacagguugaaaggggaaagucgcaagacauuuguggaguuaaugcguagaggagaucugccagucuggcucgcacauaaaguggcgagcgaagguauuaaguauaccgaccggaaguggugcuucgauggcgagaggaacaaucagauccuggaagagaacauggacguagagauauggacuaaagaaggggagaagaagaaacuucgcccccgauggcuggaugccagaacguacuccgacccucucgcuuugaaagaauuuaaagauuucgccgcaggacggaagucuaucgcucuggaccuagugaccgagauuggcaggguucccucgcaccuggcccaccgcacaagaaaugcacucgauaaccuugucaugcugcauacuagcgaacacggugggagggccuaucggcaugcuguggaggaguuaccagaaaccauggagacauugcugcuccugggccuuaugauccugcucaccggaggcgcgauguuguuucugauuucagggaaaggaguggguaagacuuccaucggcuuaauaugugucguugccaguucugggaugcuauggauggcagacauuccucugcaguggaucgcuagcgccauugugcucgaguucuuuaugaugguacuucugauccccgagccagagaaacaacguacaccucaggauaaucaguuggccuacguggucauaggaauccugacgcucgcagcuauuguggccgcgaacgaaaugggcaugcuggagaccacuaagcgcgaccuugguauguccaaagaaccggggguugugucacccacaucuuaucucgacgucgaucugcacccagcuagcgccuggaccuuguacgcaguagccaccacagugaucacuccuaugcugcgacacacgauugagaauaguaccgcuaacguuuccuuagcagccaucgcgaaccaagcugugguccuaaugggccuggacaagggauggcccauaagcaagauggaucucggcgugccacuucuggccuuggggugcuacucucaggucaauccucugacacucacugcagccgugcugcuuuuaguuacccauuaugcuauuaucggacccggccugcaggccaaagcaacaagagaagcucagaagaggaccgccgcggguaucaugaaaaacccgacuguggacgggauuaugacgaucgaucucgacccaguaauauacgauucaaaguucgagaaacaauugggacaggugaugcugcuaguccugugugccguucagcuccuucugaugcggacauccugggcauuuugcgaggcuuugacccuggccacuggcccuauuaccacacucugggaagguagucccggcaaguucuggaauacuaccaucgcagugagcauggcuaacauuuuucgcgggucguaucuggccggagccggcuuagcguucucuaucaugaaguccgucgggacaggaaaaagaggcacggguagccagggggagacccuuggagaaaaguggaaaaagaaacugaaucaacucucaaggaaggaguuugaccuauacaaaaagaguggcauaacugaaguggaucggacagaggcuaaggagggucugcgaagaggcgaaaucacccaccaugcaguaucucgcggguccgccaaauugcagugguucguggagaggaacaugguuauuccagaaggacgggugaucgaccugggcugugggcguggaggcuggagcuauuacugcgcuggucucaagaaagucacugaggugagaggguauacaaagggaggccccggccacgaagaaccugucccgaugucaaccuacggguggaauauugugaaacuuaugaguggaaaggauguuuucuaccugcccccagagaagugugacacguugcugugcgauaucggugaaagcuccccuucucccaccguagaggaaagcaggacaauucgcgugcucaaaauggucgagccuugguuaaagaacaaucaguuuuguaucaaagugcugaacccauauaugcccacuguuauagagcaucuugaacggcugcagcgaaagcacggcgggaugcuagugagaaauccucucuccaggaacucaacccacgagauguacuggauuucuaauggaacaggcaacaucgucaguucggugaauaugguaagccgccuguugcugaaccgguucacuaugaccuauagacguccaacaaucgaaaaagacguggaccucggugccgggaccaggcauguuaacgcagagcccgaaacuccgaauauggaugucauuggagagcggauacgccgaaucaaggaggaacacuccucuacguggcauuacgacgaugagaacccuuauaagacaugggccuaccacggcucauaugaagugaaagcuaccggcagcgcguccaguaugauuaaugggguggucaaacuucugacuaaaccaugggacguugugcccaccguaacacaaauggccaugacggauaccacuccuuuuggacagcagagaguguucaaggagaaagucgacacaaggaccccaaagcccaugccggguacucggaaggcaauggaaaucacagcuggcugguuauggcgcacccuggggagaaacaaaaggccucgauugugcacacgggaggaguuuacuaagaaagugcguaccaaugccgcaaugggagccguuuucacggaagagaaccaaugggauucugcuagagccgcgguggaagacgaggaauuuuggaagcucgucgaucgcgagagggagcugcacaaacagggcaagugugguagcugcguguacaauaugauggggaaacgggaaaagaagcuaggagaguucggcaaagcaaagggcucaagagccauuugguacauguggcuuggggcucgcuaucuggaauuugaggcccucggauuccugaacgaggaccauugguuuuccagggaaaauaguuacagcgguguagagggcgaaggguugcacaaacugggauauauccuccgagauauaucuaagauccccggcggugcaauguacgcugacgacaccgccgggugggauacacggauuacugaggacgaucuucauaacgaagagaaaaucacccagcagauggacccagagcacagacaacuggcuaaugccauuuucaaguuaacauaucagaacaagguugugaaaguccagaggccuacucccaagggaaccgugauggauaucauaucccgcaaagaccagcguggcucaggccaaguggggacguacggacugaauacauuuaccaacauggaaguccaguugauucggcagauggagggugaaggcguucucagcaagacugaucuggagaauccacaucuacuugagaagaagaucacacaguggcuggagaccaaggggguggagagacucaaaaggauggcaaucucgggagacgauugcguagugaagcccauugacgaucgcuucgcgaacgcccuguuggcuuuaaacgacaugggcaaaguccgaaaggauauaccucaauggcagccaucuaaagguuggcacgacuggcaacaggugccguucuguagucaccauuuucacgaacugaucaugaaggacgggcggaagcucguugugcccugcagaccucaagaugagcuuauuggaagggcccgcaucucccagggcgcaggcuggagccugaaagaaacugcuugucuagggaaggccuaugcacagaugugggcccugauguacuuccauagacgggaccucagguuggcgucaaaugcuauuugcuccgccgucccagugcacuggguacccaccucucguacaacguggagcauccacgcacaucaccaauggaugaccacugaggauaugcugacaguuuggaaccgaguguggauagaagacaauccuuggauggaggauaaaaccccagucacuacaugggaggacgugcccuaccuuggaaagcgcgaagaucaguggugugguagucugaucggccucaccuccagagccacgugggcucagaacauuuuaacagccauccagcaaguucggagccugauugggaaugaggaauuuuuggacuauaugccuucuaugaaaagguuccgcaaggaggaggaaucagagggagcaaucugguga

SEQ ID NO: 15661 - RNA, 9873 nt, Artificial Sequence
  derived and/or modified CDS sequence (opt3) from DENV-3__AY858047__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcugaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagcaggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcauucuggagcaggggaaacgcacauuaacgccccagccaauggagcugaaguauaguuggaagaccuggggaaaagcgaagaucguaacugccgaaauucaaaauuccagcuuuaucauagauggcccuaacacacccgagugcccaaacgcuucuagagcauggaaugucugggaaguggaggacuacgguuucgggguuuuuaccacaaacaucuggcuuaaauugagggaaauguauucacagcucugugaccaccggcugaugagugccgcugugaaggaugagcgcgccguccacgcagacaugggauacuggauugagagccagaaaaauggcuccuggaagcuagaaaaggcgucucugaucgaggugaaaacuugcaccuggcccaagucgcauacgcucuggagcaacgguguucuggaauccgauaugauuaucccuaaaucacuugccggcccaauaagucagcacaauuacagaccgggguaucauacacaaaccgcuggacccuggcacuugggcaagcuggaguuagacuucaacuacugcgaggggacuaccgugguaauuacagaaaauuguggaacuaggggcccuucucuccguaccacaacggucagcgguaaacugauccacgaguggugcugucgguccugcacccuuccaccccugcgauauaugggggaagauggauguugguacggcauggagaucagaccuauuaacgaaaaggaggagaauauggugaagucauuggugagcgccgguucuggcaaagucgacaacuuuacuauggggguucucugccuggcaauccuauucgaagaggugaugaggggaaaguucggcaaaaagcauaugauugcugggguacuguuuacauucgugcuccugcuuuccggacagauaaccuggcgcgauauggcccggacuuugaucaugauuggcaguaaugcaagcgacagaauggguaugggggucacauaucuggccuuaaucgcuaccuuuaaaauucagccauuccucgcgcugggauuuuuccuuaggaagcugacgucucgcgaaaaccuacuccugggcgugggcuuggccauggcaacuacccugcaauuacccgaggauaucgaacagauggcuaaugggauagcccucggacugauggcccuuaagcugaucacacaguuugagaccuaccaguuguggacugcucucguuucccugauguguucaaacacaauuuucacccuaacaguggcauggcgaacugccacccugauccuugcggguauuagucuccugccguugugccaaagcucguccaugcggaaaacggacuggcugccuaugacagucgcugccaugggcgugccacccuuaccucucuuuaucuucucucugaaggauacccuuaaacguagaagcuggccccugaaugaggggguuauggcagugggauuggucucaauacucgccaguucccugcuaaggaacgacguaccaauggcuggcccucugguggcaggugggcuucucauugccuguuauguuaucacuggaaccucugcggaucugacaguggaaaaggcugccgacgucacuugggaggaagaggcagaacagaccggcgugagccacaacuugaugaucacgguagacgaugacggcacaaugcgcauuaaagaugacgagaccgagaauauauuaacugugcugcucaagacagcccugcuuaucgucuccgggauuuuucccuacucaaucccagcuacccuguugguuuggcauacuuggcagaaacggacacagagaagcggagugcuaugggaugugccgaguccucccgaaacccaaaaggccgagcuggaagagggugucuacaggauuaagcagcagggcauccucgggaaaacgcaggugggaguuggcguacaaaaggaggguguguuccacacuauguggcaugucacccgaggggcagugcugacauauaacggaaaacgccuugaaccaaauugggcuucuguuaagaaagacuuaauauccuacggcggcggguggcggcugagcgcccaguggcagaagggagaggaagugcaagucaucgcgguggagcccgguaagaacccuaaaaauuuucagaccaugccaggcauuuuccagacaacuaccggggaaaucggagccauugcacucgauuucaagcccggcacgucggguucaccuaucauaaacagagaggggaaaguagucggauuguauggcaauggcgugguuacaaagaacgggggauacgugucugguauugcucagacuaaugccgagccggacggcccaacccccgaacuggaggaagagauguuuaaaaagaggaaccucacaaucauggaucugcacccugggaguggaaagacccguaaauaucuuccagcuaucguccgcgaagcaauuaagcggagacugaggacuuugauccuagcccccacccgagugguugccgcugagauggaggaagcgcugaaaggccucccuauacgguaccaaacaacggcaacuaaguccgagcacaccgguaaagaaauuguggacuuaaugugccaugccacauucaccaugcgccugcuuagcccggucagagugcccaauuauaaccugaucauuauggaugaggcucacuuuacugacccagccucuaucgcagccaggggguacauaagcacacggguaggaaugggcgaagcugcggccauuuucaugaccgcaacgccucccggcacugcugaugccuuuccacaguccaaugcaccuauccaggacgaggagcgagacauccccgaaagaucauggaacagugggaaugauuggauuacagacuucgccggaaagaccgugugguuuguuccaagcaucaaggcugguaacgauauugccaacugucuccgcaaaaauggcaagaaagucauacaguugucuaggaagaccuucgacacugaguaccaaaaaacaaagcugaacgauugggacuuuguggugaccacagauaucuccgaaaugggggcgaauuucaaggcagaccgugucauugauccgcggagaugccucaaaccuguaauccugacugacggacccgagagggugauccuugccggcccaaugcccguuacgguggcuucagccgcucagcgccgagguagagucgggcggaacccucagaaggagaaugaucaguauauuuuuaccggccaaccacuaaacaaugacgaagaccaugcacacuggacagaggccaaaaugcuguuggauaacauaaauacucccgaaggaaucauuccugcuuuauucgagccggaaagggagaagagugccgcaaucgacggcgaguaccgccugaaaggggaaagccguaagaccuucguggagcucaugagacggggagaucugccaguuuggcuugcgcauaaaguggccuccgaagguauuaaguauacagacaggaaguggugcuuugauggcgagcgcaacaaucagauccuggaagagaacauggacgucgagauauggaccaaagaaggggagaagaaaaagcuccgacccagaugguuggaugcucggacuuacucugacccucuggcccuaaaagaauucaaggauuuugcagcuggaaggaagucgaucgcccuggaccucgugacggagauuggccgcguacccagccaccuugcacacagaaccaggaaugcccuggauaacuuagugauguugcauacaucagaacacggugggcgggcuuaucgucaugcgguugaggagcugccagaaacuauggagacccuccugcuucugggccucaugaucuugcugacaggaggcgucauguuauuccuaauuuccgggaaaggaguggguaagaccaguaucggccugauauguguggucgccucuagcgggaugcucuggauggcagacauuccucuucaguggaucgcuuccgccauuguucuggaauuuuucaugaugguguugcugauccccgagccagagaaacagcgcacuccucaagauaaucagcucgccuacguagugauaggaauccugacacuugcagcuauugucgccgcgaacgaaaugggccuccuggagacgaccaagcgagacuuggguaugucaaaagaaccggggguggcuucucccacuagcuaucuggacguugauuuacacccagccagugcauggacacuauacgccguggcuaccaccgucaucacaccuaugcugagacacacuauugagaauuccacggcaaacguaagccucgccgcgaucgcuaaccaggccgugguucuuaugggccuggacaagggauggcccauaucuaagauggauuugggcgugccacugcucgcacuggggugcuacucacaagucaauccucuuaccuuaacagccgcugugcugcucuuggucacucauuaugccauuaucggacccggccugcaggcaaaagcuaccagggaagcccagaagcggacagcggccgguaucaugaaaaacccgaccguggacgggauuaugacuaucgaucuagacccaguuauauacgauuccaaguuugagaaacagcugggacaagugaugcuccuuguacugugugcagugcaguugcugcucaugcgcacgaguugggcuuucugcgaggcccugacauuagcaaccggcccuauuacuacccuuugggaagguagccccggcaaguuuuggaauacaacuaucgcugucucgauggccaacauuuucagagggucuuaucuggccggagcgggccucgcuuuuuccaucaugaagagcguugggaccggaaaaaggggcacagguucacagggggagacgcuaggagaaaaguggaaaaagaaacugaaucaguugagucggaaggaguucgaccuguacaaaaagucuggcauaaccgaaguggaucgaacugaggcaaaggagggucucaaaagaggcgaaaucacacaccaugccgucucccgcgggagcgcuaagcuucaaugguuuguggagaggaacaugguaauuccagaaggacgggugaucgaccugggcugugggcguggaggcuggucauauuacugcgccgguuugaaaaagguuaccgaggugagaggguauacuaaaggaggccccggccacgaagagccugucccgaugaguacauacggguggaauauugugaagcugaugagcggaaaggaugucuucuaccuccccccagagaaaugugacaccuuacugugcgauaucggugaauccucuccuagccccacgguggaggaauccaggaccauucgcguucuuaagaugguagagccuuggcugaaaaacaaucaguucuguaucaaggugcuaaacccauauaugcccgcagucauagagcaucucgaacggcugcagcgaaaacacggcgggauguuggugagaaauccucugucaaggaacucuacacacgagauguacuggauuaguaauggaacuggcaacaucguuucgagcgugaauauggucucccgccuccuucugaaccgguuuaccaugacauauagacguccaacuaucgaaaaggacguggacuuaggugccgggaccaggcauguaaacgcugagcccgaaacaccgaauauggaugugauuggagagcggauacgccgaaucaaggaggaacacucuucaaccuggcauuacgacgaugagaacccuuauaaaacuugggcguaccacggcagcuaugaaguuaaggccacgggcuccgcaaguucuaugauuaauggggucgugaaacuguugacaaagccaugggacgugguccccaccguuacucagauggcuaugaccgauacaacgccuuucggacaacagagaguguuuaaagagaagguagacaccaggacuccaaagcccaugccggguacacggaaagugauggaaaucaccgccgaguggcucuggcgcacucugggcagaaacaagaggccucgacuaugcacacgggaggaauucaccaaaaagguccguacaaaugcagccaugggggcuguguuuacugaggaaaaccagugggauagcgccaaagcggcaguugaggacgaagaguucuggaagcuuguggauagagagcgcgaacugcacaaacucggaaaguguggcucaugcgucuacaauaugauggguaagagggagaaaaagcugggggaauuuggaaaagccaagggcucccgggcuauuugguacaugugguugggcgccagauaucuggaguucgaggcacucggguuucuuaacgaagaccauugguucagucgcgagaauagcuacucuggaguggaaggugagggccugcacaaauuaggguauauccugagggauauauccaagauccccggaggcgcuauguacgccgacgacaccgcugguugggauacgcgaauuaccgaagacgauuugcauaacgaggagaagaucacacaacagauggacccagaacaccggcagcucgccaaugcaauuuuuaaacugacuuaucagaacaagguaguuaaagugcaaagaccuacccccaaggggacagucauggauaucauaucaaggaaagaccagcgcggaagcggccaggugggcacuuacgggcuaaauaccuucacgaacauggaggcgcagcuuauucgucaaauggaaggagagggugugcugucgaagacagaucucgaaaauccacaucuguuggagaagaaaaucacccagugguuagagacuaagggcgucgaacggcugaaaagaauggccaucucuggggacgauugcguugugaagcccauugacgauagguuugcuaacgcccuccuugcacugaacgacaugggaaaaguacgcaaggauauaccucaguggcagccaaguaagggcuggcacgacuggcaacaggugccguucuguucccaccauuuccacgagcuaaucaugaaagacggucgaaagcuggucgugcccugccggccucaggaugaacucauugggagagcuaggaucagccagggagccggcuggucauugaaagagacagcaugucugggcaaggccuaugcgcaaaugugggcucuuauguacuuucaucgcagagaccugcggcucgccuccaaugcaauuugcucugccguuccagugcacuggguccccaccagcaggacuaccuggaguauccacgcucaucaccaguggaugacaacggaagauauguuaauaguguggaaccguguauggaucgaggacaauccuuggauggaggauaaaaccccaguuacuacaugggaagacgugcccuaccuggggaagcgagaggaucagugguguggauccuugauuggucugaccagccgcgccacuugggcacaaaacauccucacagcuauucagcaggucagaucucuuaucggcaaugaagaguuccuggacuauaugccuucaaugaagcgguuuaggaaagaggaagagagugaaggggccauuugguga

SEQ ID NO: 15662 - RNA, 9873 nt, Artificial Sequence
  derived and/or modified CDS sequence (opt3) from DENV-3__HQ332170__SS-prME
accagccugugccucaugaugauccuucccgccgcucuggcauuccacuugaccuccagggacggcgaaccuaggaugauuguggggaagaacgaacggggaaaaucuuuacuguuuaagacugccucagguauaaauauguguacgcuaaucgcgauggaucucggcgaaaugugcgacgauaccguaacauacaaauguccacauauuacugaaguugaaccggaagacaucgauugcugguguaaccugaccaguacaugggugaccuaugggacuugcaaucaggcuggagaacaccgccgagacaagcguagcguagcccuugcaccccaugugggcaugggucuggauacaagaacccagacguggauguccgccgagggggcuuggaggcagguagaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucaacuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgacagaggccauccucccagaauauggaacccuuggccuggagugcucuccgcgaacugguuuggacuucaaugagaugauccuacugaccaugaaaaacaaggcguggauggugcauagacagugguuuuucgaucucccccugccuuggacaagcggggccaccacugaaacaccaacguggaauaggaaagagcuucugguaaccuuuaagaacgcacacgcuaaaaagcaagaaguuguggucuugggcucccaggagggagccaugcacacugcucucacaggcgccaccgaaauucaaaauucagggggaacaaguauauucgcaggucaucugaagugucgguuaaaaauggacaagcuggagcuaaaaggcaugagcuacgccaugugcacuaacaccuuugugcucaagaaagaggucucugaaacgcagcacgggaccauccugauuaagguggauuacaagggagaggacguucccuguaaaaucccuuucuccacagaagauggccaagguaaggcucauaacgggcgucuuauaacugcgaauccagugguaaccaaaaaggaggagcccgucaacauugaagcagagccgccuuucggcgaaucaaauaucgugaucggaauuggcgacaacgccuugaaaaucaauugguauaagaaggggagcaguauuggaaaaauguuugaggcuacagcccgcggugcaagaaggauggccauacugggcgauacugcuugggacuucgggucuguuggaggcgugcucaacucccuggguaagaugguccaccagaucuuugggagcgccuacaccgcacuuuucucgggcgugucuuggguaaugaaaauuggaaucggcgugcuguugacguggaucgggcucaauuccaagaacacaucaaugaguuuuagcugcauugcgauaggaaucauuacccuguauuuaggcgcuguuguccaggccgauacugguugugugaucaauuggaaagggaaggaacugaagugcggauccggcauuuucgugacaaacgagguccauaccuggacugagcaguacaaauuucaagcagacucucccaagcggcuagccaccgcuaucgccggugcaugggaaaauggcguuugugggauacgaagcacaacgcgcauggagaaccuccuguggaaacagaucgcuaaugaacuuaacuauauuuugugggagaauaacaucaagcugaccguggugguaggagauauuaucggcguccucgaacaggggaaaagaacucugacaccacagccuauggaguuaaaguacucauggaaaaccuggggaaaggccaagauagugacagcggagacucaaaacaguuccuucauuaucgacggccccaauaccccagaaugccccagcgccucuagggcuuggaacguuugggagguggaagacuaugguuuuggggucuucacgacaaauauuuggcugaaacuucgggagguguacacccagcagugugaucaccgcuugaugucagcagccguuaaggacgaaagagcugugcacgccgauaugggauacuggaucgagagucagaaaaacggcagcuggaagcucgagaaagcaucccugauagaaguaaagacuugcaccuggccuaagucucauacacuauggucgaaugguguccuggagagcgacaugaucauuccaaaaucccucgcgggcccgaucucacaacacaacuauaggcccggguaccauacucagaccgccggaccuuggcaccugggcaaacuugaauuggauuuuaauuauugcgaggggacaacgguggugauuaccgagaacuguggaacucguggcccaagucugcggacaaccacugucucugguaaauuaauccacgaauggugcugucgaagcugcacacucccaccucugagauacaugggggaggacggauguugguauggcauggaaauaaggccaauuuccgagaaggaagagaauaugguuaaaucacuugugagcgcugguucuggcgagguagauaacuucaccaugggggugcugugcuuggccauccucuuugaagaggucaugcgcggaaaguucggcaagaaacauaugaucgcagggguguucuuuacguucguucugcuacuguccggacagauuacuuggcgggacauggcucacacccucaucaugauuggcaguaaugccagcgauagaauggguaugggggugacauaccuggcacuuauagccaccuuuaagauccaacccuucuuggcucugggauuuuucuuaaggaaacucacuucucgcgaaaaccugcuucugggcgucggccuagcgauggccacaacccuccagcugccggaggacauugaacagauggcaaaugggaucgcuuugggacugauggccuuaaagcucauuacacaguuugagacuuaucaacuguggaccgcccuuaucucccugacguguucaaacacaauauucaccuugacuguggcuuggcgaaccgcaacacucauccuggccgguguuagucuacugccugugugccagagcucguccaugcggaaaacugauuggcuuccaaugaccgucgcggcuaugggcguacccccucucccccuguuuauuuucucuuugaaggacacgcugaagcguagaagcuggccauuaaaugagggggugauggccguuggacucgugucaauccuggcaaguucccuucugaggaacgaugucccuauggccggccccuugguggcuggugggcuccugauugcauguuacguaaucacaggaaccucugccgaccuaacuguggaaaaagcggcugacgucacaugggaggaagaggccgaacagaccggcguuagccauaaccugaugauaacuguggaugacgauggcacaaugcgcauuaaggacgaugagaccgagaauauccuuacggugcuccugaaaacugcauuguuaaucgucuccgggauuuuuccauacucaauaccggccacccugcucguguggcacacauggcagaagcaaacccagcggagcggaguucugugggacguaccuagucccccagaaacacagaaagcugagcuugaagaggguguguauagaaucaagcagcaaggcauuuucgggaaaacucaggucggagugggcguucagaaggaggguguguuucauaccauguggcacgucacgagaggggccgugcugacauacaacggaaagcgauuggaacccaauugggcaucugucaagaaggaucuaaucuccuauggcggcggguggcgccugagcgcucaauggcagaaaggagaggaaguccaggugauugccguugagccugguaagaaccccaagaauuuccagacuaugcccggcaccuuccaaacaaccacuggggaaaucggagcgauagcccucgacuuuaagccuggcaccucggguucaccgaucauuaaccgggaggggaagguggucggacuguacggcaauggcgugguuaccaagaacgggggauaugugucugguaucgcacagacgaaugcugagccagauggccccacuccugaacuugaggaagagauguucaagaaaagaaacuuaaccauuauggaccugcacccagggaguggaaagacaaggaaauaccuccccgccaucguccgugaagcuauaaagcgccgguugagaacccugauucucgcaccuacuagggugguagccgccgagauggaggaagcucugaagggccuuccgauccgauaucagacaaccgcgacgaaauccgagcauacuggucgggaaaucguggaucugaugugccacgcaacauuuaccaugcgcuugcuaagccccguuagagucccaaauuacaaccugauuaucauggacgaggcccauuucaccgauccugcuucuauagccgcaaggggguacauuagcacucgggugggaaugggcgaagccgcugcgaucuuuaugacagccacacccccaggcacagcagacgcuuucccucaguccaaugcccccauucaagacgaggagcgagauaucccagaaagaucauggaacagugggaaugaguggauaacugacuuugcaggaaagacggugugguucgucccgagcauuaaagccgguaacgauaucgcuaacugucuccgcaagaauggcaaaaagguaauccaguuaucuaggaagaccuuugacacagaauaucagaaaacuaagcugaacgauugggacuucgugguuaccacagauauuuccgagaugggggccaauuuuaaagcggaccgugugaucgauccucggagaugccuuaagcccgucauucugaccgacggaccagagagggugauacucgcaggccccaugccuguuacugccgcuucagccgcucagcgccgagguagaguggggcggaacccacaaaaagaaaaugaucaguacaucuucacgggccagcccuugaacaaugacgaggaccacgcacauuggaccgaagccaagaugcugcucgauaacauuaauacaccugagggaaucaucccggcucuguucgaaccagagagggagaagagugccgcaauugacggcgaauaucgccuuaaaggggagagccguaagacuuuugucgaacuaaugagacggggagaucugcccgugugguuggcgcacaaaguagccuccgaggguauaaaguacaccgacaggaaauggugcuucgauggccagcgcaacaaucaaaucuuagaagagaacauggacguggagauuuggacaaaggaaggggagaaaaagaagcugcgaccuagauggcucgaugcucggaccuauucugacccccuggcccuuaaagaauuuaaggauuucgcagcuggaaggaaaucgaucgcccuggaccucguuacugagauuggccgcgucccaagccacuuggcacauagaacaaggaaugcccuggauaaccuagugaugcugcacacgucagaacauggugggaaggcuuaccggcacgcgguggaggagcucccugaaaccauggagacucuucuguuauugggccugaugauccuccugacaggaggcgccaugcuuuuucugauauccgggaaaggaaucgguaagaccaguauuggccucaucugugucauugcaucuagcgggauguuguggauggcugaaaucccccugcaguggauagccuccgccauuguuuuagaguucuuuaugauggugcuacugaucccagagccugaaaagcagcguaccccgcaagacaaucagcucgcauauguagugauuggaauccuuacacuggcugccauaaucgcggcuaacgagaugggcuugcuggaaacuacgaaacgcgaucucgguaugucaaaggagcccggggucgugucuccaaccagcuaccuggacguugaccuucacccugccagugcauggacacucuacgccguggcuacuaccgucauuacacccaugcugcgacauaccaucgaaaauuccacugcaaacgucagcuuggccgcgauugcuaaccaggccgugguucugaugggcuuagauaaaggauggccaaucucuaagauggaccuaggcgugccucugcucgcacuugggugcuauucacaggucaauccccugacguugacagccgcugugcugcuccugauaacccacuacgccauuaucggaccgggccuucaagcaaaagcuacuagagaggcccagaagaggaccgcggccgguaucaugaagaacccaacagucgaugggauuaugacuaucgacuuagauccugugauauaugacuccaaauucgagaagcagcugggacagguuaugcucuuggugcugugugcaguacaacuacugcucaugcggaccaguugggcucuuugcgaagcccugacauuggcaacgggccccauuaccacucugugggaggguagcccaggcaaauuuuggaauacaaccaucgcugugucgauggccaacauuuuccgcgggucuuaccucgccggagcgggccuggcuuuuuccaucaugaaaagcgucgggacuggaaaaagaggcacagguucacagggggaaaccuuaggagagaaguggaagaagaaacuuaaucagcugaguaggaaagaguucgaucucuauaagaaaucuggcauaacggagguugaccggaccgaggcaaaagaaggucuaaaacgaggcgagaucacacaucacgccguguccagagggagcgcuaagcugcagugguuugucgaacgcucaauggugauucccgagggaaggguaaucgauuugggcugugggcggggaggcuggaguuacuauugcgccggucugaagaaagugacugaaguucguggguacaccaagggaggcccuggccaugaggagccggugcccaugagcacauacggguggaacauugucaaacucauguccggaaaggacguguucuaucuuccaccugaaaaaugugauacucuguugugcgacaucggugagucuagccccuccccuaccgucgaagagucaagaacaauuagggugcugaagaugguugagccauggcucaagaauaaccaauucuguaucaaaguauuaaaucccuacaugccuaccgugauagaacaccuggagcgccuucagcggaagcacggcgggaugcugguccgaaacccacuaucuagaaauaguacucaugaaauguauuggauuucgaacggaacgggcaauaucguggcaagcguuaacaugguguccaggcuccuguugaaucgcuuuacaaugacccaccggagacccacuaucgagaaagaugucgaccugggugccgggacccgucaugugaacgcugaaccggagacaccuaacauggacguaauuggagagaggauaaagcggaucaaagaagaacacaauucuacguggcacuacgaugacgaaaacccauauaagaccugggcguaccauggcucauaugaggugaaggccacuggcagcgcauccaguaugauuaaugggguugucaaacuccuuacaaagcccugggauguggugccuauggucacccagauggcuaugacugacacaaccccauucggacaacagcgcguuuuuaaagaaaagguggauacacgaacucccagaucuaugccggguaccaggcggguaaugggcaucacggccgaguggcuguggcgcaccuuagggagaaacaaaaagccuaggcugugcacacgagaggaguucacuaagaaagugcggaccaaugcagccaugggagcugucuuuacagaggaaaaccagugggacagcgccaaggcggcaguggaggaugaagacuucuggaaauugguugaucgugagagagagcuccacaagcugggcaaaugugguucaugcguguacaauaugauggggaagcgcgagaaaaagcuaggagaguuuggcaaggccaaaggcuccagggcuauuugguacauguggcuuggggcccgguaucuggaguucgaggcacucggauuucugaacgaggaccauugguucaguagagaaaauagcuacucuggugucgagggcgaaggguugcacaagcugggauauauccuccgcgauauauccaaaauccccggcggugcuauguacgccgacgacacugcugggugggauaccaggauuacggaggacgaucuucauaacgaagagaagaucacacagcaaauggacccagagcacaaacagcuggccaaugcaauuuuuaaguuaaccuaucagaacaaggugguaaaaguucagcgaccuacucccacaggaaccgugauggauaucauaucacggaaggaccaaagaggcagcggccaggucgggacuuacggacugaauaccuucacaaacauggaagcgcaguugauuaggcagauggagggugaaggcgugcucucgaaagccgaucuggagaauccacaccuacccgaaaagaaaaucacgcaauggcuugagaccaaggggguggagcgccugaagcguauggcuaucucuggagacgauugcgucguuaaaccuauugacgaucgguuugccaacgcacuccuggcuuugaacgacaugggcaaggugagaaaagauauaccacaguggcagccgaguaaggguuggcaugacuggcagcaaguacccuucuguucccaccauuuccacgaauuaaucaugaaagacgggaggaagcugguggucccuugccgcccacaggaugagcucauuggacgagcccggaucagccagggcgcaggcuggucacuuagagaaacugccugucuggggaaggcguaugcucaaauguggucccuaauguacuuucacaggcgcgaccugagacucgccucuaaugcaauuugcagcgccgugcccguucauugggugccuacaagucggaccacuugguccauccacgcucaucaccaguggaugacaaccgaggauauguugacggucuggaacaggguguggauagaagacaauccauggauggaggauaaaacacccguaaccacuugggagaacguuccuuaccugggaaagcgugaagaccaguggugugguagccuuaucggccugaccucucgagccacaugggcacagaauauuccgacugcuauccaacaggugcgcucacucauugggaacgaggaguucuuagauuauaugccaaguaugaaaagauuucggaaggaggaggaauccgagggagccaucugguga

SEQ ID NO: 15663 - RNA, 9873 nt, Artificial Sequence
  derived and/or modified CDS sequence (opt3) from DENV-3__AY858038__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuauucucccugaauacggaacccuuggccuggagugcagcccacgaacugguuuggacuuuaaugagaugauccuacugaccaugaaaaacaaggccuggaugguacauagacagugguucuuugaucucccgcugcccuggacauccggggcgaccacugaaacaccuacguggaauaaaaaggagcuucugguuaccuucaaaaacgcccacgcaaagaagcaagaaguggucguguugggcucacaggagggagcuaugcacacugcccucacaggcgcuaccgaaauccagacaagugggggaacuagcauuuuugccggucaucugaaauguagguuaaagauggacaaacuggagcuaaagggcaugucuuaugcaaugugccucaaugccuucguccugaaaaaggagguguccgaaacccagcacgggacgauacuuaucaagguugaguacaaaggagaagaugcuccauguaagauucccuucucaaccgaggacggccaagguaaagcgcauaacgggcgguugaucacagcaaacccugugguaacuaagaaagaggaaccagucaauauagaggccgaacccccguuuggcgagagcaacauugugaucggaaucggcgauaaggcucugaagauuaauugguacaaaaaggggaguucuaucggaaaaauguucgaagccaccgcacguggugcccgcagaauggcuauucucggcgacacagccugggauuuuggguccguuggaggcgugcugaacagccuugguaagaugguccaccagauauucgggucggcauauacugcgcuguuuucuggcguguccuggaucaugaaaauuggaaucggcguauugcucaccuggaucgggcugaauucaaagaacacgaguaugagcuucuccugcauugcuauaggaaucauuacauuauaccugggcgccgugguucaggcagacauggguugugucaucaauuggaaggggaaagagcuaaagugcggaucuggcauuuuugugaccaacgaggugcauacuuggacagaacaguauaaauuccaagccgauagcccuaagaggcucgcuaccgccaucgcaggugcuugggagaauggcgucugugggauacggucaacuacccgaauggaaaaccugcuuuggaaacagaucgccaaugaguugaacuacauucugugggaaaauaacauccgccucacaguuguggugggagacacgauuggcguacugcagcaggggaagagaaccuuacccccacaaccuauggagcugaaauauaguuggaagacuuggggaaaggcgaaaaucgucacagccaagacccagaauuccagcuuuauaauugauggccccaacacaccagaguggcccucugcuucaagggcauggaacgugugggaaguugaggacuacgguuucgggguguuuacuaccaauaucuggcuuaaauugcgggaaauguauacgcagcucugcgaccaccgccugaugagugccgcugucaaggaugagagagccgugcacgcagacaugggauacuggauugaaagccagaaaaacggcuccuggaagcuagagaaggcgucucugaucgagguuaaaacauguaccuggccuaagucgcauacucucuggagcaauggugugcuggaauccgauaugauaaucccaaaaucacuugccggcccgauuagucaacacaacuacaggcccggguaucauacccagacagcuggaccuuggcacuugggcaagcuggaguuagacuucaauuacugcgaagggacuaccguagucaucacagagaacugcggaacgcguggcccaucucuccggaccacuacagugagcgguaaacugauucacgagugguguugccgauccuguacccuucccccucugagauauaugggggaagauggaugcugguacggcauggagaucaggccaauaaaugaaaaggaggaaaacauggugaagucauuggucagcgccgguucuggcaaaguugacaauuuuacuaugggggugcucugucuggcaauucuauucgaggagguaaugcgcggaaaguucggcaaaaagcauaugaucgcuggggugcuguuuacauucguccuccugcuuuccggacagaucaccuggcgggauauggccagaacguugauuaugaucggcaguaacgcaagcgacaggauggguaugggggugacuuaucuggccuuaauugcuaccuuuaaaauacaacccuuccucgcgcugggauuuuuccuucgcaagcugacaucucgagaaaaucuacuccugggcguuggcuuggccauggcaaccacucugcaguuaccggaggauaucgaacagauggcuaacgggauugcccucggacugauggcccuuaagcuggugacacaguuugagaccuaccaauuguggacagcucucgucucccugaugugcucaaauacuaucuucacccuaacgguggcauggcggacagccacccugauucuugcggguaucagucuccugccuguuugucagagcucguccaugcguaaaacugacugguugccaaugaccguggcugccaugggcguccccccucugcccuuauuuauauucucucucaaggauacacugaaaagaaggagcuggccacuuaacgaagggguaauggcagugggacugguuucaaucuuggccaguucccuccugcgcaaugacgugccuauggcuggcccccuagucgcaggugggcugcuuauugccugcuaugugaucacuggaaccucugcggaucucacgguagagaaggcugccgacgugauuugggaggaagaggcagaacagacaggcgucagccacaaccugaugaucaccguugacgaugacggcacuaugcggauaaaagaugacgagacagaaaacauuuugaccguguuacugaagacugcccuccugaucguguccgggaucuuuccauacucaauuccggcuacacuucuggucuggcauaccuggcagaaacaaacgcagagaagcggaguguugugggauguuccuagucccccagagacucagaaggccgagcuagaagaggguguauacaggauaaagcagcaaggcaucuucgggaaaacccaggugggagucggcgugcagaaggaagguguuuuucacacaauguggcaugugacccgaggggcaguccugacacacaauggaaaacgccucgagcccaacugggcuucugugaagaaagaccugauuuccuauggcggcggguggcggcuuagcgcccaauggcagaagggagaggaaguacaggucaucgcgguggagccugguaagaauccaaaaaacuuccagacuaugcccggcauuuuccaaaccacgacaggggaaaucggagccauagcauuagauuuuaagccuggcacuucggguucaccgaucauuaauagagaggggaaaguugugggacuguacggcaacggcgucgugaccaagaaugggggauauguuucugguaucgcucagacaaacgccgaaccagacggccccaccccugagcucgaggaagagauguucaaaaagaggaauuugacuauuauggaucugcacccagggaguggaaagacccguaaauaccuccccgcuaucauacgcgaagcaauuaagcggagacugaggacacuuauccuggccccuacgcgaguggucgccgcugagauggaagaggcguugaaaggccuaccgauccgguaucagacuaccgcaacaaaguccgagcauaccgguaaagaaauuguggaccugaugugucacgccacuuuuacaaugcgccucuuaagccccguaagagugccaaacuacaaucugaucauaauggaugaggcucauuucaccgacccugccucuauugcagccaggggguauaucagcacgcggguuggaaugggcgaagcugcggccauuuuuaugacugcaacacccccaggcaccgcugaugccuucccucaguccaacgcacccauccaagacgaggaacgagacauaccagagagaucauggaauagugggaacgauuggauuaccgacuuugccggaaagacugucugguucgugccgagcaucaaggcugguaaugauaucgccaacugccuucgcaaaaacggcaagaaagugauucagcugucuaggaagacauuugacaccgaguaccagcguacaaaacucaaugauugggacuucgucguaacuacggauaucuccgaaaugggggcgaacuuuaaggcagaccgggugauugauccuagaagguguuugaagcccguuauacugaccgacggaccagagcgcgugauccucgccggccccaugccugucacaguggcuucagccgcucagcgaagaggucggguugggaggaauccacaaaaagaaaacgaucaguacauuuucacuggccagccccugaauaacgacgaggaccacgcacauuggaccgaggccaagaugcuucuagauaauaucaacacaccugaaggaaucauuccggcucuguucgagccagaacgcgagaaaagugccgcaauagacggcgaauaucguuugaagggggagagcagaaaaaccuuuguggaguuaaugcggaggggagaucugcccgucuggcucgcgcacaagguggccuccgaagguaucaaauacacugaccgcaaguggugcuucgauggcgagcgaaauaaccagauucuggaagagaauauggacguagaaaucuggacgaaggagggggagaaaaagaaacuuagaccucgguggcuggaugcuaggaccuauucugacccccucgccuugaaggaauuuaaagauuucgcagcuggacgcaagucgauugcccuggaccuagugacagagaucggcagaguuccaagccaccuggcacauaggacucggaacgcccucgauaaucuugucaugcugcacaccucagaacauggugggcgugcuuaccgccacgcgguggaggaauuaccugagacaauggagaccuugcugcuccugggccuuaugauacugcucacuggaggcgccauguuguuucugaucuccgggaagggaauugguaaaacaaguaucggcuuaauuugcguggucgcaucuagcgggaugcuauggauggcugacguuccccugcaauggaucgccuccgccauagugcucgaauucuuuaugaugguacuucugauuccagagccugaaaagcagcgaacgccgcaggauaaccaauuggcauauguggucaucggaauucugacccucgcugccaucguggcggcuaaugagaugggccugcuugagacuacaaaaagagaccucgguaugucaaaggaacccgggguugugucuccaaccagcuaccuggacgucgauuugcacccugccagugcauggacccuguaugccguagcuacaacugugauaacgcccauguuaaggcauaccaucgagaacuccacagcaaauguuagccuagccgcgauugcuaaccaggccgugguccugaugggccucgacaaaggauggccaaucucuaagauggaucuuggcgugccucuguuggcacugggguguuacucacaggucaacccccucacucugaccgccgcugugcuuuuacugguuacacacuacgccauuaucggaccgggccuccaggcaaaggcuacccgggaagcccaaaaacgcacugcggccgguauaaugaagaauccaacgguggacgggauuaugacaaucgauuuggacccuguaaucuaugauuccaaauucgagaagcagcugggacaggugaugcuacugguccucugcgcaguucagcuucuguugaugagaaccaguugggcuuuuugugaagcccugacucucgcaaccggccccauuacaacucugugggaggguagcccaggcaaauucuggaacaccacaaucgcugugucgauggccaauauauuuagggggucuuacuuagccggagcgggccuugcuuucuccauuaugaagagcgucgggacgggaaagcggggcaccgguucacaaggggagacucugggagaaaaauggaagaaaaagcucaaccagcuaagucgaaaagaguuugaccuguauaagaaaucuggcaucacagaaguggauagaaccgaggcaaaggaagguuugaagcgcggcgagauuacucaucacgccguauccagggggagcgcuaaacugcagugguucguggagcggaauaugguuauccccgaaggacgugugauagaccucggcugcgggagaggaggcuggucauacuauugugccggucuuaagaaagucacagaggugaggggguacaccaagggaggcccuggccaugaagagccgguccccaugaguacguauggguggaacaucgugaaacugaugagcggaaaggauguuuucuacuugccaccugaaaagugcgacacccugcucugugauauuggugaguccucucccagcccuacaguagaggaaucccgcacuauccggguguuaaaaauggucgagccauggcugaagaauaaccaguuuugcauuaaagugcuuaaucccuacaugccuaccguuaucgaacaccuggagcgacuacaaagaaagcacggcgggaugcucgugaggaacccacugucacgcaauucuacacaugagauguauuggauuaguaacggaacuggcaauaucgucucgagcgugaacaugguaucccgguugcugcucaauagauucaccaugacacaccguaggcccaccauagaaaaagacguggaccuuggugcagggacucggcauguuaacgccgagccggaaacgccuaacauggaugucauuggagagcgcauccgaagaaucaaggaagagcacucuucaacauggcacuacgacgaugagaauccauauaagaccugggcuuaccauggcagcuaugaagugaaagcgacuggcuccgccaguucuaugauuaacgggguggucaagcuguuaaccaaacccugggacguugugccuacaguaacgcagauggcaaugaccgauacuacaccauuuggacagcaaaggguguucaaggagaaagucgacacccggacuccccgcccgaugccugguacaagaaaggugauggaaauaaccgcugaguggcuguggaggacauugggccgaaauaagcggccccgucucuguacuagagaagaguuuaccaaaaagguucgcacgaacgccgcaaugggggccguguucaccgaggaaaaucagugggauagcgcuagggccgcggucgaggacgaagaguuuuggaaacugguggaucgggaaagagagcuacacaagcuuggaaaaugcggcucauguguauacaacaugauggguaagcgcgagaaaaagcugggggaauucggaaaggcaaaaggcuccagggccaucugguauauguggcucggcgcucgauaccuggaguuugaagccuugggguuccugaaugaggaccauugguuuagucgggagaacagcuacucuggaguugaaggugagggccuccacaagcuuggguauauucugagagauaucuccaaaauuccaggaggcgcaauguacgcugacgacacagccgguugggauacuaggaucaccgaagacgauuuacauaaugaggaaaagauaacacagcagauggacccugagcaccgccaacuggcuaacgccaucuucaaauugacuuaucagaauaagguggucaaggugcagcgucccaccccaaaagggacggugauggauauuaucucacggaaggaccagagaggaagcggccaagucggcacauacgggcucaacaccuuuacuaauauggaggcacagcugauuaggcagauggaaggagaggguguucuaucgaaagcggaucuugaaaacccccaccugcucgagaagaaaaucacacaguggcuggaaaccaagggcguggagcgcuugaagcgaauggccauaucuggggacgauugcguagugaaaccuauugacgaucgguucgcuaaugccuuacuggcacucaacgacaugggaaaggucagaaaagauaucccacaauggcagccgaguaagggcuggcaugacuggcagcaggugcccuucugcucccaccauuuucacgagcuuaucaugaaagacgguaggaagcugguugugccuugucgcccacaagaugaacuaauugggagagcucggauaagccagggagccggcuggucacugaaggagacugcaugccucggcaaagccuaugcgcagaugugggcuuugauguacuuccacaggcgugaccugcgacuugccuccaacgcaaucuguucugccguccccgugcauuggguaccuaccagccgcacaacguggaguauucacgcucaucaccaauggaugaccacugaagauaugcugacaguuuggaauagaguguggaucgaggacaacccauggauggaagauaagacccccgucacuacaugggaggacgugccuuaucucgggaaacgggaggaucaguggugcggauccuuaauuggucugaccagcagggccacgugggcacagaauaucuugacagcuauacagcaaguucgcucucugaucggcaacgaagaguuucucgacuacaugccgucaaugaagagauuccggaaagaagaggagagugaaggggccauuugguga

SEQ ID NO: 15664 - RNA, 9873 nt, Artificial Sequence
  derived and/or modified CDS sequence (opt3) from DENV-3__AY858039__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagagcacaaacguggauguccgccgagggggcuuggaggcaggucgaaaaaguggagacuugggcauuccggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacgucacgaccgauagccggugcccuacacagggcgaagcuauuuugccagaggaacaggaccagaauuauguuuguaaacacacuuacguggaucgcgguugggggaacggaugcggccucuuuggcaaggggagucugguaaccugcgccaaguuccaauguuuagagcugaucgagggaaaagugguccagcacgaaaaucucaaguauacagugauaauuacuguucauaccggugaccagcaccaggugggcaacgagacacaaggggucaccgcagaaaucacuccccaggcuuccacgguggaggccauucuuccugaauacggaacacugggcuuggagugcucuccacgaaccggucuagacuuuaaugagaugauccugcucacuaugaaaaacaaggcguggaugguacauagacagugguucuuugaucugccgcuucccuggaccagcggggccacaaccgaaacuccuacauggaauaaaaaggagcuguugguuacguucaaaaacgcacacgcuaagaagcaagaaguggucgugcucggcucccaggagggagccaugcacaccgcucugacuggcgccacagaaauccagaccucagggggaacaaguauuuuugcaggucauuuaaaauguaggcugaagauggacaaacuagagcucaagggcaugagcuaugccaugugcucuaaugcuuucguccugaaaaaggagguguccgaaacucagcacgggaccauacuuaucaagguugaguacaaaggagaagaugcgccauguaagauucccuucucaacggaggacggccaagguaaagcacauaacgggcgguugaucaccgccaacccugugguaacaaagaaagaggaaccagucaauauagaggcugaacccccguuuggcgagagcaacauuaucaucggaauuggcgauaaggcccugaagaucaauugguacaaaaaggggaguucuauuggaaaaauguucgaagcaacugcccguggugcucgcagaauggccauacucggcgacaccgcaugggauuuuggguccgugggaggcguucugaacagccuugguaagauggugcaccagaucuucgggucggcguauacagcucuguuuucuggcgucuccuggauuaugaaaaucggaaucggcguguugcucacuuggauugggcugaauucaaagaacaccaguaugagcuucuccugcauaguaaucggaauuaucacguuauaccugggcgccgugguucaggcagacauggguugugucauuaauuggaaggggaaagagcuaaagugcggaucuggcaucuuugugacaaacgaggugcauaccuggacugaacaguauaaauuccaagccgauagcccuaagaggcucgcuacagccauagcaggugcuugggagaauggcgucugugggauccggucaaccacucgaauggaaaaccugcuuuggaaacagauugccaaugaguugaacuacauccugugggaaaauaacauuaagcucaccguuguggugggagacaucauaggcguacuggagcaggggaaacgcacauuaacgccccagccaauggagcugaaguauaguuggaagaccuggggaaaagcgaagauugucacugccgaaauccaaaauuccagcuuuauuaucgauggcccuaacacacccgagugcccaaacgcuucuagagcauggaaugugugggaaguugaggacuacgguuucgggguguuuaccacaaacauauggcuuaaauugagggaaauguauacucagcucugugaccaccggcugaugucagccgcugucaaggaugagcgcgccgugcacgcagacaugggauacuggaucgagagucagaaaaauggcagcuggaagcuagaaaaggcgucccugauugagguuaaaaccugcacguggcccaagucucauacacucuggucgaacggugugcuggaaagcgauaugaucauuccuaaaucccuugccggcccaaucucacagcacaauuacagaccgggguaucauacccaaacugcuggacccuggcacuugggcaagcuggaguuagacuucaacuacugcgaggggaccacaguagucauaacugaaaauuguggaaccaggggcccuagucuccguacaacgaccgugucugguaaacugauucacgaguggugcugucggagcugcacucuuccaccccugcgauauaugggggaagauggauguugguacggcauggagaucagaccuaucaacgaaaaggaggagaauauggugaaguccuuggucucagccgguagcggcaaaguugacaacuuuacaaugggggugcucugccuggcaauucuauucgaagagguaaugaggggaaaguucggcaaaaagcauaugaucgcuggggugcuguuuauuuucguccuccugcuuucuggacagauaaccuggcgcgauauggcccggacuuugaucaugauuggcuccaaugcaagugacagaauggguaugggggugacauaucuggccuuaaucgcuaccuuuaaaauucagccauuccucgcgcugggauuuuuccuuaggaagcugacgagccgcgaaaaccuacuccugggcguuggcuuggccauggcaacuacccugcaauuacccgaggauaucgaacagauggcuaaugggauagcccucggacugauggcccuuaagcugaucacacaguuugagaccuaccaguuguggacugcucucgugucucugacauguuccaacaccauuuucacacuaacugucgcauggcgaaccgccacgcugauccuugcggguauuucacuccugccggugugccaaaguagcucgaugcggaaaacagacugguugccuaugaccguugcugccaugggcgugccacccuccccucuguuuaucuucucuuuaaaggauacucucaaacguagaagcuggccccugaaugagggggucauggcaguaggacuugugucaauacuggccaguuccuugcucaggaacgacguuccaauggcuggcccucugguggcaggugggcuacugauugccuguuaugucaucaccggaacaucugcggaucuuacuguggaaaaggcugccgacguaaccugggaggaagaggcagaacagacgggcgugagccacaaccucaugaucacagucgacgaugacggcaccaugcgcauuaaagaugacgagacugagaauauacugacaguuuuguuaaagaccgcccugcucaucguguccgggauuuuucccuacucaaucccagcuacucugcuuguguggcauacauggcagaaacagacccaacggagcggaguccugugggaugugccgaguccucccgaaacgcagaaggccgaguuggaagaggguguuuacagaauuaagcagaggggcaucuucgggaaaacucagguaggagugggcguccaaaaggaggguguguuucacaccauguggcauguuacacgaggggcagugcuaaccuauaacggaaaacgccuggaaccaaauugggcuucugucaagaaagaccucauauccuacggcggcggguggcggcugagcgcccaguggcagaagggagaggaagugcaaguaaucgcggucgagcccgguaagaacccuaaaaauuuccagacaaugccaggcauuuuccagacuaccacgggggaaaucggagccauugcacuugauuuuaagcccggcacaucggguucaccuaucauaaacagagaggggaaagugguuggauuauauggcaauggcguggucacuaagaacgggggauacgugucugguauugcucagaccaaugccgagccggacggcccaacacccgaacuggaggaagagauguucaaaaagaggaaccucaccaucauggauuugcacccugggaguggaaagacucguaaauaucugccagcuaucguucgcgaagcaauuaagcggagacucaggacccugauccuugcccccacacgaguggucgccgcugagauggaggaagcgcugaaaggcuugccuauacgguaccaaacgacugcaaccaaguccgagcacacagguaaagaaauuguggaccuaaugugccaugccaccuuuacuaugcgccugcucagcccgguaagagugcccaauuauaacuuaaucauuauggaugaggcucacuucacagacccagccucuaucgcagccaggggguacauaagcacccggguuggaaugggcgaagcugcggccauuuuuaugacggcaacuccucccggcacagcugaugccuucccacaguccaaugcaccuauccaggacgaggagcgagacauccccgaaagaucauggaacagugggaaugauuggauuaccgacuuugccggaaagaccgucugguucgugccaagcaucaaggcugguaacgauauugccaacugucugcgcaaaaauggcaagaaagugauacagcuuucuaggaagacuuuugacacagaguaccaaaaaaccaagcugaacgauugggacuucgucguaacaacugauaucuccgaaaugggggcgaauuuuaaggcagaccgugugauugauccgcggagaugccucaaaccuguuaucuugacggacggacccgagagggugauccuggccggcccaaugcccgucaccguggcuucagccgcucagcgccgagguagaguugggcggaacccucagaaggagaaugaucaguauauuuucacaggccaaccacucaacaaugacgaagaccaugcacacuggacugaggccaaaaugcugcuugauaacauaaauacccccgaaggaaucauuccugcucuauucgagccggaaagggagaagagugccgcaaucgacggcgaguaccgccugaaaggggaaagccguaagacauuuguggaguugaugagacggggagauuuaccagucuggcuggcgcauaaaguggccuccgaagguauuaaguauaccgacaggaaguggugcuucgauggcgagcgcaacaaucagauccucgaagagaacauggacguagagauauggacuaaagaaggggagaagaaaaagcugcgacccagauggcuugaugcucggacguacucugacccucuggcccucaaagaauuuaaggauuucgcagcuggaaggaagucgaucgccuuggaccuggugaccgagauuggccgcguucccagccaccuagcacacagaacaaggaaugcccuggauaaccucgucaugcuucauacuucagaacacggugggcgggcuuaucgucaugcgguggaggagcugccagaaaccauggagacauuauugcugcucggccugaugauccuucugaccggaggcgccaugcucuuuuugauuuccgggaaaggaguggguaagacuaguaucggccugauaugugucguugcaucuagcgggauguuauggauggcugacauuccucuacaguggaucgccuccgccauugugcuggaauucuuuaugaugguacuccuuauccccgagccagagaaacagcgcacaccucaagauaaucagcuggcauacguggucauaggaaucuugacgcuggcugccauuguggcggcuaacgaaaugggccuccuggagaccacuaagcgagaccuugguaugucaaaagaaccggggguugugucucccacaagcuaucucgacgucgaucugcacccagccagugcauggaccuuguacgccguagcuaccacagugaucacuccuaugcugagacacacgauugagaauuccaccgcaaacguuagcuuagccgcgaucgcuaaccaggccgugguccuaaugggccuggacaagggauggcccauaucuaagauggaucucggcgugccacuucuggcauuggggugcuacucacaagucaauccucugacacucacugccgcugugcugcuuuuaguuacccauuaugccauuaucggacccggccugcaggcaaaagcuacaagggaagcccagaagcggaccgcggccgguaucaugaaaaacccgacuguggacgggauuaugacgaucgaucucgacccaguaauauacgauuccaaguucgagaaacaguugggacaagugaugcugcuaguccugugugcaguucagcuccuucugaugcgcacaaguugggcuuuuugcgaggccuugacccuggcaacuggcccuauuaccacacucugggaagguagccccggcaaguucuggaauacuaccaucgcugugucgauggccaacauuuuuagagggucuuaucuggccggagcgggcuuagcuuucuccaucaugaagagcgucgggacaggaaaaaggggcacggguucacagggggagacccuuggagaaaaguggaaaaagaaacugaaucagcucagucggaaggaguuugaccuauacaaaaagucuggcauaacugaaguggaucgaacagaggcaaaggagggucugaaaagaggcgaaaucacccaccaugccguaucccgcgggagcgcuaaguugcaaugguucguggagaggaacaugguuauuccagaaggacgggugaucgaccugggcugugggcguggaggcuggucauauuacugcgccggucucaaaaaggucacugaggugagaggguauacaaaaggaggccccggccacgaagagccugucccgaugaguaccuacggguggaauauugugaagcuuaugagcggaaaggauguuuucuaccugcccccagagaaaugugacacguugcugugcgauaucggugaauccucuccuagccccaccguagaggaauccaggacaauucgcgugcucaagauggucgagccuugguuaaaaaacaaucaguuuuguaucaaggugcugaacccauauaugcccacuguuauagagcaucuugaacggcugcagcgaaaacacggcgggaugcuagugagaaauccucucucaaggaacucuacccacgagauguacuggauuaguaauggaacaggcaacaucgucucgagcgugaauaugguaucccgccuguugcugaaccgguucacuaugaccuauagacguccaacaaucgaaaaggacguggaccucggugcagggaccaggcauguuaacgccgagcccgaaacuccgaauauggaugucauuggagagcggauacgccgaaucaaggaggaacacucuucaacguggcauuacgacgaugagaacccuuauaaaacaugggcuuaccacggcagcuaugaagugaaggcgaccggcuccgccaguucuaugauuaaugggguggucaaacuucugacuaagccaugggacguugugcccaccguaacacagauggcaaugacggauaccacuccuuuuggacaacagagaguguucaaagagaaggucgacacaaggaccccaaagcccaugccggguacucggaaagugauggaaaucacagcugagugguuauggcgcacccugggcagaaacaagaggccucgauugugcacacgggaggaauuuacuaaaaagguucguaccaaugccgcaaugggggccguguucacggaggaaaaccagugggauagcgcuagagccgcggucgaggacgaagaguuuuggaaacucguggaucgcgagagggaacugcacaagcuaggaaaauguggcucaugcguauacaauaugauggguaagcgggagaagaaacuuggggaauucggaaaggcaaaaggcuccagagccauuugguacauguggcugggcgcucgcuaucucgaguuugaggcccugggguucuugaacgaagaccauugguuuaguagggagaauagcuacucuggaguugaaggugagggccugcacaagcucggguauauccuucgagauauauccaaaauccccggaggcgcaauguacgcugacgacaccgccgguugggauacacggauuacugaagacgaucugcauaacgaggagaagaucacccaacagauggacccagaacacagacaguuagcuaaugccauuuucaagcugacauaucagaacaaaguggucaaggugcaaaggccuacucccaaagggaccgugauggauaucauaucacgcaaggaccagcguggaagcggccaggucggcacguacggguugaauacauuuaccaacauggaggcacagcucauucggcaaauggaaggagaggguguucugucgaaaacugaucuagaaaauccacaucuucuggagaagaagaucacacaguggcucgagaccaaaggcguggaaagacugaagaggauggcgaucucuggggacgauugcguagugaaacccauugacgaucgcuucgccaacgcuuuguuagcccugaacgacaugggaaagguccgaaaagauauaccucaguggcagccaaguaagggcuggcacgacuggcaacaggugccguucuguucccaccauuuucacgagcucaucaugaaggacggucggaaacuuguugugcccugcagaccucaggaugaacugauugggagggcacgcaucagccagggagcuggcuggucacuaaaggagacugccugucugggcaaagcauaugcccaaaugugggcgcucauguacuuccauagacgggacuugaggcuggcuuccaaugccauuugcucugcagucccagugcacuggguacccaccagccguacaacguggaguauccacgcccaucaccaguggaugaccacugaagauaugcuuacaguuuggaaccgaguguggauagaggacaauccuuggauggaggauaagaccccagucacuacaugggaagacgugcccuaccuggggaaacgcgaggaucagugguguggaucccucaucgguuuaaccagcagagcuacgugggcccaaaacauucugacagcaauccagcagguucggucuuugauuggcaaugaagaguuucuggacuauaugccuucaaugaagagguuccgcaaggaggaagagagugaaggggcuaucugguga

SEQ ID NO: 15665 - RNA, 9873 nt, Artificial Sequence
  derived and/or modified CDS sequence (opt3) from DENV-3__JN368477__SS-prME
accagccugugccucaugaugaugcuucccgcaacacuggcuuuccacuugacuuccagagacggcgaaccuaggaugaucguggggaagaacgaacggggaaaaucuuuacuguuuaagacggcaucagguauuaauauguguacccuaauagccauggaucucggcgagaugugcgacgauacaguaacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccagacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcaaagagcaaacccacacucgacaucgagcugcagaagaccgaagcaacucagcuugccacacugaggaaauuguguauugagggaaagaucaccaauauuacgaccgauagucggugcccuacacagggcgaagcuacucucccagaggaacaggaccagaacuaugucuguaaacacaccuacguugaucgcgguugggggaauggaugcggccuguucggcaagggguccuuagugacaugcgccaaguuucaaugucuggagcccaucgagggaaaaguagugcaguaugaaaaccucaaguacacugucauaauuaccgugcacacaggugaccagcaucagguuggcaaugacacccaaggggugacugucgagaucacgccucaggcaucuacaguggaagcuguacuuccagaguauggaacccugggcuuggaaugcagcccgcgaacuggucuagauuucaacgagaugauucugcucaccaugaaaaauaaggccuggaugguucacagacagugguuuuucgaccugccccuuccuuggacauccggggcgaccacugagacaccaacguggaacaggaaagaacuguuggugaccuuuaagaaugcccaugccaagaagcaagaggucgugguccucggcucacaggaaggagcuaugcacacugcccugacaggcgcuaccgagauccagaacagugggggaacaagcaucuucgccggucacuuaaagugucggcugaaaauggauaagcuagaacucaaaggcaugucuuacgcaaugugccugaauacuuuugugcuuaagaaagagguuuccgagacccagcaugggacgauuuugauaaagguggaauacaagggagaggacgcccccuguaaaaucccuuucucaaccgaagauggccaagguaaggcucacaacgggcgucugauuacagcgaacccaguagucacuaaaaaggaggagcccgugaauaucgaagcagagccgccuuucggcgaaagcaacauaguuauuggaaucggcgacaaagcccucaagaucaauugguauaagaaagggaguucuauuggaaagauguuugaggcuaccgcccgcggugcaagaaggauggccauccugggcgauacagcuugggacuucggguccgugggaggcguccuuaacagccuggguaaaauggugcaucagauuuuugggucggccuacacugcauuguucucuggcguauccuggauaaugaagaucggaauuggcgugcuccugaccuggaucggguuaaauaguaaaaacacgucaaugagcuuuuccugcaucguuauuggaauaaucacacuguaucuaggcgcggucgugcaggcugauauggguugugugauuaauuggaaggggaaggaacucaaaugcggaaacggcaucuucgucaccaaugagguucacacuuggacagagcaguacaaguuucaagccgacucucccaaacggcuggcaaccgccauugcuggugccugggaaaacggcgugugugggauccgaagcacuacccgcauggagaaucuuuuguggaagcagauagcaaacgaacugaauuauauccucugggagaacaauauuaaacugacagugguagucggagauaucauuggcguguuagaacaggggaagagaacgcugaccccacagccuauggagcuuaaauacucauggaagacuuggggaaaggcuaaaaucguuacagccgagacccaaaacaguuccuucauaauugacggccccaacacaccagaaugccccagcgcgucuagggccuggaaugugugggaggucgaagacuaugguuuugggguguucacuaccaacaucugguugaagcuccgggagguuuacacgcagucaugugaucaucgccugaugagugcugcaauuaaagacgaaagagccgugcacgcugauaugggauacuggaucgagagccagaagaauggcuccuggaaacuagagaaggccucuuuuauagaaguaaagacaugcaccuggccuaaaucgcacacucuguggagcaacgguguccucgaguccgacaugaucauuccaaagucacuggcaggcccgaucagucagcauaaucacaggcccggguaucauacccaaacagcgggaccuuggcaccuuggcaaauuggaacuggauuucaacuacugcgaggggacuaccguggugauugccgagaauuguggaacacguggcccaucuuuacggacgaccacugucagcgguaagcucauccacgaauggugcugucgauccugcacacugcccccucuuagauauaugggggaggacggauguugguacggcauggaaauaaggccaauuaacgagaaagaagagaauaugguuaagucacuggugagcgcugguucuggcaagguagauaacuuuaccauggggguguugugccucgccauccuguucgaggaagucaugcgcggaaaauucggcaagaaacauaugaucgcaggggugcuauuuacuuucguucugcuccuguccggacagauuacauggcgggacauggcucacacccuuaucaugauuggcaguaaugccagcgauagaauggguaugggggugacgcauuuggcacugauagccacuuuuaagauccagcccuucuuagcucucggauuuuuccugaggaaacuuaccucucgcgagaaccugcuacucggcgucggccuggcgauggccacaaccuugcaacugccggaagacauugagcagauggcaaaugggaucgcuuuaggacucaugacucugaaacuuauuacacaguuugaaaccuaucagcuguggacagccuuggugucccucacuuguucaaacaccaucuucacgcugacaguugccuggcgaaccgcuacucuaauacuggcgggugugagucuucucccucugugccaaagcucguccaugcggaagaccgauugguugccaaugacagucgccgcgaugggcguacccccucugcccuuauuuaucuucucucucaaagacacuccaaagcguagaagcuggccucugaaugagggggugauggcuguuggacuugugucaauucuggccaguuccuugcucaggaacgauguccccauggcaggcccacugguggccggugggcuacugaucgcuuguuacguaauuaccggaacgucugcagaccuuacaguggagaaagccgcggacgucaccugggaagaggaagcugagcagacuggcguuagccacaaccucaugaucacaguggaugacgauggcaccaugcgcauaaaggacgaugaaacugagaauauucugacaguguuguuaaaaaccgcccugcucaucgucuccgggaucuuuccguauucaauuccugcaacgcugcuuguguggcauacuuggcagaagcagacccaacggagcggaguucugugggacguacccaguccacccgagacacagaaagccgaauuggaggaagguguguacagaauaaagcagcagggcaucuucgggaagacccaagucggagugggcguucagaaagaggguguguuucacacaauguggcacgucacuagaggggcugugcuaacccauaacggaaagcgacuggagccuaauugggccucugucaagaaggaucucauuuccuacggcggcggguggcgccugagcgcacaguggcaaaaaggagaagagguccaggugaucgcuguugaaccagguaagaaccccaagaauuuccagacgaugccuggcauuuuccagacaacuaccggggagaucggagccauagcgcuugacuuuaaaccgggcacaucggguucaccaaucauuaaccgggaagggaagguggucggauuauauggcaauggcgugguuaccaaaaacgggggauacgugucugguaucgcccaaacuaaugcagagcccgauggcccuaccccagagcuggaagaggaaauguucaagaaaagaaaccucacaauuauggacuugcaccccgggaguggaaagacgaggaaguaucugccugcuaucguccgugaggccauaaaacgccggcucagaacucugauucuugcuccgaccagggugguagcagccgaaauggaggaggcccugaagggcuugcccauccgauaccagacaaccgcuacuaaauccgaacauacaggucgggagaucguggaucuaaugugccacgcgaccuuuacgaugcgccugcucagcccaguuagagucccuaauuauaacuuagugauuauggacgaagcacauuucacugaucccgccucuaucgcugccaggggguacauaagcacacgggugggaaugggcgaggcagccgcuauuuuuaugaccgcgaccccaccuggcacugccgaagcauucccccaguccaaugcuccaauccaggacgaggagcgagacauuccggaaagaucauggaacagugggaaugaguggaucacagauuuugucggaaagaccguaugguucgugccuagcauaaaagccgguaacgacauugcaaacugucugcgcaagaauggcaagaaaguuauccaacuuucuaggaagacauuugauacugaauaucagaaaacgcgucugaacgacugggauuucguggucaccacagacaucuccgagaugggggccaauuuuaaggcugaucgggugauugaccccagaaggugccucaaaccaguuaucuugacugauggacccgagcgcgugauucuggccggcccuaugccagucaccgcggcaucagccgcucagcgaagaggucggguggggaggaacccccagaaggaaaaugaccaauacauauucacaggccagccucucaacaaugaugaggaccacgcccacuggaccgaagcuaagaugcugcuugacaacaucaauacuccggagggaauuaucccagcacuauucgaacccgagcgcgagaaaagugccgcuaucgauggcgaauaccgucugaagggggagagcagaaaaacguuuguagaauugaugcggaggggagacuuaccuguguggcuggcccauaagguugcauccgaggguauuaaauauaccgaucgcaaguggugcuucgacggcgaacgaaacaaucagauacucgaggagaacauggaugucgaaaucuggacaaaagagggggaaagaaagaagcugcggcccagguggcuugacgcgcgcacuuacucugauccacuggcccucaaagaguuuaaggacuucgcugccggaagaaaaucgauugcauuggaucuggugaccgaaaucggcagggugccuagccaccuagcucaucggacacguaaugcccuggacaaccucgucaugcuucacaccucagagcacggugggcgcgcauaucgacaugccguugaggaacugcccgagacuauggaaacauuauugcugcucggccugaugauucuucugacgggaggcgcuaugcucuuuuugaucuccgggaagggaauagguaaaaccaguaucggccugauuugugugaucguaucuagcgggauguuauggauggcggaugugccacuacaguggauugccuccgcaaucguccuggaguucuuuaugauggugcuccuuauaccugagccggaaaagcaaagaacuccccaggacaaucagcuggcuuacguugugauuggaaucuugacacuggccgccauugucgcagcuaacgagaugggccuccuggaaaccaccaagagggaucuugguaugucaaaagagccagggguagugucuccuacaagcuaucucgacguugaccugcaccccgccagugcguggacuuuguacgcuguggccacgaccgucaucacaccaaugcugcggcauacuauagaaaauuccaccgcaaacgugagcuuagccgcuaucgcaaaccaagccgucgugcuaaugggccuggauaagggauggccuauuucuaaaauggaccucggcguuccccuucuggcguuggggugcuauucacaggugaauccgcugacacucaccgcugccguacugcuuuuagugacucacuacgcaaucauuggaccaggccugcaggccaaggcuacgcgcgaggcccagaaaagaacagcagcugguaucaugaagaacccuaccgucgaugggauaaugacuauugaccucgaucccguuaucuacgacuccaaguucgagaaacaauugggacaggugaugcugcuaguccugugugccgugcagcuccuucugaugaggaccaguugggcguugugcgaagcccugacacucgcaacuggcccaaucaccacacugugggaggguagccccggcaaguuuuggaauacgaccauugcuguaucgauggccaacaucuuccgggggucuuauuuagcaggagcuggccuugccuuuuccauaaugaaaagcguggggacuggacgaagaggcacagguucacagggggaaacccugggagagaaguggaaaaagaagcucaaucaacuaagucgcaaagaguucgaucuguacaagaaaucuggcauuacugagguugacaggacagaggccaaggaagguuugaaacggggcgagaccacgcaucacgcggugucccgugggagcgcuaagcugcagugguuugucgaaagaaacauggugaucccugagggaagggucauugaucucggcugugggcgcggaggcuggucauauuacugcgcaggucuuaaaaaggugaccgaaguucggggguauacaaagggaggcccgggccacgaggagcccguaccaaugaguacuuacggguggaauaucgugaaacugaugagcggaaaggacgucuucuauuugccucccgaaaaaugugauacccugcucugcgacauaggugaguccucuccuagcccaacaguggaagagucccgaacuaucagaguuuuaaagaugguggagcccuggcugaggaacaaucaguucuguauuaaaguccuuaacccuuacaugccaaccgugaucgaacaucuggagcgccuacagcggaaguacggcgggaugcucguaagaaauccccugucacguaacucuacacacgaaauguauuggauuaguaauggaaccggcaacaucgugucgagcguuaauauggucuccagguugcugcucaaccgguuuacuaugacgcaucgccgaccgacaauugagaaggauguggaccuuggugccgggaccagacacgugaacgcugaaccugagacuccaaauauggacgucaucggagagaggauaaaacggauuaaggaagaacacucuucaaccuggcauuacgaugacgaaaaccccuauaaaacaugggccuaccacggcagcuaugagguuaaggcaacgggcuccgccaguucuaugaucaauggggugguaaaacuguuaaccaagccuugggauguggucccaauggugacucaaauggcuaugacagacaccacucccuucggacagcagcgcguuuuuaaggaaaaaguggauacaagaaccccgaggccuaugcccgguacacgaaaggucauggagaucacugcggaguggcuguggcggaccuugggccguaacaaaaagccaagacucugcacgcgcgaagaguucaccaaaaaggugaggacaaaugccgcaaugggggcuguauuuacugaagagaaccaaugggacagcgcccgggcagccguugaagaugaggaguucuggaagcugguggacaaagaaagagagcuacauaaacuuggaaaauguggcucaugcgucuacaauaugauggguaagcgcgagaagaagcugggggaguuuggaaaagcuaagggcuccagggccauuugguauauguggcucggcgcgcgauaccuggaguucgaagcauugggguuucugaacgaggaucacugguucagucgggaaaauagcuacucuggaguggagggugaaggccuccauaaacuuggguauauacugagagacaucuccaaaauuccuggaggcgccauguacgcugaugacaccgccgguugggacacaaggaucacugaggaugacuuacacaacgaggaaaagauuacccagcagauggaucccgggcaccgccagcuggcaaaugcuaucuuuaaauugacguaucaaaacaagguggucaaaguucagcguccaacacccaagggaaccgugauggacauaaucucacggaaggaucagagaggcagcggccagguagggacuuacggacucaauacauucaccaacauggaggcccaacuggugaggcagauggaaggugagggcguccuaucgaaagcugaccuugaaaauccucaucugcucgagaagaaaauuacucaguggcuggagaccaaggggguggaacgcuugaaacgaauggccaucucuggagaugacugcguugugaagccaauugaugaccgguuugcaaacgcguuacuggcccucaacgauaugggcaaggucagaaaagacaucccgcaguggcaacccaguaaggguuggcacgauuggcaacaggugccuuucuguucccaucacuuccacgagcuuauaaugaaagacgggaggaagcugguaguuccaugccgcccccaggacgaacuaauuggaagggcucggaucagccaaggcgccggcuggucacugaaagagacagcaugucucgggaaggcuuaugcccagaugugguccuugauguacuuucauaggcgugaucugcgacuugcaucuaaugccaucugcagcgcggugccuguccacuggauuccaacgagucgcaccacuugguccauacaugcucaccaucaguggaugacaaccgaagacaugcugacuguguggaacagaguuuggaucgaggauaaucccuggauggaggacaagacaccugugaccacgugggaagaugucccguaucucggaaaacgggaggaccaauggugugguagcuuaauuggccugacaucuagggccaccugggcacagaacaucuugacugccauucaacaggugcgcucacugaucggggaugaagaguuccucgacuacaugccaaguaugaagagauuucggaaagaggaagagaccgaaggagcuauaugguga

SEQ ID NO: 15666 - RNA, 9873 nt, Artificial Sequence
  derived and/or modified CDS sequence (opt3) from DENV-3__EF643017__SS-prME
accagccugugccucaugaugauccuucccgccgcucuggcauuccacuugacauccagagacggcgagccuaggaugauuguggggaagaacgaacggggaaaaucuuuacuguuuaagacugccucagguauaaauauguguacgcuaaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcgccgacgugacaagagaagcguagcccuugcaccccacgugggcaugggucuggauacaaggacccaaacguggauguccgccgagggggcuuggcggcaggucgaaaaaguggagacuugggcauugcgccauccuggauucaccauucucgcccuguuucuggcucacuacaucggcacaucucucacucagaagguugugauauucaucuuacugaugcuugucaccccaucgaugacaaugagaugugugggcguagggaacagggacuuuguugaaggauugucaggugccaccuggguggaugucgugcuggagcauggcgggugcgugacgacuauggcgaagaauaaacccacacuagacauugagcuccagaagaccgaagcaacucaacuggccacacuucggaaacuguguaucgagggaaagauuaccaacaucacgaccgauagccgcugcccuacacagggcgaagcugucuugccagaggaacaggaccagaauuauguuuguaaacacacuuacguggaucgagguugggggaacggaugcggccucuucggcaaggggagucugguaaccugcgccaaguuucaauguuuagagcccauagagggaaaagugguccaguaugaaaaucugaaguacacagugauuaucacuguucacaccggugaccagcaucaggugggcaacgagacacaaggggucaccgcagaaauuacuccucaggcuuccacgacagaggccauccucccagaauauggaacccuuggccuggagugcucuccgagaacugguuuggacuucaaugagaugauccuacugaccaugaaaaacaaggcguggauggugcacaggcagugguuuuucgaucucccccugccuuggacaagcggggccaccacugaaacaccaacguggaaucggaaagagcuucugguaaccuuuaagaacgcacaugcuaaaaagcaagaaguuguggucuugggcucccaggagggagccaugcacacugcucucacaggcgccaccgaaauucagaauucagggggaacaaguauauucagcggucaccugaagugucguuuaaaaauggacaagcuggagcuaaaaggcaugucuuacgcaaugugcacuaacaccuuugugcucaagaaagaggucuccgaaacgcagcaugggaccauccugauuaagguggaguaccgcggagaagaugcccccuguaagaucccuuucucaacagaggacggccaagguaaagcucacaacgggagacuuauaacugcgaauccaguugugaccaagaaagaggaacccguaaacauugaggcagaaccgccuuucggcgagagcaauaucgucaucggaauuggcgauaacgccuugaagaucaauugguauaaaaaggggaguucuauuggaaagauguuugaagcuacagccaggggugcacggcgaauggccauacugggcgacacugcuugggauuucggguccgugggaggcguucucaacagccuggguaaaauggugcaucagaucuuugggucggccuacaccgcacuuuucucuggcgucuccugggugaugaagauuggaaucggcguacuguugacguggaucgggcucaauucaaaaaacacaaguaugagcuuuuccugcauugcgauaggaaucauuacccuguauuuaggcgcugugguucaggccgacauggguugugucaucaauuggaaggggaaagagcugaagugcggaucuggcauuuucgugacuaacgaggugcacacauggaccgaacaguacaaguuucaagcagauagccccaaacgccuagccacugcuaucgccggugcaugggagaauggcgucugugggauaagaucaaccacaaggauggaaaaccuccuguggaagcagaucgcuaaugagcuuaacuauauuuugugggaaaauaacaucaaacugacgguuguggugggagacauuaucggcguacucgagcaggggaagcggacccugacuccacagccuauggaguuaaaauacaguuggaagacauggggaaaagccaagauagucaccgcggaaacacaaaacuccagcuucauuaucgauggccccaauacuccagagugccccucugccucacgcgcuuggaacgugugggaaguugaggacuaugguuuugggguguucaccacgaauauuuggcugaagcuuagagaagucuacacacaguugugugaccauaggcucaugagugcagccgugaaagaugagcgugcuguucacgccgacaugggauacuggaucgagagccagaagaacggcuccuggaaacuggaaaaggcaucucuaauagaggugaaaaccugcacuuggccuaagucgcacacccuguggagcaaugguguacucgaauccgauaugaucacaccaaagucacuggcgggcccgauuagucagcauaaccaccggcccggguaucauacucaaaccgccggaccuuggcaccuuggcaaauuggagcuggacuuuaauuacugcgaggggacaacggucgugaucaccgaaaacuguggaacucgaggcccaucuuuaagaacaaccacugugagcgguaagcucauucacgaguggugcuguagguccugcacacugcccccucuucgcuauaugggggaagauggauguugguacggcauggagauccggccaauaucagaaaaagaggagaauauggucaagagccugguuucugcugguuccggcaaaguggacaacuucaccauggggguauugugccucgccauucuguuugaagaggugaugagaggaaaguucggcaagaaacauaugaucgcaggggucuucuuuacguucgugcuacugcucaguggacagaucacuuggagggauaugacccacacacugauuaugaucggcagcaaugcuucugaccgcauggguauggggguuaccuaucuugccuugauugcaacuuuuaagauacagcccuuccuggccuuaggauuuuuccuccgaaaacugacaucccgggaaaaccuucugcuaggcgugggccucgcuauggcgaccacacugcaauugccggaggauaucgaacagauggccaaugggauugcacugggauuaauggcucucaagcugaucacucaguuugagaccuaccagcuuuggacggcccugauuucauugacauguaguaacaccauguucacucucaccgucgccuggcguacagcuacucugauccuagcaggugugagccugcuuccuguuugccaaucguccucuaugagaaaaaccgacuggcucccaauggccguggcggcuaugggcgucagcccccugccuuuguuuauauucucacugaaggauacguuaaagaggcgcaguuggccccucaaugaggggguaauggccgugggacugguuuccauccuugcaucuagccuguugcggaacgacgugccaauggccggcccucucgucgcuggugggcugcuaauugcauguuaugugaucacaggaaccuccgccgaucugacuguagaaaaagcggcugacauuacaagagaggaagaggccgaacagaccggcgugucacauaaccuuaugacuacagucgacgaugacggcaccaugaggaucaaggaugacgagacggagaauauacucacuguucuguugaaaaccgcauuacugauugugagcgggguguuucccuacaguaucccagccacacuccuggucuggcacaccuggcagaagcagacacaacgaucuggagugcuuugggauguuccguccccucccgaaacucagaaagcugagcuggaagaggguguauaccgcaucaagcagcagggcauuuucgggaaaacccaagugggagucggcgugcagaaggaggguguuuuucauacgauguggcacgugacacggggggccgucuugacuuauaacggaaagagacuagaaccaaauugggcaagcgugaaaaaggaccugauaucguacggcggcggguggaggcucucagcucaguggcaaaaaggagaggaaguacaggucaucgccguggagcccgguaagaacccuaaaaauuuccagaccaugccaggcacauuccagaccacuaccggggaaauuggagcgaucgcccuggauuuuaagcccggcacaucugguaguccuauuaucaaccgugaggggaagguugugggacuuuauggcaauggcgucgugacgaaaaacgggggauacguuuccgguauagcacaaacuaaugcugagccggacggcccaacccccgaauuagaggaagagauguucaagaaacgcaaccugacaaucauggaucuccacccugggagcggaaagacccggaaauauuugccagccauugugagagaagcuaucaagaggcgacugcggacucucauucuggcacccacacgcgucguggccgccgagauggaggaagcucuuaagggccugccuaucagauaccagaccacggcgacuaaaucugagcauacagguagggaaauaguagacuugaugugccacgcaaccuuuaccaugcggcuacugagcccggugcgaguucccaauuauaaccucauuaucauggaugaggcccauuucacugacccagcuuccaucgccgcaagaggguacauuucaacacgcgucggaaugggcgaagccgcugcgaucuuuaugaccgccacaccucccggcacugcagaugcuuucccacagaguaaugccccuauacaggacgaggagagggacauucccgaacguagcuggaacucugggaaugaguggaucacggauuuugcaggaaagaccgugugguucgugccauccauuaaagccgguaacgacaucgcuaacuguuuacggaagaauggcaaaaaggucauacaacugucaagaaagacauuugauacugaauaccagaaaaccaagcuuaacgacugggauuucguagugacaaccgacauuagugagaugggggccaauuuuaaagcggauaggguuaucgacccgcgccgaugccugaagccugugauccucacugauggacccgagagagucauuuuggcaggcccaaugcccgugacggccgcuagcgccgcucagcggaggggucgcguugggcguaacccucagaaagaaaaugaccaauauaucuucaccggccagccacugaacaaugaugaggaccacgcacauuggacagaagccaagaugcuccuggacaacauuaauacucccgagggaauaaucccugcucuuuucgaaccggagagagagaaguccgccgcaauugauggcgaauaccggcuaaaaggggagucuaggaagaccuuuguggaacugaugcgccgaggagacuugccagucugguuagcgcacaaaguggccucggaggguaucaaguauacagauagaaaauggugcuucgacggccagcggaacaaucagauccuggaagagaacauggauguagagauuuggaccaaggaaggggagaaaaagaagcucaggccccgcuggcuggacgcuagaacuuacagcgauccucuugcccugaaagaauuuaaggacuucgcagcuggaaggaaaucaauagcccucgauuuggugacagagaucggccggguucccucccaccuggcacaucguacgcgcaaugcccuagacaaccuggucaugcuccacaccagugaacauggugggcgagcuuauagacacgcgguggaggagcuuccagaaacuauggagacacuguuauugcugggccucaugauucugcuuaccggaggcgccaugcuguuucucaucucugggaagggaauugguaaaaccagcaucggcuugauaugugugaucgcauccucagggaugucuuggauggcugaaauuccucugcaauggaucgccagcgccauugucuuagaguucuuuaugaugguucuacugauccccgagccagaaaagcagaggacaccucaggauaaucaacucgcauacgugguaauaggaauucuuacucuggcugccaucauugcggcuaacgagaugggcuugcuggaaacgaccaagcgggaccucgguaugaguaaagagccggggguggucucccccacaagcuaucuggauguggaccuucacccagccucugcauggacucucuacgccguugcuaccacagugaucaccccuaugcugcgccauacuauagaaaauucaacggcaaacgucuccuuggccgcgaucgcuaaccaggccguagugcugaugggcuuagacaagggauggcccauuaguaaaauggaucuaggcguuccacugcucgcacuugggugcuacagccaggugaauccucugacauugaccgccgcuguccugcuccugaucacucacuaugccauuaucggacccggccuucaggcaaaggcuaccagagaggcccaaaaaaggacagcggccgguauaaugaagaacccgacuguggacgggauuaugaccaucgauuuagacccagucaucuacgauucgaaguucgagaaacagcugggacaggugaugcucuugguucugugugcagugcagcuacugcucaugcggacaucuugggcucuuugcgaagcccugacguuggcaaccggcccuauuacuacacugugggaggguucccccggcaaguuuuggaauaccacuaucgcuguaagcauggccaacauauuccgagggucauaucucgccggagugggccuggcguuuaguauuaugaaaucugucgggacaggaaagagaggcaccgguucccaaggggaaacguuaggagagaaauggaagaagaaacuuaaucagcugagccgcaaggaauucgaccucuacaaaaagucaggcaucaccgagguugauaggacagaggcuaaagaaggucuaaagcggggcgagauuacucaucacgcagugagucgugggagcgccaaacugcagugguuugucgaaagaaacauggugaucccagagggaaggguaauagacuugggcugugggcgcggaggcugguccuauuacugcgcuggucugaagaaggugaccgaaguucggggguauacaaaaggaggccccggccaugaggagccugugccgaugucuacuuacggguggaauaucgucaagcucaugagcggaaaagauguguucuaccuucccccagaaaagugugacacccuguugugcgauauuggugaguccucaccuucucccacagucgaagagagucgaaccaucagagugcugaaaaugguugagccuuggcucaagaacaaucaguucuguauuaagguauuaaacccauauaugcccacugugaucgaacaccuggagaggcuucaacgcaaacacggcgggaugcugguccggaauccucuaucgagaaacagcacgcaugaaauguacuggauuuccaauggaacaggcaacaucguggccucuguuaauauggugucacgucuccuguugaacagguuuaccaugacucaccggcgcccaaccauagagaaggacgucgaucugggugcagggacacgacaugugaacgccgaacccgagacgccgaauauggacguaauuggagagagaaucaaaaggaucaaggaagagcacaacagcaccuggcacuaugacgaugaaaauccuuacaaaacuugggcuuaucauggcuccuacgaggugaaggcgacaggcagugccucuagcaugauuaacgggguugucaagcuccuuaccaaaccaugggacguggugcccauggucacucagauggcaaugacagauaccacaccuuucggacagcaacggguuuuuaaggaaaaaguggacacucgcaccccaagaucaaugcccgguacgaggcgaguaaugggcauaaccgcugaguggcuguggcggacauuagggcguaauaagaaaccgagacugugcacucgcgaggaauucaccaagaaggugaggacaaacgccgcaaugggagccgucuuuacugaggaaaaucagugggauuccgcuaaagccgcgguggaggacgaagauuucuggaaguugguugaccgggagagagagcuccacaaacugggcaagugugguaguugcguguauaacaugauggggaaacgcgaaaagaaacuaggagaguuuggcaaggcaaagggcagcagggccaucugguacauguggcuuggggcucgauaccuggaauucgaggcccucggauuucugaaugaggaucauugguucucucgggaaaacuccuauucaggugucgagggcgaaggguugcacaaacugggauacauucucagagacaucagcaagauuccuggcggugcaauguaugcugaugacaccgccgggugggacacgaggaucacagaggaugaccuucauaaugaagagaaaauaacccagcagauggaucccgagcaccgccaacuggcuaacgccaucuuuaaguuaacuuaccagaauaaagugguaaagguucagcguccaacaccuaccggaacugugauggacauuaucucgcggaaggaucagagaggcucuggccaagucgggaccuauggacugaacacauucacgaauauggaagcacaguugauuaggcagauggagggugaaggcgugcucaguaaagcggaccuggagaacccccaccuaccagaaaagaaaaucacccaguggcuugagacuaaggggguggagcgccugaaacgaauggccauauccggagaugacugcgucguuaagcccauugaugaccgguuugcuaacgcccuccuggcauugaaugauacaggcaaggugagaaaagacaucccucaauggcagccaagcaaggguuggcaugauuggcagcagguaccguucuguucacaccauuuccacgaauuaaucaugaaagacgggaggaagcuggugguccccugccgcccucaagacgagcucauuggaagagcucggauaucccagggcgccggcuggucucuuagggaaaccgcaugucuggggaaagccuacgcgcagauguggagccuaauguauuuucaccgucgagaucugcgccucgcuaguaacgccaucugcuccgcagugccaguucauugggugcccacuagcagaacaaccuggucuauucacgcccaucaccaauggaugacgacagaggacauguugaccgucuggaaucggguguggaucgaagauaacccuuggauggaggacaagacuccaguaaccacaugggagaauguucccuaccugggaaagagggaagaucaguggugugguucacuuauuggccugacuagucgcgcuaccugggcccagaacaucccuacagcaauacagcaagugagaucccucaucgggaaugaggaauucuuagacuacaugccgagcaugaaacgguuuaggaaggaggaggaaucugagggagcuauuugguga

SEQ ID NO: 15667 - RNA, 9873 nt, Artificial Sequence
  derived and/or modified CDS sequence (opt3) from DENV-3__DQ675519__SS-prME
accagcaucugccugaugaugaugcuccccgccacccuugcuuuccaccugacuuccagggacggcgaaccuaggaugauuguggggaagaacgaacggggaaaaucuuuguuauuuaagacggccucagguauaaauauguguacccugaucgccauggauuuaggcgagaugugcgacgauacagucacuuacaaauguccacucauuaccgaaguugagccggaagacaucgauugcugguguaaccugacaaguaccugggugacuuaugggacaugcaaucaggcgggagagcaucgccgagacaagcguagcguagcucuugcaccccacgugggcaugggucuggauaccagaacgcagacuuggauguccgcagagggggccuggaggcaggucgaaaaaguggagaccugggcuuuccggcauccuggauuuacaauuuuggcacucuuccuggcccacuacaucggcacuucucugacccagaagguugugauauuuauccucuuaaugcuggucacaccaucgaugaccaugcgcugugugggcguagggaacagagacuucguugaaggacuuucaggugcuacguggguggaugucguguuggagcauggcgggugcgugacuacaauggccaagaauaaacccacccuggacauugagcuucagaagacugaagcgacacaacucgcaacccugaggaaacuuuguaucgagggaaagauuacgaacgucaccacagauagccggugcccuacucagggcgaagccauccugccagaggaacaggaccagaauuauguuuguaaacacaccuacguggaucgcgguugggggaacggaugcggcuuguuuggcaaggggagucucguaacaugcgcuaaguuccaaugucuggaguccauagagggaaaagugguccagcacgaaaauuuaaaguauacugugauuaucaccguucauacaggugaccagcaccaggugggcaacgagacccaaggggucacugccgaaauuacgccccaggcaucuacaguggaggcuauccugccugaauacggaacccucggccuugagugcagcccacgaacuggucuggacuuuaaugagaugaucuugcuaaccaugaaaaacaaggccuggaugguacauagacagugguucuuugaucugccgcuccccuggacauccggggcgaccacugaaacaccuacguggaauaaaaaggagcugcuuguuaccuucaaaaacgcccacgcaaagaagcaagaaguggucgugcugggcucacaggagggagcuaugcacacugccuugacaggcgcuaccgaaauucagacaagugggggaacuagcauauuugccggucaucucaaauguaggcugaagauggacaaauuagagcugaagggcaugucuuaugcaaugugccuaaaugccuucguccucaaaaaggagguguccgaaacccagcacgggacgauccugauuaagguugaguacaaaggagaagaugcuccaugucggauccccuucucaaccgaggacggccaagguaaggcgcauaacgggcgucuuauaacagcaaacccugugguaacuaaaaaggaggaaccagucaauauugaggccgaacccccguuuggcgagagcaacaucgugaucggaauuggcgauaaggcuuugaagaucaauugguacaagaaagggaguucuauuggaaagauguucgaagccaccgcacgcggugccagaaggauggcuauacugggcgacacagccugggauuuuggguccguuggaggcgugcucaacagccuggguaaaaugguccaccagaucuucgggucggcauauacugcgcuauuuucuggcguguccuggauuaugaagaucggaaucggcguacuguugaccuggauugggcucaauagcaagaacacgaguaugagcuucuccugcauagugaucggaauuaucacacuguacuuaggcgcuguuguccaggccgacauggguugugugauuaauuggaaggggaaggagcugaaaugcggaaacggcaucuuugugaccaaugagguccauacuuggacagaacaguauaaguuccaagcagauucuccuaaacggcuagccaccgcuauagccggugcaugggagaacggcguuugugggauccgaagcacuacccgcauggaaaaucuccuguggaagcagauugcuaacgagcuuaauuacaucuugugggaaaacaauauuaaacugacaguggugguaggagacaucauaggcguccucgagcaggggaagagaacgcugacaccccagccaauggaguuaaaauauucauggaagacuuggggaaaggccaaaauugugacagcggaaacccaaaacaguuccuuuaucauugauggcccuaacacacccgagugcccaagcgccucuagggcuuggaauguuugggaaguggaggacuacgguuucggggucuuuacuaccaacaucuggcugaaacuucgggaaguguauacgcaguugugugaccaccgccucaugucagcagccguuaaagaugagagagcugugcacgccgacaugggauacuggauagagagucagaagaauggcagcuggaaacuggaaaaggcaucccuaaucgagguaaagacaugcaccuggcccaaaucucauacucuguggucgaacgguguccucgaaagcgauaugauuaucccuaagucccuggcgggcccaauuucacagcacaaucauaggccgggguaccacacccaaacagccggacccuggcaccuuggcaaauuggagcuggacuucaacuauugcgaggggacuaccguggugaucacagaaaauuguggaacgcguggcccuaguuuacggaccacuacagucucugguaagcucauacaugaguggugcugucgaagcugcacccugccaccccuuagauacaugggggaagauggauguugguauggcauggagauuaggccuaucaacgaaaaagaggagaauaugguuaagucccuggugucagcugguagcggcaagguagacaacuuuacuauggggguguugugccucgccauccuguucgaagaggucaugcgcggaaaauucggcaagaaacacaugauugcaggggugcuauuuacauucguucugcuccugucuggacagaucaccuggcgggauauggcucauacgcuuauuaugauaggcuccaaugccagugacagaauggguaugggggugacuuacuuggcacugaucgccaccuuuaagauucagccauucuuagcucucggauuuuuccugaggaaacuuacaagccgcgaaaaccugcuacucggcgucggccuggcgauggccaccacuuugcaacugcccgaggauaucgaacagauggcaaaugggguggcuuuaggacucauggcccugaaacuuauuacacaguuugagaccuaucagcuguggacagccuugguuucucucauguguuccaacacuaucuucacccugacgguggcuuggcgaacagcaacccuaauacuggccgguaucucacuucucccggucugccaaaguagcucgaugcggaagacugacuggcugccuaugaccguagcggcuaugggcgugccacccuugccucuguuuauuuucuccuuaaaagauacacucaagcguagaucuuggccccugaaugaggggguuauggccaucggacuugugagcauucuggcaucaaguuugcucaggaacgacgucccaauggccggcccucugguggcuggugggcuacugaucgcauguuacguaauaacuggaaccuccgccgaucuuacgguggaaaaagcggcugacgucacaugggaggaagaggccgaacagaccggcguuucucacaaccucaugauuacuguggacgaugacggcacaaugcgcaucaaggaugacgagaccgagaauauccugacuguguuguuaaaaacagcacugcucauugucagcgggauauuucccuauuccaucccagccacccugcuuguguggcauacguggcagaagcagacucaacggucaggaguucugugggauguaccgagcccucccgaaacccagaaagcugaguuggaagaggguguguacagaauuaagcagcagggcaucuucgggaagacacaagucggagugggcauucagaaagaggguguuuuucacaccauguggcacgugacaagaggggccguccuaacucauaacggaaagcgacuggaaccaaauugggcaagugugaaaaaggaccucaucucuuacggcggcggguggcgccuguccgcucaguggcaaaaaggagaggaaguacaggucauagccguggagcccgguaagaacccuaagaauuuccagaccaugccaggcaucuuccagacgacaacuggggaaauuggagcgaucgcccuugauuuuaaacccggcaccagcgguucgccuauuaucaaccgggaggggaagguugugggauuauauggcaauggcgucgugacuaagaacgggggauacguuucagguauagcacaaaccaaugcugagccggacggcccaacucccgaacuggaggaagagauguucaagaaaagaaaccucaccauuauggauuugcacccugggucuggaaagacaaggaaguaucugccaacgaucgugcgugaagccaucaaacgccggcucagaacucugauucuugcucccaccagggucguggcagccgagauggaggaagcccugaagggcuugccuauccgauaccagacaaccgcuacuaaaagugagcauacagguaaggaaauaguagaccuaaugugccacgcgaccuuuacgaugcggcugcucuccccggugcgcguucccaauuauaacuuaauuaucauggaugaggcacauuucacugacccagccagcauugcugccagaggguacaucucuacaagggucggaaugggcgaagcagccgcuauauuuaugaccgcgaccccucccggcacugccgaugcauucccacagagcaaugcuccuauucaggacgaggagcgggacauccccgaacgauccuggaacucagggaaugaguggaucacagauuuugugggaaaaaccgugugguucgucccaaguauuaaggccgguaacgacaucgcaaacugucugagaaagaauggcaaaaagguaauucaacuuagccgcaaaacauuugauacugaauaucagaagacgaaacugaacgacugggauuucgugguuaccacagacauaucugagaugggggccaauuuuaaggcugauagggugaucgacccgcgucggugccucaagccugucauuuugacugauggacccgagagagugauccuggccggcccaaugcccguuaccguggcguccgcagcccagaggcgcggucgagucgggagaaacccucagaaagaaaaugaccaauacaucuucacaggccagccacucaacaaugaugaggaccacgcucacuggaccgaagccaagaugcugcuugacaacauuaauacucccgagggaauaaucccugcucuauucgaaccggagcgggagaaaucagcagccauugauggcgaauacaggcugaagggggagagucgcaaaacguuuguggaauugaugcguagaggagacuuaccaguauggcuggcucauaagguggccagcgaggguaucaaauauaccgaucggaaguggugcuucgacggcgaaaggaacaaucagauucucgaggagaacauggauguugaaaucuggacaaaggagggggagaagaagaaacugcgcccccgauggcuugacgcaagaacuuacuccgauccucuggcgcucaaggaguuuaaagacuucgccgcuggacggaagucuauagccuuggaucuggucaccgaaaucggcagggugcccucgcaccuagcauaucgcacaagaagcgcucuggacaaucucgugaugcuucauaccucagagcacggugggagggccuaccggcacgcagucgaggaacugccagagacuauggaaacauuauugcugcucggccugaugauucuucugacgggaggcgccaugcucuuuuugaucuccgggaagggaauugguaaaaccaguaucggccugauauguguuguggcuucuagcgggauguuauggauggcggauguaccucuacaguggauugccuccgcaaucgugcuggaguucuuuaugaugguccuccuuauucccgagccagaaaagcaacguacuccucaggacaaccagcuggcuuaugugguuaucggaauauugacacuggccgccaucguggcagcuaaugagaugggccuccuggaaaccaccaaacgcgaucuugguaugucaaaggagccgggggucguaucucccacaagcuaccucgacguggaccugcauccagccagugcguggacuuuguaugcuguugccacgaccgugauuacaccuaugcugcgacacacuaucgaaaacuccaccgcaaaugucagcuuagccgcuauugcaaaccaagccgugguccuaaugggccuggauaaaggauggcccaucucuaagauggaccucggcgugccacuucuggcguuggggugcuacucacagguuaacccucugacacucaccgcugccgugcugcuuuuaguaacucauuacgcaauaauuggacccggccugcaggccaaggcuacgagagaggcccagaaaaggacagcagcugguaucaugaagaauccgaccguggaugggaucaugacuauugaccucgauccagucaucuaugacuccaaauucgagaagcaauugggacagguuaugcugcuagugcugugugccguccagcuccuucugaugcggaccaguugggcguuuugcgaagccuugacacuggcaacuggcccuauaaccacacucugggaggguagccccggcaaauucuggaacacgaccauugcugugucgauggccaauaucuuucgcgggucuuaccuggcaggagcuggcuuagccuucuccauuaugaagucaguagggacuggaaagagaggcacagguucacagggggaaacccuuggagagaaauggaagaaaaagcugaaccaacucaguaggaaagaauuugaucuauauaagaaaucuggcaucacugagguggaccggacaaaggccaaggagggucugaaacgaggcgaaaccacgcaccaugcgguuuccagagggagcgcuaaguugcagugguucguggagcgcaauauggucauaccagaaggaagggugaucgaucugggcugugggcggggaggcuggucauacuauugcgcaggucucaaaaaggucaccgaggugcguggguacacaaaaggaggccccggccacgaagaaccuguuccgaugaguacuuauggguggaacauuguaaaacuuaugagcggaaaggacguguucuaccugcccccagagaaaugugauaccuugcugugcgacaucggugaauccucuccuagccccacagucgaggaauccagaacuauuagggugcucaagaugguugagccuuggcugaaaaauaaccaguuuuguaucaaggugcuaaauccauacaugcccaccgucauugagcaccuugaacgccugcagcggaaacauggcgggaugcuagugcgaaacccucucucaagaaauucuacacacgagauguauuggaucaguaacggaaccggcaauauaguaucgagcgugaacaugguuuccaggcuguugcugaaucgcuucacuaugacgcaucggagaccaacaauugaaaaggaugucgaccucggugccgggacccgucacgugaacgcugagcccgaaacuccgaacauggacgugaucggagagaggauccggcgcauuaaggaggaacacucuucaaccuggcauuacgaugacgagaauccuuauaaaacaugggccuaccacggcagcuaugaagucaaggcaacgggcuccgccaguucuaugauaaacgggguugugaaacuucugaccaagccaugggauguagugcccacugucacacaaauggcuaugaccgacacuacaccuuuuggacagcagcgaguguucaaagagaagguugauaccagaacaccaaggcccaugccggguacucggaaggugauggaaaucaccgcggagugguuauggcgcacgcugggcagaaauaaaaggccucgauugugcacccgggaggaauuuacaaagaaaguccguacuaacgccgcaaugggggcuguguucaccgaggaaaaucaaugggacagcgccagagcagccguagaggaugaagaguuuuggaagcucguugaccgcgagagggaacugcauaaacuaggaaaguguggcucaugcguguacaacaugauggguaaacgggagaagaaacuuggggaguucggaaaagcuaagggcuccagagccauuugguauauguggcugggcgcgcgcuaccucgaguuugaggcacugggguucuugaaugaagaucacugguuuaguagggagaacagcuacucuggagucgaaggugagggccugcauaaacucggguauauccuucgagacauuuccaagacacccggaggcgccauguacgcugaugacacugccgguugggacacccggaucacggaagaugaccugcacaaugaggagaaaauaacacagcagauggauccagaacacagacaguuagcaaacgcuaucuucaagcugaccuaucaaaauaagguggugaaaguccagaggccuacucccaaggggacaguuauggacauuaucucacgcaaagaucagcguggaagcggccaggugggcaccuacggguugaacacuuuuaccaauauggaggcccaacucauucggcagauggaaggagaggguguacugucgaaggcugaccuagaaaacccacaucuucccgagaaaaagaucacacaguggcuggagacgaagggcguggaaagacucaaaaggauggccauaucuggggaugacugcgucgugaagccuauugaugaccgcuucgcaaaugcgcuguuggccuuaaacgauaugggaaaaguucgaaaggacaucccacaguggcaaccgaguaaaggcuggcacgauuggcaacaggugcccuucuguucccaucacuuucacgagcugaucaugaaggacggucggaagcucgucgugccuugcagaccacaggacgaacuuauugggagggcucgcauaagccaaggagccggcuggucacugaaagagaccgcaugucuaggcaaggcuuaugcccagauguggucccugauguacuuccauagacgggaucucagguuggcaucuaacgccaucugcagcgcgguacccguucacugggugccuacaagucguacaaccugguccauucaugcucaccaucaguggaugacuacagaagacaugcugaccgucuggaaucgaguguggaucgaggauaacccauggauggaggacaaaacgcccguuacaaccugggaagaugugccuuaucuugggaagcgcgaggaccaaugguguggaagccugauuggucucacuucuagagccaccugggcacagaauaucuuaacagccauacagcagguccggucacugaucggcaacgaagaguuuuuggauuacaugccgaguaugaaaagguuccgcaaggaggaagaguccgaaggggcuauuugguga

SEQ ID NO: 15668 - RNA, 9873 nt, Artificial Sequence
  derived and/or modified CDS sequence (opt3) from DENV-3__DQ675521__SS-prME
accagcuucugccugaugaugaugcuccccgccacacuugcuuuucaccugacuuccagagacggcgagccuaggaugaucguggggaagaacgaacggggaaaaucuuuguuauucaagacggcaucagguauuaauauguguacccugauagccauggaucuaggcgagaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcccauagagggaaaaguagugcaguaugaaaaucugaaguacacagucauuaucacugugcacaccggugaccagcaucagguuggcaacgacacacaaggggugaccgucgagauuacuccucaggcauccacgguggaagcuguacucccagaguauggaacacuuggccuggaaugcucuccgcgaaccgguuuggauuuuaaugagaugauccuacugacuaugaaaaacaaggccuggaugguucacagacagugguucuuugaccucccccugccuuggaccagcggggcgacaaccgagacuccaacauggaauaggaaagaacuucuggugacguucaagaacgcccaugcaaaaaagcaagaggucguggucuugggcucccaggaaggagcuaugcacaccgcccucacuggcgcuacagagauccagaauucagggggaaccaguauuuuugccggucaccugaagugucgguuaaaaauggauaagcuggaacuaaaaggcaugagcuacgcaaugugccucaacacauucgugcugaagaaagagguuucugagacucagcaugggaccauacuuaucaagguggaauacaagggagaggacgcccccuguaaaauuccuuucuccacggaagauggccaagguaaggcucacaacgggcguuugaucaccgcgaauccaguagucacaaaaaaggaggagcccgugaacauagaagcagagccgccuuuuggcgaaucaaauauuguuaucggaaucggcgacaaagcccugaagauuaacugguauaagaaagggagcaguaucggaaagauguucgaggcuacugcccgcggugcaagaaggauggccauucucggcgauaccgcuugggacuuugggucugugggaggcguccugaauucccuugguaaaauggugcaucagauauucgggagcgccuacacagcacuguuuucgggcguaucuuggaucaugaagauuggaaucggcguguugcucacuuggaucgggcugaacuccaaaaauaccucaaugaguuucagcugcauuguuauaggaaucauuacguuauaucugggcgcggucgugcaggcugauauggguugugugaucaacuggaaggggaaggaacuaaaaugcggauccggcauuuuugucacaaaugagguucacaccuggacugagcaguacaaguuccaagccgacucucccaaacggcucgcaacagccaucgcuggugccugggaaaacggcgugugugggauacgaagcaccacucgcauggagaaucugcuuuggaagcagaucgcaaacgaauugaauuauauucugugggagaacaauaucaaacucaccgugguagucggagauauuaucggcgugcuggaacaggggaagagaacauuaacgccacagccuauggagcugaaauacucauggaagaccuggggaaaggcuaaaauaguuacugccgagauucaaaacaguuccuuuaucauugacggccccaacacaccagaaugccccagcgcgucuagggccuggaaugugugggaggucgaagacuaugguuucgggguguuuaccacaaacaucuggcuuaaguugcgggagauguacacucagucaugugaucaucgccucaugagugcugcaauaaaagacgaaagagccguucacgcugauaugggauacuggaucgagagccagaagaauggcuccuggaaacuggagaaggccucuuucauugaagugaagaccugcacguggccuaaaucgcacacacuauggagcaacgguguacuggaguccgacaugaucauuccaaagucacucgcaggcccgaucagucagcauaaucacaggcccggguaucauacccaaacugcgggaccuuggcaccugggcaaacuugaauuggauuuuaacuacugcgaggggaccacagucgugauaacugagaauuguggaacccguggcccaucucugcggacaacgaccgugagcgguaaguuaauucacgaauggugcugucgauccugcacucuccccccucugagauauaugggggaggacggauguugguacggcauggaaaucaggccaaucaacgagaaagaagagaauauggucaagucacuuguuagcgccgguucuggcaagguggauaacuucacaauggggguacugugcuuggcuauucucuucgaggaagugaugcgcggaaaauuuggcaagaaacauaugaucgucggggugcuguucaccuuuguucuacugcucuccggacagauuacuuggcgggacauggcccacacacugauaaugaucggcaguaaugcaagcgauagaauggguaugggggugaccuaucuugcuuugauugccacguucaagauccagcccuuucuggcauuaggauucuuucucaggaaacugacuucucgcgagaaccuucugcuaggcgucggccucgccauggcuaccacacugcaauugccggaagacauugagcagauggcgaaugggaucgcccugggauuaaugacccucaagcugauaacucaguucgaaacauaccagcuuuggaccgcacugguguccuugacauguucaaacacuaucuuuacccucacgguugcuuggcgaacagccacccugauucuagccggugugagucugcuuccucucugccaaagcucguccaugcggaagacugauuggcugccaaugaccgucgcugcaaugggcguacccccuuugccccuguucaucuuuucuuuaaaagacacaccaaagcguagaagcuggccucucaaugagggggugauggccguuggacuggugucaauucuugcgaguucccuguugaggaacgauguccccauggcuggcccacucguggccggugggcugcuaaucgcauguuauguaauaacuggaaccucugccgaccugacgguggagaaagcugcagacgucacaugggaagaggaagccgagcagaccggcguuagccauaaccuuaugauuacuguggaugacgauggcacaaugcgcaucaaggacgaugaaaccgagaauauccucacugugcuguugaaaacagcguuacugauugucuccgggauauucccguacucaaucccugcuacccuccugguguggcacacguggcagaagcagacucaacggagcggaguucuuugggacguacccaguccacccgagacccagaaagccgaacuggaggaagguguguacagaauuaagcagcagggcaucuuugggaagacacaagucggagugggcguucagaaagaggguguguuccauaccauguggcacgucacaaggggggcaguguugacucacaacggaaagcgacuagagccuaauugggccucuguaaaaaaggaucugauuuccuauggcggcggguggcgccucagcgcucaguggcaaaaaggagaagagguccaggugaucgccguugaaccagguaagaaccccaagaauuuccagaccaugccuggcauauuucagacgacaacuggggagaucggagcaauugcucuggacuucaaaccgggcaccucggguucaccaaucauuaaccgggaagggaagguggucggacuuuacggcaauggcgugguuacaaaaaacgggggauaugugucugguaucgcccaaaccaaugcggagcccgauggcccuacuccagaguuagaagaggaaauguuuaagaaaagaaaccugaccauaauggaccuccaucccgggaguggaaagacaaggaaguacuugccugccauuguccgugaggcaaucaaacgccggcugagaacgcucauccuggcuccgacuagggugguagccgcugaaauggaggaggcacuuaagggccugcccauucgauaucagaccacagccaccaaauccgaacacacuggucgggagaucguggauuugaugugccaugccacauucaccaugcgccuacugagcccaguuagagucccuaauuacaaccucauaauuauggacgaagcucacuuuacggaucccgcgucuaucgcagccaggggguauauuagcacucgggugggaaugggcgaggcugccgcaaucuucaugacagccaccccaccuggcaccgcugaagcguuuccccaguccaaugccccaauacaggacgaggagcgagacauuccggaaagaucauggaacagugggaaugaguggaucacugauuucgugggaaagacagucugguuuguaccuagcaucaaagcagguaacgacauugcuaacuguuuacgcaagaauggcaagaaagugauccaacugucuaggaagaccuucgauacagaauaccagaaaacucgucuuaacgacugggauuuuguugugacgaccgacauuuccgagaugggggccaauuuccgggcagauagagucauagaccccaggcgcugccugaagccagugauccucacagauggacccgagcgaguuauuuuggccggcccuaugccagugacugcugccucagcggcacagagacgggguagggucgggcgcaacccccagaaagaaaaugaccaauacaucuucaccggccagccucugaacaaugaugaggaccaugcccacuggacagaagcuaagaugcuccuggacaacaucaauaccccggagggaauuauaccagcccuuuuugaacccgagcgugagaagagugcugcaaucgauggcgaauauagacuaaaaggggagagccggaagacuuucguggaacugaugaggcgcggagacuugccuguaugguuagcccacaaaguggcuuccgaggguauuaaguacacggaucgaaaauggugcuuugacggcgaaagaaacaaucagauccuggaggagaacauggauguugaaauuuggaccaaggagggggaacggaaaaagcucaggccccgcuggcuggacgccagaacauauucugauccacuugcacugaaggaguucaaagacuuugcggccggaaggaagucgaucgcucucgauuuggucacugaaauaggccgggugccuagccaucuggcccaccguacccgcaaugcacuagacaaccuggugaugcuccauacaucagagcacggugggcgagcuuacagacacgccgucgaggaacuucccgagaccauggaaacucuguuauugcugggccucaugauccugcuuacaggaggcgcaaugcuguuccucauuuccgggaaaggaaucgguaagacgaguauuggcuugaucuguguuauagugucuagcgggaugcuguggauggccgauguaccauuacaguggauugcuuccgcgaucgugcuagaguuuuucaugaugguccugcucauuccugagccggaaaaacaaaggaccccccaggacaaucagcuugccuaugugguuaucggaauacugacuuuggcagcuaucguggccgccaacgagaugggccugcucgaaacaaccaagcgggaucuggguaugucaaaggagccaggggucguaucuccuaccagcuaccuugacguggaccuccaucccgcaagugcuuggacacuguaugccguugcgacuacggugauuaccccaauguugcgccacacaaucgaaaauuccacugcuaacgucagccuggccgcaauugccaaccaagcuguggucuuaaugggccuagauaaaggauggccuaucucuaagauggaccugggcgugccccuccuugcacuggggugcuacucacagguuaauccguugacccugacagccgcggugcuccugcuuguaacccauuacgcuauaauuggaccaggcuuacaggccaaagcaacuagagaggcccagaagaggacggcugccgguaucaugaaaaacccuacaguggaugggaucaugaccauugaccuggaucccgucaucuaugacuccaaguuugagaagcaacucggacagguuauguugcuggugcuaugugcaguccagcugcuccuuaugcggacuaguugggcucugugcgaagccuugacccuggcgacaggcccaauaacuacccucugggaggguagccccggcaaauucuggaauacaacgauugccgugucgauggcaaacaucuuucgagggucuuaccuggcuggagccggcuuagcauucuccauuaugaagagcguagggaccggaagacgcggcacugguucacagggggaaacacuuggagagaaauggaagaaaaagcugaaucaacucaguaggaaggaauuugaucuauauaaaaagucuggcaucaccgagguggaccggacugaggcuaaagaaggucugaagcguggcgagacaacccaccaugccguuuccagagggagcgccaaauugcagugguucguggaaaggaacauggucauaccugagggacgcgugaucgaucugggcugugggcggggaggcuggucauacuauugcgcgggucucaagaaagucacggaagugcgaggguacaccaagggaggcccgggccacgaggagcccguuccaaugaguacauauggguggaauauuguaaagcuuaugagcggaaaagacguguucuaccugccucccgaaaagugugauacuuugcugugcgacaucggugaguccucuccuagcccaaccgucgaagaguccagaacaauuagggugcucaaaaugguugagcccugguuaaagaacaaucaguuuuguaucaaagugcugaacccuuacaugccaacugucauugaacaccuugagcgccugcagcggaaguauggcgggaugcuagugagaaauccccucucacguaacucuacccaugaaauguacuggaucaguaauggaacaggcaacauaguaucgagcgugaauaugguuuccaggcuguugcugaaccgguucaccaugacucaccgccgaccgacgauugagaaggaugucgaccucggugcugggacaagacaugugaacgcagaaccugagaccccaaauauggacgugaucggagagaggaucaaacggauuaaggaagagcacucuucaacuuggcacuaugaugacgaaaaccccuacaaaaccugggccuaucauggcagcuacgaggucaaggcuacaggcuccgccaguucuaugauaaaugggguugugaaacuucugacgaagccuugggauguagugccaauggucacccaaauggcaaugacugacacaacccccuuuggacagcagcgcguguucaaggaaaaaguugauacuagaacaccgaggccuaugcccgguacccgaaaggugauggagaucacagccgagugguuauggcggacucugggccguaacaaaaagccaagauugugcacccgcgaagaguuuacgaaaaaggucaggaccaaugcugcgaugggggccguguucacagaagagaaccaaugggacagcgcacgggcugccguagaagaugaggaguuuuggaagcucguugacagagaacgcgagcugcacaaacuaggaaaguguggcucaugcguguauaauaugauggguaaaagggaaaagaaacuuggggaguucggaaaggcaaaaggcucccgagccauuugguacauguggcugggcgcucgguaccucgaguuugaagcccugggguucuugaacgaggaucauugguuuaguagagaaaauagcuauucuggagucgagggugaaggccugcacaagcucggguacauccuuagggacauuuccaagaucccuggaggcgcgauguaugcagaugacacugccgguugggacacccgcauaacagaggaugaccugcauaacgaggaaaaaaucacucagcagauggaucccgagcaccgucaguuagcuucagccauuuucaagcugaccuaccaaaauaaaguggugaagguccagcggccaacgcccaaagggacaguuauggacaucauuagcagaaaggaucagaggggaucgggccaggugggcaccuauggguugaacacuuuuacaaauauggaagcacaacucguacgccagauggagggagaaggugugcugucuaaggcugaccuagagaacccucaccuucuggagaaaaagaucacccaguggcucgaaacuaaaggcgucgagcgacugaagcggauggccauaaguggggaugacugcgugguuaaaccaauugaugacagauucgcuaaugccuuguuagcacugaacgauaugggaaaggugaggaaggacaucccgcaguggcaacccuccaaaggcuggcaugauuggcagcaggucccuuucuguagccaccauuuucacgaacucaucaugaaggacggucgcaaacuugugguaccaugcagaccccaggacgagcugauugggcgggcgaggauaucacaaggagccggcuggucccuaaaggaaaccgcuugucugggcaaagccuacgcacagauguggucucucauguauuuccaccgucgagauuugcgccuggcuagcaacgccaucugcagugcaguuccugugcauugggucccaacauccagaacgaccuggagcauucacgcccaucaccaguggaugacuacagaggacaugcuuaccguguggaaucggguuuggaucgaggauaaccccuggauggaagacaagacuccugugacaaccugggaggaugucccguaccuggggaagagggaagaccaaugguguggaucucucauugguuuaacgucacgcgcgacaugggcucagaauauccugaccgccauacagcaggugagaaguuugaucggcgaugaggaguuucuggacuacaugccauccaugaaacgguucaggaaggaagaggaaagcgagggggcaauuugguga

SEQ ID NO: 15669 - RNA, 9873 nt, Artificial Sequence
  derived and/or modified CDS sequence (opt3) from DENV-3__DQ675522__SS-prME
accagcuucugccugaugaugaugcuccccgcaacacuugcuuuucaccugacuuccagggacggcgaaccuaggaugaucguggggaagaacgaacggggaaaaucuuuguuauucaagacggcaucagguauuaauauguguacccugauagccauggauuuaggcgagaugugcgacgauacaguaacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccagacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacucgacaucgagcuccagaagaccgaagcaacucagcuggccacacuuaggaaacuguguauugagggaaagaucaccaacauuacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcccauagagggaaaaguagugcaguaugaaaaucugaaguacacagucauuaucacugugcacaccggugaccagcaucagguuggcaacgacacacaaggggugaccgucgagauuacuccucaggcauccacgguggaagcuguacucccagaguauggaacacuuggccuggaaugcucuccgcgaaccgguuuggauuuuaaugagaugauccugcugacuaugaaaaacaaggccuggaugguucacagacagugguucuuugaccucccccugccuuggaccagcggggcgacaaccgagacuccaacauggaauaggaaagaacuucuggugacguucaagaacgcccaugccaagaagcaagaggucguggucuugggcucccaggaaggagcuaugcacaccgcccucacuggcgcuacagagauccaaaauucagggggaaccaguauuuuugccggucaccugaagugucgguuaaaaauggauaagcuggaacuaaaaggcaugagcuacgcaaugugccucaacacauucgugcugaagaaagagguuucugagacucagcaugggaccauacuuaucaagguggaauacaagggagaggacgcccccuguaaaauuccuuucuccacggaagauggccaagguaaggcucacaacgggcguuugaucaccgcgaauccaguagucacuaagaaggaggagcccgugaacauagaagcagagccgccuuuuggcgaaucaaauauuguuaucggaaucggcgacaaagcccugaagauuaacugguauaagaaagggagcaguaucggaaagauguucgaggcuacugcccgcggugcaagaaggauggccauucucggcgauaccgcuugggacuuugggucugugggaggcguccuaaauucccuugguaaaauggugcaucagauauucgggagcgccuacacagcacuguuuucgggcguaucuuggaucaugaagauuggaaucggcguguugcucacuuggaucgggcugaacuccaaaaauaccucaaugaguuucagcugcauuguuauaggaaucauuacguuauaucugggcgcggucgugcaggcugauauggguugugugaucaacuggaaggggaaggaacuaaaaugcggauccggcauuuuugucacaaaugagguucacaccuggacugagcaguacaaguuccaagccgacucucccaaacggcucgcaacagccaucgcuggugccugggaaaacggcgugugugggauacgaagcaccacucgcauggagaaucugcuuuggaagcagaucgcaaacgaauugaauuauauucugugggagaacaauaucaaacucaccgugguagucggagauauuaucggcgugcuggaacaggggaagagaacauuaacgccacagccuauggagcugaaauacucauggaagaccuggggaaaggcuaaaauaguuacugccgagauucaaaacaguuccuuuaucauugacggccccaacacaccagaaugccccagcgcgucuagggccuggaaugugugggaggucgaagacuaugguuucgggguguuuaccacaaacaucuggcuuaaguugcgggagauguacacucagucaugugaucaucgccucaugagugcugcaauaaaagacgaaagagccguucacgcugauaugggauacuggaucgagagccagaagaauggcuccuggaaacuggagaaggccucuuucauugaagugaagaccugcacguggccuaaaucgcacacacuauggagcaacgguguacuggaguccgacaugaucauuccaaagucacucgcaggcccgaucagucagcauaaucacaggcccggguaucauacccaaacugcgggaccuuggcaccugggcaaacuugaauuggauuuuaacuacugcgaggggaccacagucgugauaacugagaauuguggaacccguggcccaucucugcggacaacgaccgugagcgguaaguuaauucacgaauggugcugucgauccugcacucuacccccucugagauauaugggggaggacggauguugguacggcauggaaaucaggccaaucaacgagaaagaagagaauauggucaagucacuuguuagcgccgguucuggcaagguggauaacuucacaauggggguacugugcuuggcuauucucuucgaggaagugaugcgcggaaaauuuggcaagaaacauaugaucgucggggugcuguucaccuuuguucuacugcucuccggacagauuacuuggcgggacauggcccacacacugauaaugaucggcaguaaugcaagcgauagaauggguaugggggugaccuaucuugcuuugauugccacguucaagauccagcccuuucuggcauuaggauucuuucucaggaaacugacuucucgcgagaaccuucugcuaggcgucggccucgccauggcuaccacacugcaauugccggaagacauugagcagauggcgaaugggaucgcccugggauuaaugacccucaagcugauaacucaguucgaaacauaccagcuuuggaccgcacugguguccuugacauguucaaacacuaucuuuacccucacgguugcuuggcgaacagccacccugauucuagccggugugagucugcuuccucucugccaaagcucguccaugcggaagacugauuggcugccaaugaccgucgcugcaaugggcguacccccuuugccccuguucaucuuuucuuuaaaagacacaccaaagcguagaagcuggccucucaaugagggggugauggccguuggacuggugucaauucuugcgaguucccuguugaggaacgauguccccauggcuggcccacucguggccggugggcugcuaaucgcauguuauguaauaacuggaaccucugccgaccugacgguggagaaagcugcagacgucacaugggaagaggaagccgagcagaccggcguuagccauaaccuuaugauuacuguggaugacgauggcacaaugcgcaucaaggacgaugaaaccgagaauauccucacugugcuguugaaaacagcguuacugauugucuccgggauauucccguacucaaucccugcuacccuccugguguggcacacguggcagaagcagacucaacggagcggaguucuuugggacguacccaguccacccgagacccagaaagccgaacuggaggaagguguguacagaauuaagcagcagggcaucuuugggaagacacaagucggagugggcguucagaaagaggguguguuccauaccauguggcacgucacaagaggggcaguguugacucacaacggaaagcgacuagagccuaauugggccucugucaagaaggaucugauuuccuauggcggcggguggcgccucagcgcucaguggcaaaaaggagaagagguccaggugaucgccguugaaccagguaagaaccccaagaauuuccagaccaugccuggcauauuucagacgacaacuggggagaucggagcaauugcucuggacuucaaaccgggcaccucggguucaccaaucauuaaccgggaagggaagguggucggacuuuacggcaauggcgugguuaccaaaaacgggggauaugugucugguaucgcccaaaccaaugcggagcccgauggcccuacuccagaguuagaagaggaaauguuuaagaaaagaaaccugaccauaauggaccuccaucccgggaguggaaagacaaggaaguacuugccugccauuguccgugaggcaaucaaacgccggcugagaacgcucauccuggcuccgacuagggugguagccgcugaaauggaggaggcacuuaagggccugcccauucgauaucagaccacagccaccaaauccgaacacacuggucgggagaucguggauuugaugugccaugccacauucaccaugcgccuacugagcccaguuagagucccuaauuacaaccucauaauuauggacgaagcucacuuuacggaucccgcgucuaucgcagccaggggguauauuagcacucgggugggaaugggcgaggcugccgcaaucuucaugacagccaccccaccuggcaccgcugaagcguuuccccaguccaaugccccaauacaggacgaggagcgagacauuccggaaagaucauggaacagugggaaugaguggaucacugauuucgugggaaagacagucugguuuguaccuagcaucaaagcagguaacgacauugcuaacuguuuacgcaagaauggcaagaaagugauccaacugucuaggaagaccuucgauacagaauaccagaaaacucgucuuaacgacugggauuuuguugugacgaccgacauuuccgagaugggggccaauuucaaggcagaucgggucauagaccccagaaggugccugaaaccagugauccucacagauggacccgagcgcguuauuuuggccggcccuaugccagugacugcugccucagcggcacagcgaagaggucgggucgggaggaacccccagaaggaaaaugaccaauacaucuucaccggccagccucugaacaaugaugaggaccaugcccacuggacagaagcuaagaugcuccuggacaacaucaauaccccggagggaauuauaccagcccuuuuugaacccgagcgcgagaaaagugcugcaaucgauggcgaauaucgucuaaagggggagagcagaaaaacuuucguggaacugaugcggaggggagacuugccuguaugguuagcccacaagguggcuuccgaggguauuaaauacacggaucgcaaguggugcuuugacggcgaacgaaacaaucagauccuggaggagaacauggauguugaaauuuggaccaaagagggggaaagaaagaagcuccggcccagguggcuggacgcccgcacauauucugauccacuugcacugaaagaguucaaggacuuugcggccggaagaaaaucgaucgcucucgauuuggucacugaaauaggcagggugccuagccaucuggcccaccggacccguaaugcacuagacaaccuggugaugcuccauacaucagagcacggugggcgcgcuuaccgacacgccgucgaggaacuucccgagaccauggaaacucuguuauugcugggccucaugauccugcuuacaggaggcgcaaugcuguuccucauuuccgggaagggaaucgguaaaacgaguauuggcuugaucuguguuauagugucuagcgggaugcuguggauggccgauguaccauuacaguggauugcuuccgcgaucgugcuagaguuuuucaugaugguccugcucauuccugagccggaaaagcaaagaacaccccaggacaaucagcuugccuaugugguuaucggaauacugacuuuggcagcuaucguggccgccaacgagaugggccugcucgaaacaaccaagagggaucuggguaugucaaaagagccaggggucguaucuccuaccagcuaccuugacguggaccuccaucccgcaagugcuuggacacuguaugccguugcgacuacggugauuaccccaauguugcggcacacaaucgaaaauuccacugcuaacgucagccuggccgcaauugccaaccaagcuguggucuuaaugggccuagauaagggauggccuaucucuaaaauggaccugggcgugccccuccuugcacuggggugcuacucacagguuaauccguugacccugacagccgcggugcuccugcuuguaacccauuacgcuauaauuggaccaggcuuacaggccaaggcaacucgcgaggcccagaaaagaacggcugccgguaucaugaagaacccuacaguggaugggaucaugaccauugaccuggaucccgucaucuaugacuccaaguuugagaaacaacucggacagguuauguugcuggugcuaugugcaguccagcugcuccuuaugaggacaaguugggcucugugcgaagccuugacccuggcgacaggcccaauaacuacccucugggaggguagccccggcaaguucuggaauacaacgauugccgugucgauggcaaacaucuuucgggggucuuaccuggcuggagccggcuuagcauucuccauuaugaaaagcguagggaccggacgaagaggcacugguucacagggggaaacacuuggagagaaguggaaaaagaagcugaaucaacucagucgcaaagaauuugaucuauauaagaaaucuggcaucaccgagguggacaggacugaggcuaaggaaggucugaaacggggcgagacaacccaccaugccguuucccgugggagcgccaaguugcagugguucguggaaagaaacauggucauaccugagggaagggugaucgaucugggcugugggcgcggaggcuggucauacuauugcgcgggucucaaaaaggucacggaagugcggggguacaccaagggaggcccgggccacgaggagcccguuccaaugaguacauauggguggaauauuguaaaacuuaugagcggaaaggacguguucuaccugccucccgaaaaaugugauacuuugcugugcgacaucggugaguccucuccuagcccaaccgucgaagagucccgaacaauuagagugcucaagaugguugagcccuggcugaaaaacaaucaguuuuguaucaaggugcuaaacccuuacaugccaacugucauugaacaccuugagaggcugcagcgcaaguauggcgggaugcuagugcggaauccccucucaagaaacucuacccaugaaauguacuggaucaguaauggaacaggcaacauaguaucgagcgugaauaugguuucccgucuguugcugaacagguucaccaugacucaccggcgcccgacgauugagaaagaugucgaccucggugcugggacacgacaugugaacgcagaaccugagaccccaaauauggacgugaucggagagagaaucaagaggauuaaagaggaacacucuucaacuuggcacuaugaugacgaaaaccccuacaagaccugggccuaucauggcagcuacgaggucaaagcuacaggcuccgccaguucuaugauaaaugggguugugaaacuucugacgaagccuugggauguagugccaauggucacccaaauggcaaugacugacacaacccccuuuggacagcagcggguguucaaagaaaagguugauacucgcacaccgagaccuaugcccgguaccaggaaagugauggagaucacagccgagugguuauggcgaacucugggccggaacaagaaaccacguuugugcaccagagaagaguuuacgaagaagguccgcaccaaugcugcgaugggggccguguucacagaagagaaccaaugggacagcgcaagggcugccguagaagaugaggaguuuuggaaacucguugaccgggaaagagagcugcacaagcuaggaaaauguggcucaugcguguauaauaugauggguaagcgcgagaagaaacuuggggaguucggaaaagcaaaaggcuccagggccauuugguacauguggcugggcgcucgauaccucgaguuugaagcccugggguucuugaacgaggaucauugguuuagucgggaaaauagcuauucuggagucgagggugaaggccugcacaagcucggguacauccuuagagacauuuccaaaaucccuggaggcgcgauguaugcagaugacacugccgguugggacaccaggauaacagaggaugaccugcauaacgaggaaaagaucacucagcagauggaucccgagcaccgccaguuagcuucagccauuuucaaacugaccuaccaaaauaagguggugaaaguccagcguccaacgcccaaggggacaguuauggacaucauuagccggaaggaucagagaggaucgggccaggugggcaccuauggguugaacacuuuuacaaauauggaagcacaacucguaaggcagauggagggagaaggugugcugucuaaagcugaccuagagaacccucaccuucuggagaagaaaaucacccaguggcucgaaacuaagggcgucgagcgccugaaacgaauggccauaaguggggaugacugcgugguuaagccaauugaugaccgguucgcuaaugccuuguuagcacugaacgauaugggaaaggugagaaaagacaucccgcaguggcaacccuccaagggcuggcaugauuggcagcaggucccuuucuguagccaccauuuucacgaacucaucaugaaagacgguaggaaacuugugguaccaugccgcccccaggacgagcugauugggagagcgcggauaucacaaggagccggcuggucccuaaaagaaaccgcuugucugggcaaggccuacgcacagauguggucucucauguauuuccacaggcgugauuugcgacuggcuagcaacgccaucugcagugcaguuccugugcauugggucccaacaucccgcacgaccuggagcauucacgcccaucaccaguggaugacuacagaggacaugcuuaccguguggaauagaguuuggaucgaggauaaccccuggauggaagacaagacuccugugacaaccugggaggaugucccguaccuggggaaacgggaagaccaaugguguggaucucucauugguuuaacgucaagggcgacaugggcucagaauauccugaccgccauacaacaggugcgcaguuugaucggcgaugaggaguuucuggacuacaugccauccaugaagagauuccggaaagaagaggaaagcgagggggcaauuugguga

SEQ ID NO: 15670 - RNA, 9873 nt, Artificial Sequence
  derived and/or modified CDS sequence (opt3) from DENV-3__DQ675527__SS-prME
accagcuucugccugaugaugaugcuccccgccacacuugcuuuucaccugacuuccagagacggcgagccuaggaugaucguggggaagaacgaacggggaaaaucuuuguuauucaagacggcaucagguauuaauauguguacccugauagccauggaucuaggcgagaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccaaacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacuagacaucgagcuccagaagaccgaagcaacucaacuggccacacuuaggaaacuguguauugagggaaagaucaccaacauuacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcccauagagggaaaaguagugcaguaugaaaaucugaaguacacagucauuaucacugugcacaccggugaccagcaucagguuggcaacgacacacaaggggugaccgucgagauuacuccucaggcauccacgguggaagcuguacucccagaguauggaacacuuggccuggaaugcucuccgcgaaccgguuuggauuuuaaugagaugauccuacugacuaugaaaaacaaggccuggaugguucacagacagugguucuuugaccucccccugccuuggaccagcggggcgacaaccgagacuccaacauggaauaggaaagaacuucuggugacguucaagaacgcccaugcaaaaaagcaagaggucguggucuugggcucccaggaaggagcuaugcacaccgcccucacuggcgcuacagagauccagaauucagggggaaccaguauuuuugccggucaccugaagugucgguuaaaaauggauaagcuggaacuaaaaggcaugagcuacgcaaugugccucaacacauucgugcugaagaaagagguuucugagacucagcaugggaccauacuuaucaagguggaauacaagggagaggacgcccccuguaaaauuccuuucuccacggaagauggccaagguaaggcucacaacgggcguuugaucaccgcgaauccaguagucacaaaaaaggaggagcccgugaacauagaagcagagccgccuuuuggcgaaucaaauauuguuaucggaaucggcgacaaagcccugaagauuaacugguauaagaaagggagcaguaucggaaagauguucgaggcuacugcccgcggugcaagaaggauggccauucucggcgauaccgcuugggacuuugggucugugggaggcguccugaauucccuugguaaaauggugcaucagauauucgggagcgccuacacagcacuguuuucgggcguaucuuggaucaugaagauuggaaucggcguguugcucacuuggaucgggcugaacuccaaaaauaccucaaugaguuucagcugcauuguuauaggaaucauuacguuauaucugggcgcggucgugcaggcugauauggguugugugaucaacuggaaggggaaggaacuaaaaugcggauccggcauuuuugucacaaaugagguucacaccuggacugagcaguacaaguuccaagccgacucucccaaacggcucgcaacagccaucgcuggugccugggaaaacggcgugugugggauacgaagcaccacucgcauggagaaucugcuuuggaagcagaucgcaaacgaauugaauuauauucugugggagaacaauaucaaacucaccgugguagucggagauauuaucggcgugcuggaacaggggaagagaacauuaacgccacagccuauggagcugaaauacucauggaagaccuggggaaaggcuaaaauaguuacugccgagauucaaaacaguuccuuuaucauugacggccccaacacaccagaaugccccagcgcgucuagggccuggaaugugugggaggucgaagacuaugguuucgggguguuuaccacaaacaucuggcuuaaguugcgggagauguacacucagucaugugaucaucgccucaugagugcugcaauaaaagacgaaagagccguucacgcugauaugggauacuggaucgagagccagaagaauggcuccuggaaacuggagaaggccucuuucauugaagugaagaccugcacguggccuaaaucgcacacacuauggagcaacgguguacuggaguccgacaugaucauuccaaagucacucgcaggcccgaucagucagcauaaucacaggcccggguaucauacccaaacugcgggaccuuggcaccugggcaaacuugaauuggauuuuaacuacugcgaggggaccacagucgugauaacugagaauuguggaacccguggcccaucucugcggacaacgaccgugagcgguaaguuaauucacgaauggugcugucgauccugcacucuccccccucugagauauaugggggaggacggauguugguacggcauggaaaucaggccaaucaacgagaaagaagagaauauggucaagucacuuguuagcgccgguucuggcaagguggauaacuucacaauggggguacugugcuuggcuauucucuucgaggaagugaugcgcggaaaauuuggcaagaaacauaugaucgucggggugcuguucaccuuuguucuacugcucuccggacagauuacuuggcgggacauggcccacacacugauaaugaucggcaguaaugcaagcgauagaauggguaugggggugaccuaucuugcuuugauugccacguucaagauccagcccuuucuggcauuaggauucuuucucaggaaacugacuucucgcgagaaccuucugcuaggcgucggccucgccauggcuaccacacugcaauugccggaagacauugagcagauggcgaaugggaucgcccugggauuaaugacccucaagcugauaacucaguucgaaacauaccagcuuuggaccgcacugguguccuugacauguucaaacacuaucuuuacccucacgguugcuuggcgaacagccacccugauucuagccggugugagucugcuuccucucugccaaagcucguccaugcggaagacugauuggcugccaaugaccgucgcugcaaugggcguacccccuuugccccuguucaucuuuucuuuaaaagacacaccaaagcguagaagcuggccucucaaugagggggugauggccguuggacuggugucaauucuugcgaguucccuguugaggaacgauguccccauggcuggcccacucguggccggugggcugcuaaucgcauguuauguaauaacuggaaccucugccgaccugacgguggagaaagcugcagacgucacaugggaagaggaagccgagcagaccggcguuagccauaaccuuaugauuacuguggaugacgauggcacaaugcgcaucaaggacgaugaaaccgagaauauccucacugugcuguugaaaacagcguuacugauugucuccgggauauucccguacucaaucccugcuacccuccugguguggcacacguggcagaagcagacucaacggagcggaguucuuugggacguacccaguccacccgagacccagaaagccgaacuggaggaagguguguacagaauuaagcagcagggcaucuuugggaagacacaagucggagugggcguucagaaagaggguguguuccauaccauguggcacgucacaaggggggcaguguugacucacaacggaaagcgacuagagccuaauugggccucuguaaaaaaggaucugauuuccuauggcggcggguggcgccucagcgcucaguggcaaaaaggagaagagguccaggugaucgccguugaaccagguaagaaccccaagaauuuccagaccaugccuggcauauuucagacgacaacuggggagaucggagcaauugcucuggacuucaaaccgggcaccucggguucaccaaucauuaaccgggaagggaagguggucggacuuuacggcaauggcgugguuacaaaaaacgggggauaugugucugguaucgcccaaaccaaugcggagcccgauggcccuacuccagaguuagaagaggaaauguuuaagaaaagaaaccugaccauaauggaccuccaucccgggaguggaaagacaaggaaguacuugccugccauuguccgugaggcaaucaaacgccggcugagaacgcucauccuggcuccgacuagggugguagccgcugaaauggaggaggcacuuaagggccugcccauucgauaucagaccacagccaccaaauccgaacacacuggucgggagaucguggauuugaugugccaugccacauucaccaugcgccuacugagcccaguuagagucccuaauuacaaccucauaauuauggacgaagcucacuuuacggaucccgcgucuaucgcagccaggggguauauuagcacucgggugggaaugggcgaggcugccgcaaucuucaugacagccaccccaccuggcaccgcugaagcguuuccccaguccaaugccccaauacaggacgaggagcgagacauuccggaaagaucauggaacagugggaaugaguggaucacugauuucgugggaaagacagucugguuuguaccuagcaucaaagcagguaacgacauugcuaacuguuuacgcaagaauggcaagaaagugauccaacugucuaggaagaccuucgauacagaauaccagaaaacucgucuuaacgacugggauuuuguugugacgaccgacauuuccgagaugggggccaauuucaaggcagaucgggucauagaccccagaaggugccugaaaccagugauccucacagauggacccgagcgcguuauuuuggccggcccuaugccagugacugcugccucagcggcacagcgaagaggucgggucgggaggaacccccagaaggaaaaugaccaauacaucuucaccggccagccucugaacaaugaugaggaccaugcccacuggacagaagcuaagaugcuccuggacaacaucaauaccccggagggaauuauaccagcccuuuuugaacccgagcgcgagaaaagugcugcaaucgauggcgaauaucgucuaaagggggagagcagaaaaacuuucguggaacugaugcggaggggagacuugccuguaugguuagcccacaagguggcuuccgaggguauuaaauacacggaucgcaaguggugcuuugacggcgaacgaaucaaccagauucuggaggagaauauggauguugaaaucuggaccaaagagggggaaagaaagaaccuccggcccagguggcuggacgcccgcacauauucugauccacuugcacugaaggaguucaaagacuuugcggccggaagaaagucgauagcucucgauuuggucacugaaaucggcagggugccuagccaucuggcccaccggacccguaaugcacuagacaaccuggugaugcuccauacaucagagcacggugggcgcgcuuaccgacacgccgucgaggaacuucccgagaccauggaaacucuguuauugcugggccucaugauucugcuuacaggaggcgcaaugcuguuccucaucuccgggaaaggaauugguaagacgaguaucggcuugauauguguuauugugucuagcgggaugcuguggauggccgauguaccauuacaguggaucgcuuccgcgauugugcuagaguuuuucaugaugguccugcucaucccugagccggaaaaacaaagaaccccccaggacaaucagcuugccuaugugguuauaggaauccugacuuuggcagcuauuguggccgccaacgagaugggccugcucgaaacaaccaagagggaucuggguaugucaaaggagccaggggucguaucuccuaccagcuaccuugacguggaccuccaucccgcaagugcuuggacacuguaugccguugcgacuacggugaucaccccaauguugcggcacacaauugaaaauuccacugcuaacgucagccuggccgcaaucgccaaccaagcuguggucuuaaugggccuagauaaaggauggccuauaucuaagauggaccugggcgugccccuccuugcacuggggugcuacucacagguuaauccguugacccugacagccgcggugcuccugcuuguaacccauuacgcuauuaucggaccaggcuuacaggccaaagcaacucgcgaggcccagaagagaacggcugccgguaucaugaaaaacccuacaguggaugggauuaugaccaucgaccuggaucccgucauauaugacuccaaguuugagaagcaacucggacagguuauguugcuggugcuaugugcaguccagcugcuccuuaugaggacuaguugggcucugugcgaagccuugacccuggcgacaggcccaauuacuacccucugggaggguagccccggcaaauucuggaauacaacgaucgccgugucgauggcaaacauuuuucgggggucuuaccuggcuggagccggcuuagcauucuccaucaugaagagcguagggaccggacgaagaggcacugguucacagggggaaacacuuggagagaaauggaagaaaaagcugaaucaacucagucgcaaggaauuugaucuauauaaaaagucuggcauaaccgagguggacaggacugaggcuaaagaaggucugaagcggggcgagacaacccaccaugccguuucccgugggagcgccaaauugcagugguucguggaaagaaacauggucaucccugagggaagggugauugaucugggcugugggcgcggaggcuggucauacuauugcgcgggucucaagaaagucacggaagugcggggguacaccaagggaggcccgggccacgaggagcccguuccaaugaguacauauggguggaauaucguaaagcuuaugagcggaaaagacguguucuaccugccucccgaaaagugugauacuuugcugugcgacauuggugaguccucuccuagcccaaccgucgaagagucccgaacaaucagagugcucaaaaugguugagcccugguuaaagaacaaucaguuuuguauuaaagugcugaacccuuacaugccaacugucaucgaacaccuugagaggcugcagcgcaaguauggcgggaugcuagugcggaauccccucucaagaaacucuacccaugaaauguacuggauaaguaauggaacaggcaacauuguaucgagcgugaauaugguuucccgucuguugcugaacagguucaccaugacucaccggcgcccgacgaucgagaaggaugucgaccucggugcugggacacgacaugugaacgcagaaccugagaccccaaauauggacgugaucggagagagaauuaaaaggauaaaggaagagcacucuucaacuuggcacuaugaugacgaaaaccccuacaaaaccugggccuaucauggcagcuacgaggucaaggcuacaggcuccgccaguucuaugaucaaugggguugugaaacuucugacgaagccuugggauguagugccaauggucacccaaauggcaaugacugacacaacccccuuuggacagcagcggguguucaaggaaaaaguugauacucgcacaccgagaccuaugcccgguaccaggaaggugauggagauuacagccgagugguuauggcgaacucugggccggaacaaaaagccacguuugugcaccagagaagaguuuacgaaaaagguccgcaccaaugcugcgaugggggccguguucacagaagagaaccaaugggacagcgcaagggcugccguagaagaugaggaguuuuggaagcucguugaccgggaaagagagcugcacaaacuaggaaaguguggcucaugcguguauaauaugauggguaaacgcgaaaagaaacuuggggaguucggaaaggcaaaaggcuccagggccaucugguacauguggcugggcgcucgauaccucgaguuugaagcccugggguucuugaacgaggaucauugguuuagucgggaaaauagcuauucuggagucgagggugaaggccugcacaagcucggguacauucuuagagacaucuccaagauaccuggaggcgcgauguaugcagaugacacugccgguugggacaccaggaucacagaggaugaccugcauaacgaggaaaaaauuacucagcagauggaucccgagcaccgccaguuagcuucagccaucuucaagcugaccuaccaaaauaaaguggugaagguccagcguccaacgcccaaagggacaguuauggacauuaucagccggaaggaucagagaggaucgggccaggugggcaccuauggguugaacacuuuuacaaauauggaagcacaacucguaaggcagauggagggagaaggugugcugucuaaggcugaccuagagaacccucaccuucuggagaaaaagauaacccaguggcucgaaacuaaaggcgucgagcgccugaagcgaauggccauuaguggggaugacugcgugguuaaaccaaucgaugaccgguucgcuaaugccuuguuagcacugaacgauaugggaaaggugagaaaggacaucccgcaguggcaacccuccaaaggcuggcaugauuggcagcaggucccuuucuguagccaccauuuucacgaacucauuaugaaggacgguaggaaacuugugguaccaugccgcccccaggacgagcugauagggagagcgcggaucucacaaggagccggcuggucccuaaaggaaaccgcuugucugggcaaagccuacgcacagauguggucucucauguauuuccacaggcgugauuugcgacuggcuagcaacgccauuugcagugcaguuccugugcauugggucccaacaucccgcacgaccuggagcauccacgcccaucaccaguggaugacuacagaggacaugcuuaccguguggaauagaguuuggauugaggauaaccccuggauggaagacaagacuccugugacaaccugggaggaugucccguaccuggggaagcgggaagaccaaugguguggaucucucaucgguuuaacgucaagggcgacaugggcucagaauauacugaccgccauccagcaggugcgcaguuugauuggcgaugaggaguuucuggacuacaugccauccaugaaaagauuccggaaggaagaggaaagcgagggggcaaucugguga

SEQ ID NO: 15671 - RNA, 9873 nt, Artificial Sequence
  derived and/or modified CDS sequence (opt3) from DENV-3__DQ675528__SS-prME
accagcuucugccugaugaugaugcuccccgccacacuugcuuuucaccugacuuccagagacggcgaaccuaggaugaucguggggaagaacgaacggggaaaaucuuuguuauucaagacggcaucagguauuaauauguguacccugauagccauggauuuaggcgaaaugugcgacgauacagucacuuacaaauguccacucaucgcggaaguugagccggaagacauugauugcugguguaaccugaccaguacaugggugaccuaugggacuugcaaucaggcuggagagcaucgccgagacaagcguagcguagcccuugcaccccacgugggcaugggucuggauacaagaacccagacguggauguccgccgagggggcuuggaggcaggucgaaaaaguggagacuugggcauugcggcauccuggauuuaccauccucgcccuguuccuggcucacuacauuggcacaucucucacucagaagguugugaucuuuauauuacugaugcuugucaccccaucgaugacaaugcgcugugugggcguagggaacagagacuucguugaaggauugucaggugccaccuggguggaugucgugcuggagcauggcgggugcgugacgacuauggcgaagaauaaacccacacucgacaucgagcuccagaagaccgaagcaacucagcuggccacacuuaggaaacuguguauugagggaaagaucaccaacauuacgaccgauagccggugcccuacacagggcgaagcuaucuugccagaggaacaggaccagaauuaugucuguaaacacacuuacguugaucgcgguugggggaacggaugcggccucuuuggcaaggggagucuggugaccugcgccaaguuccaauguuuagagcccauagagggaaaaguagugcaguaugaaaaucugaaguacacagucauuaucacugugcacaccggugaccagcaucagguuggcaacgacacacaaggggugaccgucgagauuacuccucaggcauccacgguggaagcuguacucccagaguauggaacacuuggccuggaaugcucuccgcgaaccgguuuggauuuuaaugagaugauccugcugacuaugaaaaacaaggccuggaugguucacagacagugguucuuugaccucccccugccuuggaccagcggggcgacaaccgagacuccaacauggaauaggaaagaacuucuggugacguucaagaacgcccaugccaagaagcaagaggucguggucuugggcucccaggaaggagcuaugcacaccgugcucacuggcgccacagagauccaaaauucagggggaaccaguauuuuugcuggucaccugaagugucgguuaaaaauggauaagcuggaacuaaaaggcaugagcuacgccaugugccucaacacauucguucugaagaaagaggugucugagacucagcaugggaccauacuuaucaagguagaauacaagggagaggacgcacccuguaaaauuccuuucuccacggaagauggccaagguaaggcccacaacgggcguuugaucaccgcuaauccagucgugacuaagaaggaggagcccguuaacauagaagcggagccgccuuuuggcgaaucaaauauugugaucggaaucggcgacaaagcacugaagauuaacugguauaagaaagggagcaguaucggaaagauguucgaggccacugcucgcggugccagaaggauggcaauucucggcgauaccgccugggacuuugggucugucggaggcgugcuaaauucccuugguaaaaugguacaucagauauucgggagcgcuuacacagcccuguuuucgggcgugucuuggaucaugaagauuggaaucggcguuuugcucacuuggaucgggcugaacuccaaaaauaccucaaugaguuucagcugcauugucauaggaaucauuacguuauaucugggcgcaguggugcaggcggauauggguugugucaucaacuggaaggggaaggaacuaaaaugcggauccggcauuuuuguuacaaaugaggugcacaccuggacugagcaguacaaguuccaagcugacucucccaaacggcucgccacagcaaucgccggugcuugggaaaacggcgugugugggauacgaagcaccacucgcauggagaaucugcuuuggaagcagaucgccaacgaauugaauuauauucugugggagaacaauaucaaacucaccguagucgugggagauauuaucggcguucuggaacaggggaagagaacauuaacgccacagccuauggagcugaaauacucauggaagaccuggggaaaggcaaaaauagugacugcugagauucaaaacaguuccuuuaucauugacggccccaacacaccagaaugccccagcgccucuagggcguggaaugucugggagguggaagacuaugguuucgggguuuuuaccacaaacaucuggcuuaaguugcgggagauguacacucagucaugugaucaucgccucaugagugccgcuauaaaagacgaaagagcagugcacgccgauaugggauacuggaucgagagccagaagaauggcuccuggaaacuggagaaggcuucuuucauugaaguaaagaccugcacguggccuaaaucgcacacacuauggagcaacgguguccuggaguccgacaugaucauuccaaagucacucgccggcccgaucagucagcauaaucacaggcccggguaucauacccaaacugcaggaccuuggcaccugggcaaacuugaauuggauuuuaacuacugcgaggggaccacaguggugauaacugagaauuguggaacccguggcccaucucugcggacaacgaccgucagcgguaaguuaauucacgaauggugcugucgauccugcacucuacccccucugagauauaugggggaggacggauguugguacggcauggaaaucaggccaaucaacgagaaagaagagaauaugguuaagucacuugugagcgcggguucuggcaagguagauaacuucacaaugggggugcugugcuuggccauucucuucgaggaagucaugcgcggaaaauuuggcaagaaacauaugaucguggggguucuguucaccuuugugcuacugcucuccggacagauuacuuggcgggacauggcucacacacugauaaugaucggcaguaaugccagcgauagaauggguaugggggucaccuaucuugcauugauugcuacguucaagauccagcccuuucuggccuuaggauucuuucucaggaaacugacuucucgcgagaaccuucugcuaggcgugggccucgcaauggccaccacacugcaauugccggaagacauugagcagauggcuaaugggaucgcgcugggauuaaugacccucaagcugauaacucaguucgaaacauaccagcuuuggaccgcccugguuuccuugacauguucaaacacuaucuuuacccucacgguggcauggcgaacagcuacccugauucuagccggugucagucugcuuccucucugccaaagcucguccaugcggaagacugauuggcugccaaugaccguagccgcuaugggcgugcccccuuugccccuguucaucuuuucuuuaaaagacacaccaaagcguagaagcuggccucucaaugaggggguuauggcagugggacuggucucaauucuugccaguucccuguugaggaacgaugugcccauggcgggcccacucguagcuggugggcugcuaaucgccuguuaugugauaacuggaaccucugcagaccugacggucgagaaagccgcugacguuacaugggaagaggaagcagagcagaccggcgugagccauaaccuuaugauuacuguggaugacgauggcacaaugcgcaucaaggacgaugaaaccgagaauauccucacuguccuguugaaaacagccuuacugauuguguccgggauauucccguacucaaucccugcgacccuccugguuuggcacacguggcagaagcagacucaacggagcggaguacuuugggacgugcccaguccacccgagacccagaaagcugaacuggaggaaggugucuacagaauuaagcagcagggcaucuuugggaagacacaagugggaguuggcgugcagaaagagggugucuuccauaccauguggcacgugacacgaggggcaguauugacucacaacggaaagaggcuagagccuaauugggcaucugucaaaaaggaucugauuuccuauggcggcggguggcgccucagcgcccaguggcaaaaaggagaagaggugcagguuaucgcuguggaaccagguaagaaccccaagaauuuccagaccaugccuggcauauuucagacgacaacuggggagaucggagccauugcacuggacuucaaaccgggcaccucggguucaccaaucauuaaccgggaagggaaggucgugggacuuuacggcaauggcguugugaccaagaacgggggauaugucucugguaucgcucaaaccaaugccgagcccgauggcccuacuccagaguuagaagaggaaauguuuaagaaaagaaaccugaccauaauggaccuccaucccgggaguggaaagacaaggaaguacuugccugcgauugugcgugaggccaucaaacgccggcugagaacgcucauccuggcaccgacuaggguaguggcugccgaaauggaggaggcucuuaagggccugcccauucgauaucagaccacagcaaccaaauccgaacacacuggucgggagaucguugauuugaugugccaugccacauucaccaugcgccuacugagcccagucagagugccuaauuacaaccucauaauuauggacgaagcccacuuuacggaucccgcuucuaucgcggcaaggggguauauuagcacucgggugggaaugggcgaggccgcugccaucuucaugacagcaaccccaccuggcaccgccgaggcuuuuccccaguccaaugcgccaauacaggacgaggagcgagacauuccggaaagaucauggaacagugggaaugaguggaucacugauuucgucggaaagacaguaugguuugugccuagcaucaaagccgguaacgacauugcaaacuguuuacgcaagaauggcaagaaaguuauccaacugucuaggaagaccuucgauacagaauaccagaaaacucgucuuaacgacugggauuuuguggucacgaccgacauuuccgagaugggggcuaauuucaaggccgaucgggugauagaccccagaaggugccugaaaccaguuauccucacagauggacccgagcgcgugauuuuggcaggcccuaugccagucacugccgcuucagccgcgcagcgaagaggucggguggggaggaacccccagaaggaaaaugaccaauacaucuucaccggccagccucugaacaaugaugaggaccaugcacacuggacagaagccaagaugcuccuggacaacaucaauaccccggagggaauuauaccagcucuuuuugaacccgagcgcgagaaaagugccgcuaucgauggcgaauaucgucuaaagggggagagcagaaaaacuuucguagaacugaugcggaggggagacuugccugugugguuagcacacaagguugccuccgaggguauuaaauacacggaucgcaaguggugcuuugacggcgaacgaaacaaucagauccuggaggagaacauggaugucgaaauuuggaccaaagagggggaaagaaagaagcuccggcccagguggcuggacgcucgcacauauucugauccacuugcccugaaagaguucaaggacuuugcagcgggaagaaaaucgaucgcccucgauuuggugacugaaauaggcagggugccuagccaucuggcucaccggacccguaaugcccuagacaaccuggucaugcuccauacaucagagcacggugggcgcgcauaccgacacgcuguugaggaacuucccgagaccauggaaacucuguuauugcugggccucaugauccugcuuacaggaggcgccaugcuguuccucauuuccgggaagggaaucgguaaaacgaguauuggcuugaucugugugauaguaucuagcgggaugcuguggauggcagaugugccauuacaguggauugccuccgcuaucguccuagaguuuuucaugauggugcugcucauuccugagccggaaaagcaaagaacaccccaggacaaucagcuugcguauguugugaucggaauacugacuuuggccgcaaucgucgcugccaacgagaugggccugcucgaaacaaccaagagggaucuggguaugucaaaagagccagggguagugucuccuaccagcuaccuugacguugaccuccaucccgccagugcauggacacuguaugcuguggccacuacggucauuaccccaauguugcggcacacaaucgaaaauuccacugcgaacgugagccuggcugccauugcaaaccaagccgucguguuaaugggccuagauaagggauggccuaucucuaaaauggaccugggcguuccccuccuugcucuggggugcuacucacaggugaauccguugacccugacagcagccguacuccugcuugugacccauuacgcgauaauuggaccaggcuuacaggcuaaggccacucgcgaggcacagaaaagaacggccgcugguaucaugaagaacccuacagucgaugggaucaugaccauugaccuggaucccguuaucuaugacuccaaguuugagaaacaacucggacaggugauguugcugguccuaugugccgugcagcugcuccuuaugaggacaaguugggcacugugcgaggcuuugacccuggccacaggcccaauaacuacccucugggaggguagccccggcaaguucuggaauacaacgauugcgguaucgauggccaacaucuuucgggggucuuaccuggcaggagcuggcuuagccuucuccauuaugaaaagcguggggaccggacgaagaggcacugguucacagggggaaacacuuggagagaaguggaaaaagaagcugaaucaacucagucgcaaagaauuugaucuauauaagaaaucuggcaucaccgagguugacaggacugaggcaaaggaaggucugaaacggggcgagacaacccaccaugcugugucccgugggagcgccaaguugcagugguucgucgaaagaaacauggugauaccugagggaagggucaucgaucugggcugugggcgcggaggcuggucauacuauugcgccggucucaaaaaggugacggaaguucggggguacaccaagggaggcccgggccacgaggagcccguaccaaugaguacauauggguggaauauugugaaacuuaugagcggaaaggacgucuucuaccugccucccgaaaaaugugauacuuugcugugcgacaucggugaguccucuccuagcccaaccguggaagagucccgaacaauuagaguucucaagaugguggagcccuggcugaaaaacaaucaguuuuguaucaagguccuaaacccuuacaugccaacugugauugaacaccuugagaggcugcagcgcaaguauggcgggaugcuaguacggaauccccucucaagaaacucuacccaugaaauguacuggaucaguaauggaacaggcaacauagugucgagcguuaauauggucucccgucuguugcugaacagguucaccaugacucaccggcgcccgacgauugagaaagauguggaccucggugcggggacacgacaugugaacgcugaaccugagaccccaaauauggacgucaucggagagagaaucaagaggauuaaagaagaacacucuucaacuuggcacuaugaugacgaaaaccccuacaagaccugggcauaucauggcagcuacgagguuaaagccacaggcuccgcuaguucuaugauaaauggggugguaaaacuucugacgaagccuugggauguggucccaauggugacccaaauggccaugacugacacaacccccuuuggacagcagcggguuuucaaagaaaagguggauacucgcacaccgagaccuaugcccgguaccaggaaagucauggagaucacagcagagugguuauggcgaacucugggccggaacaagaaaccacguuugugcaccagagaagaguuuacgaagaaggugcgcaccaaugccgcuaugggggcgguauucacagaagagaaccaaugggacagcgccagggcagcuguugaagaugaggaguuuuggaaacucguggaccgggaaagagagcugcacaagcuaggaaaauguggcucaugcgucuauaauaugauggguaagcgcgagaagaaacuuggggaguucggaaaagccaaaggcuccagggcaauuugguacauguggcugggcgcccgauaccucgaguuugaagcucugggguucuugaacgaggaucauugguuuagucgggaaaauagcuauucuggaguggagggugaaggccugcacaagcucggguacauccuuagagacauuuccaaaaucccuggaggcgccauguaugcggaugacacugcagguugggacaccaggauaacagaggaugaccugcauaacgaggaaaagaucacucagcagauggaucccgagcaccgccaguuagccucagcuauuuucaaacugaccuaccaaaauaagguggucaaaguucagcguccaacgcccaaggggacagugauggacaucauuagccggaaggaucagagaggaucgggccagguaggcaccuauggguugaacacuuuuacaaauauggaagcccaacucgugaggcagauggagggagaagguguccugucuaaagcagaccuagagaacccucaccuucuggagaagaaaaucacccaguggcucgaaacuaagggcguggagcgccugaaacgaauggcuauaaguggggaugacugcguugugaagccaauugaugaccgguucgccaaugcuuuguuagcccugaacgauaugggaaaggucagaaaagacaucccgcaguggcaacccuccaagggcuggcaugauuggcaacaggugccuuucuguagccaccauuuucacgaacucaucaugaaagacgguaggaaacuuguaguuccaugccgcccccaggacgagcugauugggagagcacggauaucacaaggagcgggcuggucccuaaaagaaaccgccugucugggcaaggcuuacgcccagauguggucucucauguauuuccacaggcgugauuugcgacuggcaagcaacgcuaucugcagugccgugccuguccauugggugccaacaucccgcacgaccuggagcauucacgcacaucaccaguggaugacuacagaggacaugcuuaccguuuggaauagaguguggaucgaggauaaccccuggauggaagacaagacuccugucacaaccugggaggaugugccguaccuggggaaacgggaagaccaaugguguggaucucucauugguuuaacgucaagggccacaugggcgcagaauauccugaccgcuauacagcagguacgcaguuugaucggcgaugaggaguuucuggacuacaugccauccaugaagagauuccggaaagaagaggaaagcgagggggccauuugguga

SEQ ID NO: 15672 - RNA, 9873 nt, Artificial Sequence
  derived and/or modified CDS sequence (opt3) from DENV-3__DQ675530__SS-prME
acuagcuucugccugaugaugaugcuccccgcaacacuugcuuuucaccugacauccagggacggcgaaccuaggaugaucguggggaagaacgaacggggaaaaucuuuguuauucaagacggcaucagguauuaauauguguacccugauagccauggaucuuggcgagaugugcgacgauacaguaacuuacaaauguccacucaucgcggaaguugagccggaagacauugauugcugguguaaccugaccaguacaugggugaccuaugggacuugcaaucaggcuggagagcaucgccgagacaagcguagcguggcccuugcaccccacgugggcaugggucuggauacaagaacccagacguggauguccgccgagggggcuuggaggcaggucgaaaaaguggagacuugggcauugcggcauccuggauuuaccauccucgcccuguuccuggcucacuacauuggcacaucuccaacucagaagguugugaucuuuauacucuuaaugcuggucacccccucgaugacaaugcgcugugugggcguagggaacagagacuucguugaaggacuuucaggugccaccuggguggaugucguguuggagcauggcgggugcgugacgacuauggcgaagaauaaaccuacacuggacaucgagcuacagaagaccgaagcaacucagcucgccacacugaggaaacuuuguauugagggaaagaucaccaacauuacgaccgauagccggugcccaacacagggcgaagcuauccugcccgaggaacaggaccagaauuaugucuguaaacacacuuacguugaucgcgguugggggaacggaugcggcuuguuuggcaaggggagucucgugaccugcgccaaguuccaaugucuggagccuauagagggaaaaguagugcaguaugaaaauuuaaaguacacagucauuaucacugugcacaccggugaccagcaucagguuggcaacgacacacaaggggugaccgucgagauuacuccacaggcauccacgguggaagcuguacugccggaguauggaacacucggccuugaaugcucuccccgaaccggucuggauuuuaaugagaugaucuugcuaacuaugaaaaacaaggccuggaugguucacagacagugguucuuugaccugccucucccauggaccagcggggcgacaaccgagacucccacauggaauaggaaagaacugcuugugacguucaagaacgcccaugccaagaagcaagaggucgugguccugggcucccaggaaggagcuaugcacaccgccuugacuggcgcuacagagauccaaaauucagggggaaccaguauuuuugccggucaccucaagugucggcugaaaauggauaaguuagaacugaaaggcaugagcuacgcaaugugccuaaacacauucgugcucaagaaagagguuucugagacucagcaugggaccauacugaucaagguggaauacaagggagaggacgccccuuguaaaauuccauucuccacggaagauggccaagguaaggcucacaacgggcgucuuaucaccgcgaaucccguagucacuaagaaggaggagccggugaacauagaagcagagccucccuuuggcgaaucaaauauuguuaucggaaucggcgacaaagccuugaagauuaacugguauaagaaagggagcaguaucggaaagauguucgaggcuacugcccgcggugcaagaaggauggccauucugggcgauaccgcuugggacuuugggucugugggaggcguccucaauucccuggguaaaauggugcaucagauauucgggagcgccuacacagcacuauuuucgggcguaucuuggaucaugaagauuggaaucggcgugcuguugacuuggaucgggcucaacuccaaaaauaccucaaugaguuucagcugcauuguuauaggaaucauuacgcuguauuuaggcgcggucgugcaggcugauauggguugugugaucaacuggaaggggaaggaacugaaaugcggauccggcauuuuugucacaaaugagguucacaccuggacugagcaguacaaguuccaagccgacucuccaaaacggcuagcaacagccaucgcuggugccugggaaaacggcgugugugggauacgaagcaccacucgcauggagaaucuccuguggaagcagaucgcaaacgaacuuaauuauauuuugugggagaacaauaucaaacugaccgugguagucggagauauuaucggcgugcucgaacaggggaagagaacacugacgccucagcccauggaguuaaaauacucauggaagaccuggggaaaggcuaaaauaguuacugccgagauucaaaacaguuccuuuaucauugacggcccaaacacacccgaaugcccuagcgcgucuagggccuggaaugugugggaggucgaagacuaugguuucgggguguuuaccacaaacaucuggcugaaacuucgggagauguacacucagucaugugaucaucgcuugaugagugcugcaauaaaagacgaaagagccguucacgcugauaugggauacuggaucgagagccagaagaauggcuccuggaaacucgagaaggccucuuucauugaagugaagaccugcacguggccaaaaucgcacacacuguggagcaacgguguacuagaguccgacaugaucauuccgaagucacuggcaggccccaucagucagcauaaucacaggccuggguaucauacccaaacugcgggaccauggcaccucggcaaacuggaacuugauuuuaacuacugcgaggggaccacagucgugauaacugagaauuguggaacccguggccccucuuugcggacaacgaccgugagcgguaagcugauucacgaauggugcugucgauccugcacuuuaccuccacucagauauaugggggaggacggauguugguacggcauggaaaucaggcccaucaacgagaaagaagagaauauggucaagucacugguuagcgccgguucuggcaagguggauaacuucacaauggggguacuuugccuggcuauuuuguucgaggaagugaugcgcggaaaauuuggcaagaaacauaugaucgucgggguacucuucaccuuuguucugcuacuguccggacagauuacuuggcgggacauggcccacacacucauaaugaucggcaguaaugcaagcgauagaauggguaugggggugaccuaucuggcucuuauugccacguucaagauccagccguuuuuggcacugggauucuuuuuaaggaaacucacuucucgcgagaaccugcuucugggcgucggccuagccauggcuaccacacuccaacugccugaagacauugagcagauggcgaaugggaucgccuugggacugaugaccuuaaagcucauaacucaguucgaaacauaccagcuguggaccgcacuugugucccugacauguucaaacacuaucuuuaccuugacgguugcuuggcgaacagccacccucauucuggccggugugagucuacugccacuuugccaaagcucguccaugcggaagacugauuggcuccccaugaccgucgcugcaaugggcguaccuccccugccauuguucaucuuuucucugaaagacacaccuaagcguagaagcuggcccuuaaaugagggggugauggccguuggacucgugucaauucuggcgaguucccuucugaggaacgaugucccaauggcuggcccguugguggccggugggcuccugaucgcauguuauguaauaacuggaaccucugccgaccuaacgguggagaaagcugcagacgucacaugggaagaggaagccgagcagaccggcguuagccauaaccugaugauuacuguggaugacgauggcacaaugcgcaucaaggacgaugaaaccgagaauauccuuacugugcuccugaaaacagcguuguuaauugucuccgggauauucccuuacucaauccccgcuacccugcucguguggcacacguggcagaagcagacucaacggagcggaguucugugggacguaccaagucccccugagacccagaaagccgaacuugaggaagguguguacagaauuaagcagcagggcaucuuugggaagacacaagucggagugggcguucagaaagaggguguguuccauaccauguggcacgucacaagaggggcagugcugacucacaacggaaagcgauuggagccaaauugggccucugucaaaaaggaucuaauuuccuauggcggcggguggcgccugagcgcucaguggcaaaaaggagaagagguccaggugaucgccguugaacccgguaagaacccuaagaauuuccagaccaugccgggcauauuucagacgacaacuggggagaucggagcaauugcucucgacuucaaaccaggcaccucggguucacccaucauuaaccgggaagggaagguggucggacuguacggcaauggcgugguuaccaaaaacgggggauaugugucugguaucgcccaaaccaaugcggagccugauggcccaacucccgagcuugaagaggaaauguuuaagaaaagaaacuuaaccauaauggaccugcauccugggaguggaaagacaaggaaguaccucccggccauuguccgugaggcaaucaaacgccgguugagaacgcugauccucgcucccacuagggugguagccgcugaaauggaggaggcacugaagggccuuccaauucgauaucagaccacagccaccaaauccgaacacacuggucgggagaucguggaucugaugugccaugccacauucaccaugcgcuugcuaagcccuguuagaguccccaauuacaaccugauaauuauggacgaagcucacuuuacggauccagcgucuaucgcagccaggggguauauuagcacucgggugggaaugggcgaggcugccgcaaucuucaugacagccaccccucccggcaccgcugaagcguuuccacaguccaaugccccgauacaggacgaggagcgagacauuccugaaagaucauggaacagugggaaugaguggaucacugauuucgugggaaagacagucugguuuguacccagcaucaaagcagguaacgacauugcuaacugucuccgcaagaauggcaagaaagugauccaauuaucuaggaagaccuucgauacagaauaccagaaaacucgucugaacgacugggauuuuguugugacgaccgacauuuccgagaugggggccaauuucaaggcagaucgggucauagacccaagaaggugccuuaaacccgugauccugacagauggaccugagcgcguuauucucgccggcccaaugcccgugacugcugccucagcggcacagcgaagaggucgggucgggaggaacccucagaaggaaaaugaccaauacaucuucaccggccagccguugaacaaugaugaggaccaugcccacuggacagaagcuaagaugcugcucgacaacaucaauaccccagagggaauuauacccgcccuguuugaaccugagcgcgagaaaagugcugcaaucgauggcgaauaucgucuuaagggggagagcagaaaaacuuucguggaacuaaugcggaggggagaccugcccguaugguuggcccacaagguggcuuccgaggguauuaaauacacggaucgcaaguggugcuuugacggcgaacgaaacaaucagaucuuagaggagaacauggauguugaaauuuggaccaaagagggggaaagaaagaagcugcggccaagguggcucgacgcccgcacauauucugauccucuggcacuuaaagaguucaaggacuuugcggccggaagaaaaucgaucgcucuggaucucgucacugaaauaggcagggugcccagccauuuggcccaccggacccguaaugcacuggacaaccuagugaugcugcauacaucagagcacggugggcgcgcuuaccgacacgccgucgaggaacucccagagaccauggaaacucuucuguuauugggccugaugauccuccugacaggaggcgcaaugcuuuuccugauuuccgggaagggaaucgguaaaacgaguauuggccucaucuguguuauagugucuagcgggauguuguggauggccgauguaccucugcaguggauugcuuccgcgaucguguuagaguuuuucaugaugguccuacugauuccggagcccgaaaagcaaagaaccccacaggacaaucagcucgccuaugugguuaucggaauacuuacucuggcagcuaucguggccgccaacgagaugggcuugcuggaaacaaccaagagggaucucgguaugucaaaagagccuggggucguaucucccaccagcuaccuggacguggaccuucauccagcaagugcuuggacacucuaugccguugcgacuacggugauuaccccuaugcugcggcacacaaucgaaaauuccacugcuaacgucagcuuggccgcaauugccaaccaagcugugguccugaugggcuuagauaagggauggcccaucucuaaaauggaccuaggcgugccgcugcucgcacuugggugcuacucacagguuaauccacugaccuugacagccgcggugcugcuccugguaacccauuacgcuauaauuggaccuggccuucaggccaaggcaacucgcgaggcccagaaaagaacggcugccgguaucaugaagaaccccacaguggaugggaucaugaccauugacuuagauccagucaucuaugacuccaaguuugagaaacaacugggacagguuaugcucuuggugcugugugcaguccagcuacugcucaugaggacaaguugggcucuuugcgaagcccugaccuuggcgacaggccccauaacuacccugugggaggguagcccuggcaaguucuggaauacaacgauugccgugucgauggcaaacaucuuucgggggucuuaccucgcuggagccggccuggcauucuccauuaugaaaagcguagggaccggacgaagaggcacugguucacagggggaaacauuaggagagaaguggaaaaagaaacuuaaucaacugagucgcaaagaauuugaucucuauaagaaaucuggcaucaccgagguggacaggacugaggcuaaggaaggucuaaaacggggcgagacaacccaccaugccguuucccgugggagcgccaagcugcagugguucguggaaagaaacauggucauaccggagggaagggugaucgauuugggcugugggcgcggaggcuggucauacuauugcgcgggucugaaaaaggucacggaagugcggggguacaccaagggaggccccggccacgaggagccaguuccuaugaguacauauggguggaauauuguaaaacucaugagcggaaaggacguguucuaccuucccccugaaaaaugugauacucuguugugcgacaucggugaguccucuccaagccccaccgucgaagagucccgaacaauuagagugcugaagaugguugagccuuggcucaaaaacaaucaguuuuguaucaagguguuaaacccauacaugcccacugucauugaacaccuggagaggcuucagcgcaaguauggcgggaugcuggugcggaauccgcuaucaagaaacucuacccaugaaauguacuggaucaguaauggaacaggcaacauaguaucgagcgugaauaugguuucccgucuccuguugaacagguucaccaugacucaccggcgcccuacgauugagaaagaugucgaccugggugcugggacacgacaugugaacgcagaaccagagacccccaauauggacgugaucggagagagaaucaagaggauuaaagaggaacacucuucaacuuggcacuaugaugacgaaaacccuuacaagaccugggccuaucauggcagcuacgaggucaaagcuacaggcuccgccaguucuaugauaaaugggguugugaagcuccuuacgaagccaugggauguagugcccauggucacccaaauggcaaugacugacacaaccccguuuggacagcagcggguguucaaagaaaagguugauacucgcacaccuagacccaugccagguaccaggaaagugauggagaucacagccgaguggcuguggcgaacuuuaggccggaacaagaaaccucgucugugcaccagagaagaguuuacgaagaagguccgcaccaaugcugcgaugggggccguguucacagaagagaaccaaugggacagcgcaagggcugccguagaagaugaggaguuuuggaaauugguugaccgggaaagagagcuccacaagcugggaaaauguggcucaugcguguauaauaugauggguaagcgcgagaaaaagcuaggggaguucggaaaagcaaagggcuccagggccauuugguacauguggcuuggcgcucgauaccuggaguuugaagcccucggguuccugaacgaggaucauugguuuagucgggaaaauagcuauucuggagucgagggugaaggcuugcacaagcugggguacauccucagagacauuuccaaaauccccggaggcgcgauguaugcagaugacacugccgguugggacaccaggauaacagaggaugaccuucauaacgaggaaaagaucacucagcagauggauccagagcaccgccagcuggcuucagccauuuucaaauuaaccuaccaaaauaagguggugaaaguccagcgucccacgccuaaggggacaguuauggacaucauuagccggaaggaucagagaggaucgggccaggugggcaccuaugggcugaacacuuuuacaaauauggaagcacaauugguaaggcagauggagggagaaggugugcucucuaaagcugaccuggagaacccacaccuacuugagaagaaaaucacccaguggcuggaaacuaagggcgucgagcgccucaaacgaauggccauaaguggggaugacugcgugguuaagccgauugaugaccgguucgcuaaugcccuguuggcauuaaacgauaugggaaaggugagaaaagacaucccccaguggcaaccuuccaagggcuggcaugauuggcagcaggucccauucuguagccaccauuuucacgaacugaucaugaaagacgguaggaagcucgugguacccugccgcccucaggacgagcuuauugggagagcgcggauaucacaaggagccggcuggucccugaaagaaaccgcuugucuaggcaaggccuacgcacagauguggucucugauguauuuccacaggcgugaucuccgauuggcuagcaacgccaucugcagugcaguuccagugcauuggguccccacaucccgcacgaccuggagcauucacgcccaucaccaguggaugacuacagaggacaugcugaccguguggaauagaguuuggaucgaggauaacccuuggauggaagacaagacuccggugacaaccugggaggaugucccauaccuugggaaacgggaagaccaaugguguggaucucugauuggucucacgucaagggcgacaugggcucagaauaucuuaaccgccauacaacaggugcgcagucugaucggcgaugaggaguuuuuggacuacaugcccuccaugaagagauuccggaaagaagaggaaagcgagggggcaauuugguga

SEQ ID NO: 15673 - RNA, 9873 nt, Artificial Sequence
  derived and/or modified CDS sequence (opt3) from DENV-3__DQ675533__SS-prME
accagccugugccucaugaugauccuucccgccgcucuggcuuuccacuugacauccagggacggcgagccuaggaugauuguggggaagaacgaacggggaaaaucuuuacuguuuaagacugccucagguauaaauauguguacgcugaucgcgauggaucucggcgagaugugcgacgauaccgucacauacaaauguccacauauuacugaaguugagccggaagacaucgauugcugguguaaccugaccaguacaugggugaccuaugggacuugcaaucaggcuggagagcaccgccgagacaagcguagcguagcccuugcaccccaugugggcaugggucuggauacaagaacccagacguggauguccgccgagggggcuuggaggcaggucgaaaaaguggagacuugggcauugcggcacccuggauucaccauucucgcccuguuucuggcucauuacaucggcacaucucucacucagaagguugugauauucaucuuacugaugcuugucaccccaucgaugacaaugcgcugugugggcguagggaacagagacuuuguugaaggauugucaggugccaccuggguggaugucgugcuggagcacggcgggugcgugacgacuauggcgaagaauaaacccacacuagacauugagcuccagaagaccgaagcaacucagcuggccacacuuaggaaacuguguaucgagggaaagauuaccaacaucacgaccgauagccggugcccuacacagggcgaagcugucuugccagaggaacaggaccagaauuauguuuguaaacacacuuacguggaucgcgguugggggaacggaugcggccucuucggcaaggggagucugguaaccugcgccaaguuucaauguuuagagcccauagagggaaaagugguccaguaugaaaaucugaaguacacagugauuaucacuguucauaccggugaccagcaccaggugggcaacgagacacaaggggucaccgcagaaauuacuccucaggcuuccacgcaugaggcccuccuuccagaauauggaacacugggcuuggagugcucuccgcgaaccggucuagacuucaaugagaugauccugcucacuaugaaaaacaaggcguggauggugcacagacagugguuuuucgaucugccccuuccuugggccagcggggcaaccacagaaaccccaacuuggaauaggaaagagcuguugguaacauuuaagaacgcucacgccaaaaagcaagaaguugugguccucggcucccaggagggagcuaugcauacggcccugaccggcgcaacugaaauccaaaauucagggggaacaaguauuuucgccggucacuuaaagugucggcugaaaauggacaagcuagagcucaaaggcaugagcuacgcuaugugcaccaacacauuugugcugaagaaagaggucucugaaacucagcaugggaccauacuuaucaagguggaguacaagggagaagaugcgcccuguaaaauuccuuucuccacggaggacggccaagguaaggcacacaacgggcguuugaucaccgccaauccaguugugacuaagaaagaggaacccguaaacauagaggcugaaccgccuuucggcgagucaaauauugucaucggaaucggcgauaacgcccugaaaauuaauugguauaaaaaggggagcaguaucggaaaaauguuugaagcaacugcccgcggugcuagaaggauggccauucucggcgacaccgcaugggauuucgggucugugggaggcguucugaacucccuugguaagauggugcaucagauauuugggagcgcguacacagcucuguucucgggcgucucuugggugaugaaaaucggaauuggcguauugcucacuuggaucgggcuaaauuccaagaacaccucaaugaguuuuagcugcaucgccauuggaauaaucacguuauaucugggcgcagugguucaggccgacauggguugugucauuaauuggaaagggaaggagcuaaagugcggauccggcaucuucgugacaaacgaggugcacaccuggacugaacaguacaaauuucaagcugauucucccaagcggcucgccacagcaauugcuggugccugggagaauggcgucugugggauccgaagcaccacucgcauggaaaaccugcuuuggaaacagauagcgaaugaguugaacuauauccugugggaaaauaacauuaagcucaccguuguggugggagacacacugggcguauuagagcaggggaaaagaacgcugaccccacagccuauggagcuuaaguacucauggaaaacuuggggaaaggccaagaucgucacagcugaaacccaaaacaguuccuucauuaucgauggccccaauacaccagagugccccagcgcaucuagggccuggaacgugugggaaguugaggacuaugguuuugggguguucacuaccaauauaugguugaaacuccgggaagucuacacgcagcugugugaccaccgccuaaugucagcugccgugaaggaugagagagcaguucaugcggacaugggauacuggauugagagucagaaaaacggcagcuggaagcuggaaaaagccucccucaucgaggugaagacaugcaccuggccuaagucucacacucuguggucgaaugguguacuugaaagcgauaugauuaucccaaaauccuuggcuggcccgauaucacagcauaacuauaggcccggguaccacacccaaacagccggaccuuggcaccugggcaaguuagagcucgacuuuaauuauugcgaggggacuaccgucgugaucacagaaaguuguggaacgcguggcccaucucugcggaccacuacagugagcgguaaacuuauucaugaguggugcugucgauccugcacccugcccccuuugagauacaugggggaagauggauguugguauggcauggagaucaggccaauuucagaaaaggaggagaacauggucaaaagccucguuucugcagguuccggcaagguggacaauuucacuauggggguacugugccuagcuauccuguuugaagaggugcuccgcggaaaguucggcaaaaagcacaugauagccggggucuucuuuacauucgugcugcuuuugaguggacagauuaccuggcgggauauggcacauacgcugaucaugaucggcagcaacgccucugacagaauggguauggggguuacuuacuuagcucucauugcgaccuuuaaaauccagcccuuccuggcccuuggauuuuuccugaggaagcuaacaucccgcgaaaaucuccuguugggcgugggccuggcaauggcuaccacuuuacaacucccggaggauauugaacagauggccaacgggauagcccugggacuuauggcucugaaauugaucacacaguuugagaccuaucagcucuggacagcacuggucucacuaacuuguaguaauaccauuuucacgcugacaguggccuggcgaaccgcgacucuuauccucgcugguguuagccuguugccugugugccaaucguccucuaugcggaagaccgacuggcugccaaugacagucgccgcaaugggcguacccccuuuaccccuccugauuuuuagccuuaaggauacucugaaacguagaucauggccauugaacgagggggugauggccguuggacucgugaguauccuggcuuccucucuacugaggaaugacgucccuauggcaggcccccuuguggccggugggcuccugauagcguguuacguaaucaccggaacgagcgcugauuugacaguggaaaaggccgcagacgucaccugggaggaagaggccgaacagacuggcguuucccacaacuuaaugauuacaguggacgaugacggcaccaugcgcaucaaagaugacgagacugagaacauucugacagugcuccugaagaccgcccuucugaucgucucagggauauucccauacagcauuccggcuacguugcuaguguggcauacuuggcagaaacagacccaacggaguggaguucugugggauguaccuucucccccagaaacacagaaggcagagcucgaagaggguguguauagaaucaaacagcagggcaucuuugggaagacccaagucggagugggcguucagaaggaggguguguuccacacaauguggcacgucacuagaggggcugugcugacccauaauggaaaacgacuugaacccaacugggccuccguaaagaaagacuuaauuagcuacggcggcggguggcgccugucggcgcaguggcaaaagggagaggaaguccaggugauagccguugagccugguaaaaauccaaagaacuuucagacgaugcccggcacauuccagacuaccacaggggaaaucggagcaauugcucucgauuucaagccuggcaccucagguucuccgaucauuaaucgggaggggaaaguggucggauuguauggcaacggcgugguuacuaagaaugggggauacgugagugguaucgcccaaaccaacgcugagccagacggccccacaccugaacuggaggaagagauguuuaaaaagagaaaucucacgauaauggaucugcacccaggguccggaaaaacuaggaaguaucuucccgcaaucguccgugaagccauuaagcgccggcugagaaccuugauccuagccccuacaagggugguagcugcggagauggaggaagcacugaaaggccucccgauucgauaccagaccacugccacaaagagcgagcauaccggucgggaaaucguggacuuaaugugccacgcuacguucacuaugcgccugcuuucucccguuagagucccaaacuauaaucugauaauuauggaugaggcccauuuuacagacccugcaagcaucgccgcuaggggguacaucuccacccgggugggaaugggcgaagcggccgcaauuuucaugaccgcuacucccccaggcacagccgaugcauuuccucagucaaacgcccccauccaggacgaggagcgagacauaccagaaagaaguuggaauagcgggaacgaguggauuaccgauuucgcuggaaaaacagugugguuugucccgucuaucaaggccgguaaugacauugcgaacugucuccgcaaaaacggcaagaagguaauccaauuguccaggaaaacuuucgauacggaauaccagaagaccaaacugaaugacugggauuuugugguuacaacugacauaucagagaugggggcaaacuucaaggccgaucgugugauugacccucggagaugccucaaacccgucauccugaccgauggaccagagagggugauccuugcuggccccaugccuguuacagccgcuagugcagcccagcgccgagguagaguggggcggaauccacagaaggaaaacgaccaauauauuuuuaccggccagccccuaaauaacgaugaggaccacgcucacuggacugaagccaagaugcuguuggacaauaucaacacgccugagggaauuauaccggcauuauucgaaccagagagggagaaaagcgcggccaucgauggcgaauaccgccugaagggggagucccguaaaaccuucgucgaacucaugagacggggagaccugcccguguggcuugcucauaagguagccucugaggguauuaaauauacagauaggaaguggugcuuugacggcgaacgcaauaaccagauccuggaggagaauauggauguggaaaucuggacuaaagagggggaacgaaagaagcucagaccucggugguuggacgcaaggaccuacucggauccccuggcucuaaaagaguucaaggacuuugccgcaggacgcaaaagcauugcccuggaucucguuacagaaauaggcagagucccaucacaccuugcucauaggacccggaacgcgcuggacaauuuagugauguugcacacuuccgagcacggugggcgugccuaucgccaugcaguggaggaacugccugagacaauggaaacgcuccugcuucugggccucaugaucuugcugaccggaggcgcuauguuauuccuaauuagugggaagggaaucgguaaaacuucuauuggccugaucugugucauagccagcuccgggaugcucuggauggccgagguuccccuucaguggaucgcaucagcuauugugcuggaguuuuucaugaugguauugcugaucccagaaccugagaagcaacgaacaccgcaggauaaccagcucgccuacguggucauuggaauccugacccuugcggcuauaauugccgcaaaugaaaugggccuccuggagaccacaaagagagacuuggguaugucuaaagaacccggggugguuagcccaacaaguuaucuggauguggacuuacacccugccuccgcuuggacgcuauacgcagucgccaccacaguaaucacucccaugcugaggcauaccauugagaacagcacagcgaaugugucucucgcugccaucgcaaaccaagccguugugcuuaugggccuggacaagggauggccaauaucaaaaauggauuugggcgucccucugcucgcucuggggugcuacucccaggugaacccccuuaccuuaacugccgcaguccugcucuugaucacgcacuaugcuauuaucggaccgggccugcaggccaaggcgacacgggaggcccagaaacgcaccgcagcugguauuaugaagaauccaacuguggacgggaucaugaccauagaucuagacccuguuauuuacgauaguaaguuugaaaaacaacugggacaggugaugcuccuuguacugugugccgugcaguugcugcucaugagaacaagcugggcacugugcgaggcuuuaacucuugccaccggccccaucacaacgcugugggaagguucgccaggcaaguucuggaacaccacuaucgccgucucuauggcgaauauuuuuaggggguccuaucucgcuggagcaggccuagccuucagcaucaugaaaucaguugggacaggaaagcggggcaccgguagucagggggagacucugggagaaaaauggaagaagaaauugaaccaacugucucgaaaggaguuugaccucuacaaaaaguccggcauaacagagguggauagaaccgaagcuaaagagggucuuaagcgcggcgaaacgacccaucacgccgucagcagggggucagcaaaacugcagugguucguggagcggaauaugguagugcccgaaggacguguuauugacuugggcugugggagaggaggcuggaguuauuacugcgccggucugaagaaggugacagaggucaggggguauacuaaaggaggcccuggccacgaggaaccggugcccaugagcaccuacggguggaacaucgucaagcucauguccggaaaagauguguuuuacuuaccaccugagaagugugacacacugcuuugcgauauuggugaaucuagccccuccccuacuguugaggagucacgcaccauccggguacugaaaaugguggaaccauggcuaaagaauaaccaguucuguauaaagguccucaaucccuauaugccuacagugaucgagcaucuggaacgauugcagagaaaacacggcgggaugcugguuaggaacccacucucucgcaauaguacccaugagauguacuggauuucgaacggaacuggcaauaucgugagcuccgucaacauggugucucggcuucuguuaaauagauucacgaugacacaccguaggcccaccauugaaaaggacguagaucugggugcugggacucggcacgugaacgcggagccggagaccccuaacauggacguuaucggagaacgcauuaaacgaaucaaggaggaacauaauucaacauggcacuaugacgaugagaacccauacaaaacgugggccuaucauggcagcuacgaagucaaggcaaccggcuccgcuaguucuaugauaaaugggguggugaaguugcucacuaaacccugggacgucguuccuauggugacacaaauggccaugaccgauacuacaccauuuggacagcagagaguauucaaggagaaaguggacaccaggacaccccggccgaugccugguacucgcaaggucauggagauuaccgcagaauggcuguggagaacgcuaggcaggaacaaacgaccccggcuuugcacccgugaggaauuuacaaagaaggugagaacuaaugccgcuaugggggccguuuucaccgaggaaaaccaaugggauagcgcgaaagcagccguggaggacgaggaauuuuggaagcuggucgaucgcgagagggaacuccacaaacugggaaaguguggcucaugcguguauaauaugauggguaaacgggagaagaaauugggggaguucggaaaggcuaagggcuccagagccaucugguacauguggcugggcgcacgcuaccucgaauuugaggcucuuggguuccugaacgaagaccauugguuuaguagggagaauagcuauucuggaguagaaggugagggcuuacacaaacugggguacaucuugcgagauauuuccaagauaccaggaggcgccauguaugcugacgauacagccgguugggacacucggaucaccgaggacgaucuccacaacgaagagaaaauuauccagcagauggacccugaacauagacagcuggcaaaugcgauuuucaagcuaacguaccaaaacaaaguugugaagguccagaggcccacaccaaccgggacugugauggauaucauaucacgcaaggaccagcguggaagcggccaggugggcacauaugggcuuaauaccuuuacuaacauggaggcccaacugguccggcagauggaaggagaggguguucucaccaaagcugaucuggagaauccccacuuguuagaaaagaaaaucacacaguggcuggagacgaagggcguggaaagacucaaaaggauggccauuucgggggacgauugcguagugaagccuaucgacgaucgcuucgcaaacgcacuucuggcccuaaacgacaugggaaagguccgaaaagauauuccacaguggcaaccgucuaagggcuggcaugacuggcaacaggugcccuuuuguagucaccacuuccaugagcugaucaugaaagauggucggaagcucguugugccuugcagaccacaggacgaauugauagggagggcacgcauuucccaaggagccggcuggagccugagagagaccgcgugucuuggcaaggcuuacgcccagauguggucacugauguauuuccaccggagggaccuccguuuagcauccaaugccaucugcucugcuguccccgugcauuggguaccuacuagccgaacaaccuggaguauccacgcccaucaccaguggaugacuacagaggauaugcugaccguuuggaaccgcguguggauugaagagaauccauggauggaagacaagacgcccgucacaaccugggagaacgugccuuacuuggggaagagagaggaucaaugguguggaucccugauaggucucacuagccgggcaaccugggcucagaauaucccgacagccauucagcagguuaggucucuuaucggcaacgaagaguuucuggacuacaugccaucaaugaaacgcuucagaaaggaagaggaaagugagggggcgauuugguga

SEQ ID NO: 15674 - RNA, 9873 nt, Artificial Sequence
  derived and/or modified CDS sequence (opt3) from DENV-3__AY744677__SS-prME
accagccugugccucaugaugaugcuucccgccacacuggcuuuccacuugacuucccgagacggagaaccuaggaugaucguggggaagaacgaacggggaaaaucuuuacuguuuaagacggcaucagguauuaauauguguacccugauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaaccgggacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauauucacccuaacgguggcguggcgcacagcuacccugauccuugccguuauuagucuccugccggugugccaaagcucguccaugcgaaaaacugacugguugccuaugaccgucgcagccaugggugugccaccccugccuuuauuuaucuucucucucaaggauacacugaaacggcguagcuggccccuuaacgagggcguuauggcuguggggcuggucucaauuuuggcaaguuccuuucucagaaaugacguaccaauggccggaccucugguggcgggcggucuacugaucgcuuguuauguuauaacugggaccucugccgaucuuacgguggaaaaggcagccgacgucacaugggaggaagaggcugaacagaccggagugagccauaaccucaugauuacuguagacgaugacggcacaaugaggaucaaagaugacgagaccgagaacauccugacuguguuguuaaagacagcccugcucauugucuccggcauauuccccuacucaaucccagcaacccugcuuguuuggcacacguggcagaaacagacucaacgcagcggggugcugugggaugugccgaguccucccgaaacccagaaggcugaguuggaagagggagucuaccggauuaagcagcaggguaucuuuggcaaaacacaaguggggguuggaguacagaaggagggcguguuccauaccauguggcacgucacaagaggugccgugcuaacucacaaugggaaaaggcuggaaccaaacugggcgaauguuaagaaagaccucauuucuuauggaggcggcuggaagcuguccgcccaguggcaaaagggggaggaagugcaggucaucgcaguggagcccggcaagaacccuaagaauuuccagaccaugccagguauauuucagacgacaacuggcgaaaucggggcuauugcccuugauuucaaacccggaaccagcggcucgccuaucauuaaccgagaggguaagguagucggguuauacggaaauggcgugguuaccaagaacggcggguaugugucaggaaucgcucaaaccaaugcagagccggacgguccaacucccgaacuggaggaagagauguuuaagaagcgcaaccucaccauaauggauuugcauccuggcucugggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaaagugagcacacuggcagggaaaucguggaccuaaugugccaugccacauucaccaugcgacugcucuccccgguccgggugcccaauuacaacuuaauaguaauggaugaggcacacuuuacggacccagccagcauugcugcgcgcgguuauaucucuacuagaguggggaugggagaagccgcagcuauuuucaugacagccaccccucccggcaccgcagaugccuuuccacagagcaaugcuccuauccaggacgaggagagggacauacccgaacgguccuggaacucaggcaaugaguggauuacugauuucgccgggaagacaguuugguuugucccaaguaucaaggcgggaaacgacaucgcaaacugucugagaaagaaugguaagaaagugauucaacuuagcagaaagaccuucgauacagaauaccagaaaacuaagcugaacgacugggauuuuguggucacgaccgacaucucugagaugggcgccaauuucaaggcugaucgcguaauugacccgaggcguugccucaaaccugugauauugacagaugggcccgagcggguuauccuggccggaccaaugcccgugacugucgcuuccgcagcccagagaaggggccgcgugggucgaaacccucagaaggaaaaugaccaauacauuuucaccgggcagccacucaacaaugaugaggaccaugcucacuggacagaagccaaaaugcugcuugacaacaucaauacccccgagggcaucauuccugcacuauuugaaccggagagagagaagucagcggccauagauggagaauaucggcugaaaggcgagaguaggaagacuuucguugaauugaugcgccguggggacuuaccaguguggcuggcucacaaagucgccagcgagggaaucaaguacacggauagaaaguggugcuuugacggugaacggaacaaucagauucucgaggagaacauggauguggaaaucuggaccaaagagggcgaaaagaaaaagcugaggccccgcuggcuugacgcacgaacauauuccgauccucuggcucucaaagaguucaaggacuuugccgcagggagaaagucuauugccuuggaucugguaacugaaaucggacgggugcccucgcaucuagcucacaggacccgcaaugcgcuggacaaccucguuaugcuucauacaagcgagcacggcgguagagccuacaggcacgcagucgaggaacugccagagaccauggaaacuuuauugcugcucgggcugaugauacuucugacaggcggagcuaugcuauucuugaucucaggcaaagggauuggaaagacguccaucggucugauuugugugguggccaguucuggcauguuauggauggccgaugucccucuacaguggaucgcaagcgcuauaguucuggaguuuuucaugauggugcuccuuauucccgagccagaaaaacaacggaccccucaggacaaucagcuggccuauguagugaucgggauuuugacucuggcggcuaucgucgccgcaaacgagaugggacuccuggaaacaaccaagcgugaucuuggcauguccaaagagccgggugugguuucacccaccucuuaccucgacguggaccugcauccagccagcgcuuggacauuguaugcagucgccacuacgguaauaaccccuaugcugcgccacacaaucgaaaauaguacugcgaacguguccuuagcugccauugcaaaccaagccguugugcuaauggggcuggauaagggcuggcccaucagcaagauggaccucggagucccacuucuggcuuugggcugcuacucucaggugaauccucugacccucacagccgcaguccugcuuuuagugacccauuacgcuauuaucgggcccggacugcaggccaaagcgacucgagaggcccagaagagaacggcagcuggcauaaugaaaaacccgacaguugaugguauuaugaccaucgaccucgauccagugaucuaugacucaaaguuugagaaacaauuggggcagguaaugcugcuagugcugugugccguccagcuccuucugaugaggacuuccugggcauucugcgaggcuuugacccuggccacaggaccuauuacuacccucugggaaggcagucccgguaaguuuuggaauacaacgaucgccguuagcauggcgaacauauuccggggcucguaccuggcuggggcaggauuagccuuuucuauuaugaaguccgugggcaccgggaaacgcggaacuggcagccagggugaaacacuuggggagaaguggaaaaagagacugaaucaacucucaaggaaagaguucgaucuauauaagaaaaguggaaucaccgaggucgaccggacugaggcuaaggaaggccugaagcgaggugagauuacacaccaugccgugucuagaggcuccgcaaaauugcagugguucguagaacgcaacauggugaucccagaggggaggguuauagaucugggauguggcagagggggauggagcuacuauugcgccggccucaagaaagugaccgaaguccgugguuacacgaaagggggacccggccacgaggagccugugccgaugucaaccuauggcuggaauaucgucaaacuuaugagugggaaggacguguuuuaccugcccccagaaaagugugauacauugcugugcgacauuggagagagcuccccuucucccacuguugaagagagcagaaccaucaggguacucaaaaugguggagccuugguuaaagaacaaucaguucuguauuaaaguccugaacccauacaugcccacagugaucgaacaccuugagcgccugcagcggaagcaugguggcaugcuaguucgaaauccucucuccagaaacucaacucacgaaauguauuggauuucuaaugggaccggaaacaucgugaguucggucaauauggugagcaggcuguugcugaaccgcuuuacaaugacccaucggagaccaacuauagagaaagauguagaccucggcgcugguacgcgucacgugaacgcggaacccgagacaccgaauauggacguuauuggggagaggauccggcgcaucaaggaagaacacuccucuaccuggcauuacgaugacgaaaacccuuauaagacuugggccuaccacggaucauaugaggucaaagcaaccggcagcgcuuccaguaugauuaauggcguggugaaacuucugacaaaaccaugggaugucguucccauggugacgcaaauggccaugaccgacacuacaccuuucgggcagcagcgaguauuuaaggaaaaaguggauaccagaacuccaaggcccaugccgggaacacggaaggucauggagauaaccgcagagugguuauggcgcacacuggguagaaacaagaggccucgauugugcacucgggaagaguucaucaaaaaggugcguaccaaugccgcuaugggcgccguuuuuacggaagagaaccaaugggacucugcgagagcagccguggaagaugaggaguucuggaaacucgucgaccgcgaaagggagcugcauaagcuagggaaauguggaagcugcguguacaauaugaugggcaagcgggagaagaaacuuggugaguuugggaaggcuaaaggaucaagagccauuugguauauguggcugggcgcacgcuaccucgaguucgaagcucugggcuuuuugaacgaggaucacugguucuccagggaaaauaguuacagcgggguagagggagaaggucugcauaagcucggcuauauccuucgagacauuucuaaaauccccgggggagccauguacgcugaugacaccgccggcugggacacacggauaacugaggaugaccugcacaacgaggaaaagaucacccagcagauggauccagagcacagacaguuagcaaaugcgauuuuuaaacugacauaucaaaacaagguugugaagguccagaggccuacucccaaagguaccgugauggacaucauuucccgcaaggaucagcgugggucaggacaggugggcacguacggcuugaauacauucaccaacauggaagcccaacucauccggcagauggagggggaaggaguccugagcaaagcugaccuagagaauccacaucuucuggagaagaaaguuacucaguggcucgaaacaaaggguguggagagacugaagaggauggccauaucgggcgaugacugcguagugaaacccauugaugaccgcuucgcaaacgcuuuguuagcccugaacgauauggggaagguccgaaaagacaucccucaguggcaaccaucuaagggauggcacgauuggcaacaggugccguuuuguagucaucacuuccacgaacucaucaugaaagacggccggaaacuuguugugcccugcagaccucaggacgagcugauugguagggcacgcauaucccaaggggccggauggagccuaagagaaaccgcgugucugggcaaggcuuaugcccagaugugggcacucauguacuuucaucggagggauuugcgucuggccucaaaugcuaucugcuccgccgucccagugcacuggguacccacuucucgaaccacauggagcauucaugcacaccaucaguggaugacgaccgaggacaugcuuacuguuuggaaccgcguguggaucgaggauaauccuuggauggaagacaaaacaccagucaccacuugggaggaugugcccuaucugggcaagagagaagaccaauggugugggagucucauuggauuaacaucccgggcuaccugggcccagaacauccugacggcgauacagcagguuaggagcuugaucgguaaugaggaguuccuggauuacaugccuucuaugaaacgcuuuagaaaggaagaggaaucagagggcgcuauuugguga

SEQ ID NO: 15675 - RNA, 9873 nt, Artificial Sequence
  derived and/or modified CDS sequence (opt3) from DENV-3__AY744678__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauauucacccuaacgguggcguggcgcacagcuacccugauccuugccguuauuagucuccugccggugugccaaagcucguccaugcgaaaaacugacugguugccuaugaccgucgcagccaugggugugccaccccugccuuuauuuaucuucucucucaaggauacacugaaacggcguagcuggccccuuaacgagggcguuauggcuguggggcuggucucaauuuuggcaaguuccuuucucagaaaugacguaccaauggccggaccucugguggcgggcggucuacugaucgcuuguuauguuauaacugggaccucugccgaucuuacgguggaaaaggcagccgacgucacaugggaggaagaggcugaacagaccggagugagccauaaccucaugauuacuguagacgaugacggcacaaugaggaucaaagaugacgagaccgagaacauccugacuguguuguuaaagacagcccugcucauugucuccggcauauuccccuacucaaucccagcaacccugcuuguuuggcacacguggcagaaacagacucaacgcagcggggugcugugggaugugccgaguccucccgaaacccagaaggcugaguuggaagagggagucuaccggauuaagcagcaggguaucuuuggcaaaacacaaguggggguuggaguacagaaggagggcguguuccauaccauguggcacgucacaagaggugccgugcuaacucacaaugggaaaaggcuggaaccaaacugggcgaauguuaagaaagaccucauuucuuauggaggcggcuggaagcuguccgcccaguggcaaaagggggaggaagugcaggucaucgcaguggagcccggcaagaacccuaagaauuuccagaccaugccagguauauuucagacgacaacuggcgaaaucggggcuauugcccuugauuucaaacccggaaccagcggcucgccuaucauuaaccgagaggguaagguagucggguuauacggaaauggcgugguuaccaagaacggcggguaugugucaggaaucgcucaaaccaaugcagagccggacgguccaacucccgaacuggaggaagagauguuuaagaagcgcaaccucaccauaauggauuugcauccuggcucugggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaaagugagcacacuggcagggaaaucguggaccuaaugugccaugccacauucaccaugcgacugcucuccccgguccgggugcccaauuacaacuuaauaguaauggaugaggcacacuuuacggacccagccagcauugcugcgcgcgguuauaucucuacuagaguggggaugggagaagccgcagcuauuuucaugacagccaccccucccggcaccgcagaugccuuuccacagagcaaugcuccuauccaggacgaggagagggacauacccgaacgguccuggaacucaggcaaugaguggauuacugauuucgccgggaagacaguuugguuugucccaaguaucaaggcgggaaacgacaucgcaaacugucugagaaagaaugguaagaaagugauucaacuuagcagaaagaccuucgauacagaauaccagaaaacuaagcugaacgacugggauuuuguggucacgaccgacaucucugagaugggcgccaauuucaaggcugaucgcguaauugacccgaggcguugccucaaaccugugauauugacagaugggcccgagcggguuauccuggccggaccaaugcccgugacugucgcuuccgcagcccagagaaggggccgcgugggucgaaacccucagaaggaaaaugaccaauacauuuucaccgggcagccacucaacaaugaugaggaccaugcucacuggacagaagccaaaaugcugcuugacaacaucaauacccccgagggcaucauuccugcacuauuugaaccggagagagagaagucagcggccauagauggagaauaucggcugaaaggcgagaguaggaagacuuucguugaauugaugcgccguggggacuuaccaguguggcuggcucacaaagucgccagcgagggaaucaaguacacggauagaaaguggugcuuugacggugaacggaacaaucagauucucgaggagaacauggauguggaaaucuggaccaaagagggcgaaaagaaaaagcugaggccccgcuggcuugacgcacgaacauauuccgauccucuggcucucaaagaguucaaggacuuugccgcagggagaaagucuauugccuuggaucugguaacugaaaucggacgggugcccucgcaucuagcucacaggacccgcaaugcgcuggacaaccucguuaugcuucauacaagcgagcacggcgguagagccuacaggcacgcagucgaggaacugccagagaccauggaaacuuuauugcugcucgggcugaugauacuucugacaggcggagcuaugcuauucuugaucucaggcaaagggauuggaaagacguccaucggucugauuugugugguggccaguucuggcauguuauggauggccgaugucccucuacaguggaucgcaagcgcuauaguucuggaguuuuucaugauggugcuccuuauucccgagccagaaaaacaacggaccccucaggacaaucagcuggccuauguagugaucgggauuuugacucuggcggcuaucgucgccgcaaacgagaugggacuccuggaaacaaccaagcgugaucuuggcauguccaaagagccgggugugguuucacccaccucuuaccucgacguggaccugcauccagccagcgcuuggacauuguaugcagucgccacuacgguaauaaccccuaugcugcgccacacaaucgaaaauaguacugcgaacguguccuuagcugccauugcaaaccaagccguugugcuaauggggcuggauaagggcuggcccaucagcaagauggaccucggagucccacuucuggcuuugggcugcuacucucaggugaauccucugacccucacagccgcaguccugcuuuuagugacccauuacgcuauuaucgggcccggacugcaggccaaagcgacucgagaggcccagaagagaacggcagcuggcauaaugaaaaacccgacaguugaugguauuaugaccaucgaccucgauccagugaucuaugacucaaaguuugagaaacaauuggggcagguaaugcugcuagugcugugugccguccagcuccuucugaugaggacuuccugggcauucugcgaagcucuaacccuggccacaggaccuauuacuacccucugggagggcagucccgguaaguuuuggaauacaacgaucgccguuagcauggcgaacauauuccggggcucguaccuggcuggggcaggauuagccuuuucuauuaugaaguccgugggcaccgggaaacgcggaacuggcagccagggugaaacacuuggggagaaguggaaaaagaaacugaaucaacucucaagaaaggaguucgaucuauauaaaaagaguggaaucaccgaggucgacaggacugaggcuaaggaaggccugaaacggggugagauuacacaccaugccgugucucgaggcuccgcaaaguugcagugguucguagaaagaaacauggugaucccagaggggcgcguuauagaucugggauguggcagagggggauggagcuacuauugcgccggccucaaaaaggugaccgaaguccgggguuacacgaaagggggacccggccacgaggagccugugccgaugucaaccuauggcuggaauaucgucaaacuuaugagugggaaggacguguuuuaccugcccccagaaaaaugugauacauugcugugcgacauuggagagagcuccccuucucccacuguugaagagagccguaccaucagaguacucaagaugguggagccuugguugaaaaacaaucaguucuguauuaagguccugaacccauacaugcccacagugaucgaacaccuugagaggcugcagcgcaaacaugguggcaugcuaguucggaauccucucucccgaaacucaacucacgaaauguauuggauuucuaaugggaccggaaacaucgugaguucggucaauauggugagcagacuguugcugaacagguuuacaaugacccaucgccggccaacuauagagaaggauguagaccucggcgcugguacgagacacgugaacgcggaacccgagacaccgaauauggacguuauuggggagcguaucaggcggaucaaggaagaacacuccucuaccuggcauuacgaugacgaaaacccuuauaaaacuugggccuaccacggaucauaugaggucaaggcaaccggcagcgcuuccaguaugauuaauggcguggugaaacuucugacaaagccaugggaugucguucccauggugacgcaaauggccaugaccgacacuacaccuuucgggcagcagcgcguauuuaaagaaaagguggauacccgaacuccaagacccaugccgggaacaaggaaggucauggagauaaccgcagagugguuauggcggacacugggucgcaacaaaagaccuagguugugcacucgagaagaguucaucaagaaagugcggaccaaugccgcuaugggcgccguuuuuacggaagagaaccaaugggacucugcgcgugcagccguggaagaugaggaguucuggaagcucgucgacagagaacgcgagcugcauaaacuagggaaguguggaagcugcguguacaauaugaugggcaaaagggaaaagaaacuuggugaguuugggaaagcuaagggaucacgggccauuugguauauguggcugggcgcaagauaccucgaguucgaagcucugggcuuuuugaacgaggaucacugguucucccgcgaaaauaguuacagcgggguagagggagaaggucugcauaaacucggcuauauccuuagggacauuucuaagauccccgggggagccauguacgcugaugacaccgccggcugggacacacgaauaacugaggaugaccugcacaacgaggagaaaaucacccagcagauggauccagagcaccggcaguuagcaaaugcgauuuuuaagcugacauaucaaaacaagguugugaaaguccagagaccuacucccaaggguaccgugauggacaucauuuccaggaaagaucagcgcgggucaggacaggugggcacguacggcuugaauacauucaccaacauggaagcccaacucauccgucagauggagggggaaggaguccugagcaaggcugaccuagagaauccacaucuucuggagaaaaagguuacucaguggcucgaaacaaaggguguggagcggcugaaaagaauggccauaucgggcgaugacugcguagugaagcccauugaugacagguucgcaucugcuuuguuagcccugaacgauauggggaaaguccgcaaggacaucccucaguggcaaccaaguaaaggauggcacgauuggcaacaggugccguuuuguucccaucacuuccacgaacucaucaugaaggacggccgaaaacuuguugugcccugccggccucaggacgagcugauugguagagcaaggauaagccaaggggccggauggucacuacgcgaaaccgcgugucugggcaaggcuuaugcccagaugugggcacucauguacuuucauagacgggauuugaggcuggccuccaacgcuaucugcucugccgucccagugcacuggguacccacuagccguaccacauggaguauucaugcacaccaucaguggaugacgaccgaggacaugcuuacuguuuggaaucgaguguggaucgaggauaacccuuggauggaagacaagacaccagucaccacuugggaggaugugcccuaucugggcaaacgcgaagaccaauggugugggucccucauuggauuaacaagcagagcuaccugggcccagaauauccugacggcgauacagcagguucggucuuugaucgguaacgaggaguuccuggauuacaugccuucaaugaagagguuucgcaaagaagaggaaagugagggcgcuauuugguga

SEQ ID NO: 15676 - RNA, 9873 nt, Artificial Sequence
  derived and/or modified CDS sequence (opt3) from DENV-3__AY744679__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggccccccacgugggcauggguuuggauaccagaacgcaaacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagugguccagcacgaaaaucugaaguauacugugauaauuaccguucauacaggugaccagcaccaggugggcaacgagacccaaggggucacugccgaaaucacgccccaggcaucuacaguggaggcuauucucccugaauacggaacccuuggccuggagugcagcccacgaacugguuuggacuuuaaugagaugauccuacugaccaugaaaaacaaggccuggaugguacauagacagugguucuuugaucucccgcugcccuggacauccggggcgaccacugaaacaccuacguggaauaaaaaggagcuucugguuaccuucaaaaacgcccacgcaaagaagcaagaaguggucguguugggcucacaggagggagcuaugcacacugcccucacaggcgcuaccgaaauccagacaagugggggaacuagcauuuuugccggucaucugaaauguagguuaaagauggacaaacuggagcuaaagggcaugucuuaugcaaugugccucaaugccuucguccugaaaaaggagguguccgaaacccagcacgggacgauacuuaucaagguugaguacaaaggagaagaugcuccauguaagauucccuucucaaccgaggacggccaagguaaagcgcauaacgggcgguugaucacagcaaacccuauagugacuaagaaagaggaaccaguaaauauugaggccgaacccccguuuggcgagagcaacaucgucaucggaauuggcgauaaggcucugaagaucaauugguacaaaaaggggaguucuauuggaaaaauguucgaagccaccgcacguggugcccgcagaauggcuauacucggcgacacagccugggauuuuggguccgugggaggcguucugaacagccuugguaagauggugcaccagaucuucgggucggcauauacugcgcuguuuucuggcgucuccuggauuaugaaaaucggaaucggcguguugcucaccuggauugggcugaauucaaagaacacgaguaugagcuucuccugcauaguaaucggaauuaucacauuauaccugggcgcugugguucaggccgacauggguugugucauuaauuggaaggggcaggagcuaaaaugcggaucuggcaucuuugugaccaacgaggugcauacuuggacagaacaauauaaguuccaggcagauagcccuaaaaggcucgccaccgcuauagccggugcaugggagaauggcgucugugggauccggucaacuacccgaauggaaaaccugcuuuggaagcagauugcuaaugaguugaacuacauccugugggaaaauaacauuaaacucacaguuguggugggagacguaaucggcguccuggagcaggggaagcgcacguuaaccccccaaccaauggagcugaaauauaguuggaagacuuggggaaaggccaaaauagugacagcggaaacccagaauuccagcuuuauuaucgauggcccuaacacacccgagugcccaucugccucaagagcuuggaacguuugggaaguggaggacuacgguuucggggucuuuacuaccaauauuuggcuuaaguugagggaaauguauacgcagcucugugaccaccggcugaugagugcagccgugaaagaugagcgcgcuguucacgccgacaugggauacuggaucgagagccagaagaacggcuccuggaaacuagaaaaggcaucucugauagaggugaagacaugcaccuggcccaaaucgcauacucucuggagcaaugguguacuggaauccgauaugaucauuccuaagucacuugcgggcccaaucagucaacacaacuacagaccgggguaucauacccagacagccggacccuggcacuugggcaaacuggaguuagacuucaauuacugcgaggggacuaccgucgugauuacagaaaacuguggaacgaggggcccuucucuccguaccacuacagugagcgguaagcugauccacgaguggugcugucgguccugcacccuuccaccccugcgauauaugggggaagauggauguugguacggcauggagauaagaccuauuaaugaaaaagaggagaacauggucaagucauugguuagcgcugguucuggcaaggccgacaauuuuacuaugggggugcucugccuggcaauccuauucgaagagguaaugaggggaaaauucggcaagaaacauaugaucgcuggggcccuguuuacauucgugcuccugcuuuccggacagauuaccuggcgcgauauggcacacacguugaucaugauuggcaguaacgccagcgaccggauggguaugggggucacuuaucuggcuuuaauagcgaccuuuaagauccaaccauuccucgcccugggauuuuuccuuagaaaacugacaucuagggaaaaucuacuccugggcgugggcuuggcaauggcuaccacucugcaguuacccgaggauauugaacagauggccaacgggaucgcccucggacugauggcucuuaagcugauuacacaguuugagaccuaccaauuguggacagcacucguuucccugauguguucaaauacuaucuucacccuaacgguggccuggcgcacagcgacccugauacuugcugucaucagucuccugccggugugccagagcucguccaugcgaaagacugacugguugccuaugaccguugccgcaaugggugugccaccccugccuuuauuuauuuucucucucaaagauacacugaagcggcguagcuggccccuuaacgagggcgucauggccguagggcuggugucaaucuuggcuaguuccuuucucagaaaugacguuccaauggcaggaccucugguggccggcggucuacugauugcguguuaugucaucacugggaccucugcugaucuuacgguggaaaaagccgcagacguaacaugggaggaagaggccgaacagaccggagugagccauaaccucaugauaacugucgacgaugacggcacaaugaggauuaaggaugacgagaccgagaacauccugacuguuuuguuaaaaacagcucugcucaucguguccggcauuuuccccuacucaauaccagccacccugcuuguguggcacacguggcagaagcaaacucagcgcagcgggguccugugggaugugccgaguccucccgaaacccagaaagcagaguuggaagagggaguuuaccggaucaagcagcaagguauuuuuggcaagacacagguaggggugggaguccagaaagagggcguguuccauaccauguggcacguuacaagaggugcugugcuaacucacaaugggaagaggcuggaaccaaacugggccaaugucaaaaaggaccucaucucuuauggaggcggcuggaaacuguccgcgcaauggcagaagggggaggaagugcagguaauugccgucgagcccggaaagaacccuaaaaauuuccagaccaugccagguaucuuucaaacgacaacuggcgaaauaggggcaaucgcucuugauuucaagcccggaaccagcggcucgccuauuaucaaccgagaggguaaagugguuggguuauacggaaauggcguggucacaaagaacggcggguaugugucaggaauugcccagaccaaugcugagccggacgguccaacucccgaacuggaggaagagauguuuaaaaagcgcaaccucaccaucauggauuugcauccuggcucugggaagacacggaaauaccugccagcaauaguuagagaagccauuaagaggcgucuccgcacgcugauccuugcccccacucggguggucgcugcggagauggaggaagcacugaaaggauugccuaucagauaucagaccacagccaccaagagugagcacacuggcagggaaauuguggaccuaaugugccaugcuacauucaccaugcgacugcucuccccgguacgggugcccaauuacaacuuaaucguuauggaugaggcccacuuuacggacccagcaagcauagccgcucgcgguuauauuucuacuagagucgggaugggagaagcggccgcaaucuucaugacagcuaccccucccggcaccgccgaugcauuuccacagagcaaugccccuauucaagacgaggagagggacauccccgaacgguccuggaacucaggcaaugaguggauaacugauuucgcugggaaaacagugugguuugugccaaguauuaaggccggaaacgacaucgcgaacugucugcgaaagaaugguaaaaaggucauccagcuuagcagaaaaaccuucgauacagaauaccagaagacuaaacugaacgacugggauuuuguagugacgaccgacauuucugagaugggcgcaaauuucaaggccgaucgcguuaucgacccgaggcguugccucaagccugugauuuugacagaugggcccgagcgggucauacuggcuggaccaaugcccgugacuguugccuccgcugcacagagaaggggccgcgugggucgaaacccucaaaaagaaaaugaccaguacaucuucaccgggcagccacucaacaaugaugaggaccaugcccacuggacagaagcuaagaugcugcuugacaacauuaauacccccgagggcaucaucccugcccuauuugaaccggagagagagaaaucagcagcgauugauggagaauaucggcugaagggcgagaguaggaaaacuuucgucgaauugaugcgccguggggacuuaccaguguggcuggcccacaagguagcuagcgagggaauaaaauacacggauagaaaguggugcuuugacggugaacggaacaaucagauccucgaggagaacauggauguggaaauuuggaccaaggagggcgaaaaaaagaaacugaggccccgcuggcuugacgcccgaacauauuccgauccucuggcacucaaggaguucaaagacuuugcugccgggagaaagucuaucgcauuggaucugguuacugaaauuggacggguccccucgcaucuagcccacaggacccgcaaugcucuggacaaccucgugaugcuucauacaagcgagcacggcgguagagcguacaggcacgccguggaggaacugccagagaccauggaaacuuuauugcugcucgggcugaugauccuucugacaggcggagcaaugcucuucuugauaucaggcaaggggaucggaaaaacguccauuggucugaucugugucguugcuaguucuggcauguuauggauggccgaugugccucuacaauggauugccagcgcaaucguacuggaguuuuucaugauggugcuccuuauacccgagccagaaaagcagcggaccccucaggacaaucaacuggcuuaugucgugauugggaucuugacucuggccgcgauuguugcugccaacgagaugggacuccuggaaacaaccaaacgugaucuuggcauguccaaggagccggguguggucucacccaccucuuaccucgacguagaccugcauccagcaagcgccuggacauuguaugcuguggcaacuacgguuaucaccccuaugcugcgccacacaauagaaaauaguacugccaacguguccuuagcggcuaucgccaaccaggcagucgugcuaauggggcuggauaaaggcuggcccauuagcaagauggaccucggagucccacuucuggccuugggcugcuacucucaggugaauccucugacccucacagcugccguucugcuuuuagugacccauuacgcaaucauugggcccggacugcaggcuaaggccacucgagaggcgcaaaaaagaacggccgcaggcaucaugaagaacccgacaguagaugguauaaugaccauugaccucgauccagugaucuaugacucaaaauuugagaagcaguuggggcaggucaugcugcuaguucugugugcugugcagcuccuucugaugaggacuuccugggccuucugcgaagcauugacccuggcuacaggaccuaucacuacccucugggagggcagucccgguaaauuuuggaauacaacgauugccgucagcauggccaacaucuuccggggcucguaccuggcgggggcuggauuagcauuuucuauaaugaaguccgugggcaccgggaagcgcggaacuggcagccaaggugaaacacuuggggagaaauggaagaaaaagcugaaucagcucucaagaaaagaauucgaucuauauaagaaaaguggaauuaccgagguagacaggacugaggccaaggaaggccugaagcggggugagaucacacaccaugcugugucucgaggcuccgccaaauugcagugguucguugaaagaaacauggugauuccagaggggcgcgucaucgaucugggauguggcagggggggauggagcuacuauugcgcaggccucaagaaagugaccgaaguccgggguuacacgaaggggggacccggccacgaggagccugugccgaugucaaccuauggcuggaauauaguuaaacuuaugagugggaaggacguauuuuaccugcccccagaaaagugugauacauugcugugcgacaucggagagagcuccccuucucccacuguggaagagagccguaccauuagaguccucaaaaugguggagccuugguuaaagaacaaucaguucuguaucaaaguucugaacccauacaugcccacagugauugaacaccuugagaggcugcaacgcaagcaugguggcaugcuaguccggaauccucucucccgaaacucaacucacgaaauguauuggaucucuaaugggaccggaaacauugugaguucgguaaauauggugagcagacuguugcugaacagguuuacaaugacccaucgccggccaacuaucgagaaagauguugaccucggcgccgguacgagacacgucaacgcugaacccgagacaccgaauauggacauaauuggggagcguaucaggcggaucaaggaagagcacuccucuaccuggcauuacgaugacgaaaacccuuauaagacuugggcguaccacggaucauaugaggugaaagccaccggcagcgcauccaguaugauuaauggcguggucaagcuucugacaaaaccaugggauguugugcccaugguaacgcagauggcuaugaccgacacuacaccuuucgggcagcaacgcguguuuaaggaaaaagucgauacccgaacuccaagacccaugccgggaacaaggaaggugauggagauaaccgccgagugguuauggcggacacugggucgcaacaagagaccuagguugugcacucgagaagaguucaugaaaaagguucggaccaaugcagccaugggcgcuguguuuacggaagagaaccagugggacucugcccgugcggcagucgaagaugaggaguucuggaaacucguggacagagaacgcgagcugcauaagcuagggaaauguggaagcugcguauacaauaugaugggcaagagggaaaaaaagcuuggugaguuugggaaggccaaaggaucacgggcuaucugguauauguggcugggcgccagauaccucgaguucgaagcacugggcuuuuugaacgaggaucacugguucucccgcgaaaauaguuacagcgggguugagggagaaggucugcauaagcucggcuauauucuuagggacaucucuaaaauucccgggggagcuauguacgccgaugacaccgcuggcugggacacacgaaucacugaggaugaccugcacaacgaggaaaagauaacccagcagauggauccagagcaccggcaauuagccaaugcaaucuuuaaacugacauaucagaacaagguggucaaggugcagagaccuacucccaaagguaccgugauggacauuaucuccaggaaggaucagcgcgggucaggacaagucggcacguacggcuugaauacauucaccaacauggaagcgcagcucauucgucagauggagggggaaggaguucugagcaaagccgaccuagagaauccacaucuucuggagaagaaagugacucaguggcucgaaacaaaggguguagagcggcugaagagaauggcuaucucgggcgaugacugcguggucaaacccauagaugacagguucgccaacgcauuguuagcucugaacgauauggggaaggugcgcaaagacauuccucaauggcagccaucuaagggauggcacgauuggcagcagguuccguuuuguagucaucacuuccacgaacucaucaugaaagacggccgaaagcuugugguccccugccggccucaagacgagcugaucgguagagccaggauuucccagggggcaggauggagccuacgcgaaaccgccugucugggcaaggcguaugcucagaugugggcccucauguacuuucauagacgggauuugaggcuggcaucaaaugccauaugcuccgcugugccaguacacuggguucccacuucucguaccacauggagcauccaugcccaccaucaauggaugacgaccgaggacaugcuuacuguguggaaccgagucuggauugaggauaauccuuggauggaagacaaaacaccagugaguaccugggaggauguucccuaucugggcaagcgcgaagaccaguggugugggucccucaucggauuaacuagcagagcaacaugggcucagaacauucugaccgccauccagcaagugcggucuuugauagguaaugaggaguuccuggauuacaugccuucaaugaaaagguuucgcaaggaagaggaaagugagggcgcgaucugguga

SEQ ID NO: 15677 - RNA, 9873 nt, Artificial Sequence
  derived and/or modified CDS sequence (opt3) from DENV-3__AY744680__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauauucacccuaacgguggcguggcgcacagcuacccugauccuugccguuauuagucuccugccggugugccaaagcucguccaugcgaaaaacugacugguugccuaugaccgucgcagccaugggugugccaccccugccuuuauuuaucuucucucucaaggauacacugaaacggcguagcuggccccuuaacgagggcguuauggcuguggggcuggucucaauuuuggcaaguuccuuucucagaaaugacguaccaauggccggaccucugguggcgggcggucuacugaucgcuuguuauguuauaacugggaccucugccgaucuuacgguggaaaaggcagccgacgucacaugggaggaagaggcugaacagaccggagugagccauaaccucaugauuacuguagacgaugacggcacaaugaggaucaaagaugacgagaccgagaacauccugacuguguuguuaaagacagcccugcucauugucuccggcauauuccccuacucaaucccagcaacccugcuuguuuggcacacguggcagaaacagacucaacgcagcggggugcugugggaugugccgaguccucccgaaacccagaaggcugaguuggaagagggagucuaccggauuaagcagcaggguaucuuuggcaaaacacaaguggggguuggaguacagaaggagggcguguuccauaccauguggcacgucacaagaggugccgugcuaacucacaaugggaaaaggcuggaaccaaacugggcgaauguuaagaaagaccucauuucuuauggaggcggcuggaagcuguccgcccaguggcaaaagggggaggaagugcaggucaucgcaguggagcccggcaagaacccuaagaauuuccagaccaugccagguauauuucagacgacaacuggcgaaaucggggcuauugcccuugauuucaaacccggaaccagcggcucgccuaucauuaaccgagaggguaagguagucggguuauacggaaauggcgugguuaccaagaacggcggguaugugucaggaaucgcucaaaccaaugcagagccggacgguccaacucccgaacuggaggaagagauguuuaagaagcgcaaccucaccauaauggauuugcauccuggcucugggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaaagugagcacacuggcagggaaaucguggaccuaaugugccaugccacauucaccaugcgacugcucuccccgguccgggugcccaauuacaacuuaauaguaauggaugaggcacacuuuacggacccagccagcauugcugcgcgcgguuauaucucuacuagaguggggaugggagaagccgcagcuauuuucaugacagccaccccucccggcaccgcagaugccuuuccacagagcaaugcuccuauccaggacgaggagagggacauacccgaacgguccuggaacucaggcaaugaguggauuacugauuucgccgggaagacaguuugguuugucccaaguaucaaggcgggaaacgacaucgcaaacugucugagaaagaaugguaagaaagugauucaacuuagcagaaagaccuucgauacagaauaccagaaaacuaagcugaacgacugggauuuuguggucacgaccgacaucucugagaugggcgccaauuucaaggcugaucgcguaauugacccgaggcguugccucaaaccugugauauugacagaugggcccgagcggguuauccuggccggaccaaugcccgugacugucgcuuccgcagcccagagaaggggccgcgugggucgaaacccucagaaggaaaaugaccaauacauuuucaccgggcagccacucaacaaugaugaggaccaugcucacuggacagaagccaaaaugcugcuugacaacaucaauacccccgagggcaucauuccugcacuauuugaaccggagagagagaagucagcggccauagauggagaauaucggcugaaaggcgagaguaggaagacuuucguugaauugaugcgccguggggacuuaccaguguggcuggcucacaaagucgccagcgagggaaucaaguacacggauagaaaguggugcuuugacggugaacggaacaaucagauucucgaggagaacauggauguggaaaucuggaccaaagagggcgaaaagaaaaagcugaggccccgcuggcuugacgcacgaacauauuccgauccucuggcucucaaagaguucaaggacuuugccgcagggagaaagucuauugccuuggaucugguaacugaaaucggacgggugcccucgcaucuagcucacaggacccgcaaugcgcuggacaaccucguuaugcuucauacaagcgagcacggcgguagagccuacaggcacgcagucgaggaacugccagagaccauggaaacuuuauugcugcucgggcugaugauacuucugacaggcggagcuaugcuauucuugaucucaggcaaagggauuggaaagacguccaucggucugauuugugugguggccaguucuggcauguuauggauggccgaugucccucuacaguggaucgcaagcgcuauaguucuggaguuuuucaugauggugcuccuuauucccgagccagaaaaacaacggaccccucaggacaaucagcuggccuauguagugaucgggauuuugacucuggcggcuaucgucgccgcaaacgagaugggacuccuggaaacaaccaagcgugaucuuggcauguccaaagagccgggugugguuucacccaccucuuaccucgacguggaccugcauccagccagcgcuuggacauuguaugcagucgccacuacgguaauaaccccuaugcugcgccacacaaucgaaaauaguacugcgaacguguccuuagcugccauugcaaaccaagccguugugcuaauggggcuggauaagggcuggcccaucagcaagauggaccucggagucccacuucuggcuuugggcugcuacucucaggugaauccucugacccucacagccgcaguccugcuuuuagugacccauuacgcuauuaucgggcccggacugcaggccaaagcgacucgagaggcccagaagagaacggcagcuggcauaaugaaaaacccgacaguugaugguauuaugaccaucgaccucgauccagugaucuaugacucaaaguuugagaaacaauuggggcagguaaugcugcuagugcugugugccguccagcuccuucugaugaggacuuccugggcauucugcgaagcucuaacccuggccacaggaccuauuacuacccucugggagggcagucccgguaaguuuuggaauacaacgaucgccguuagcauggcgaacauauuccggggcucguaccuggcuggggcaggauuagccuuuucuauuaugaaguccgugggcaccgggaaacgcggaacuggcagccagggugaaacacuuggggagaaguggaaaaagaaacugaaucaacucucaagaaaggaguucgaucuauauaaaaagaguggaaucaccgaggucgacaggacugaggcuaaggaaggccugaaacggggugagauuacacaccaugccgugucucgaggcuccgcaaaguugcagugguucguagaaagaaacauggugaucccagaggggcgcguuauagaucugggauguggcagagggggauggagcuacuauugcgccggccucaaaaaggugaccgaaguccgggguuacacgaaagggggacccggccacgaggagccugugccgaugucaaccuauggcuggaauaucgucaaacuuaugagugggaaggacguguuuuaccugcccccagaaaaaugugauacauugcugugcgacauuggagagagcuccccuucucccacuguugaagagagccguaccaucagaguacucaagaugguggagccuugguugaaaaacaaucaguucuguauuaagguccugaacccauacaugcccacagugaucgaacaccuugagaggcugcagcgcaaacaugguggcaugcuaguucggaauccucucucccgaaacucaacucacgaaauguauuggauuucuaaugggaccggaaacaucgugaguucggucaauauggugagcagacuguugcugaacagguuuacaaugacccaucgccggccaacuauagagaaggauguagaccucggcgcugguacgagacacgugaacgcggaacccgagacaccgaauauggacguuauuggggagcguaucaggcggaucaaggaagaacacuccucuaccuggcauuacgaugacgaaaacccuuauaaaacuugggccuaccacggaucauaugaggucaaggcaaccggcagcgcuuccaguaugauuaauggcguggugaaacuucugacaaagccaugggaugucguucccauggugacgcaaauggccaugaccgacacuacaccuuucgggcagcagcgcguauuuaaagaaaagguggauacccgaacuccaagacccaugccgggaacaaggaaggucauggagauaaccgcagagugguuauggcggacacugggucgcaacaaaagaccuagguugugcacucgagaagaguucaucaagaaagugcggaccaaugccgcuaugggcgccguuuuuacggaagagaaccaaugggacucugcgcgugcagccguggaagaugaggaguucuggaagcucgucgacagagaacgcgagcugcauaaacuagggaaguguggaagcugcguguacaauaugaugggcaaaagggaaaagaaacuuggugaguuugggaaagcuaagggaucacgggccauuugguauauguggcugggcgcaagauaccucgaguucgaagcucugggcuuuuugaacgaggaucacugguucucccgcgaaaauaguuacagcgggguagagggagaaggucugcauaaacucggcuauauccuuagggacauuucuaagauccccgggggagccauguacgcugaugacaccgccggcugggacacacgaauaacugaggaugaccugcacaacgaggagaaaaucacccagcagauggauccagagcaccggcaguuagcaaaugcgauuuuuaagcugacauaucaaaacaagguugugaaaguccagagaccuacucccaaggguaccgugauggacaucauuuccaggaaagaucagcgcgggucaggacaggugggcacguacggcuugaauacauucaccaacauggaagcccaacucauccgucagauggagggggaaggaguccugagcaaggcugaccuagagaauccacaucuucuggagaaaaagguuacucaguggcucgaaacaaaggguguggagcggcugaaaagaauggccauaucgggcgaugacugcguagugaagcccauugaugacagguucgcaaacgcuuuguuagcccugaacgauauggggaaaguccgcaaggacaucccucaguggcaaccaucuaaaggauggcacgauuggcaacaggugccguuuuguagucaucacuuccacgaacucaucaugaaggacggccgaaaacuuguugugcccugccggccucaggacgagcugauugguagagcaaggauaucccaaggggccggauggagccuacgcgaaaccgcgugucugggcaaggcuuaugcccagaugugggcacucauguacuuucauagacgggauuugaggcuggccucaaaugcuaucugcuccgccgucccagugcacuggguacccacuucucguaccacauggagcauucaugcacaccaucaguggaugacgaccgaggacaugcuuacuguuuggaaccgaguguggaucgaggauaauccuuggauggaagacaagacaccagucaccacuugggaggaugugcccuaucugggcaaacgcgaagaccaauggugugggagucucauuggauuaacauccagagcuaccugggcccagaacauccugacggcgauacagcagguucggagcuugaucgguaaugaggaguuccuggauuacaugccuucuaugaagagguuucgcaaagaagaggaaucagagggcgcuauuugguga

SEQ ID NO: 15678 - RNA, 9873 nt, Artificial Sequence
  derived and/or modified CDS sequence (opt3) from DENV-3__AY744681__SS-prME
accagccugugccucaugaugaugcuucccgccacccuggcuuuccacuugacuuccagagacggcgaaccuaggaugaucguggggaagaacgaacggggaaagucuuuacuguuuaagacggcaucagguauuaauauguguacccugauagccauggaucucggcgaaaugugcgacgauacagucacuuacaaguguccacugaucaccgaaguugagccggaagacauugauugcugguguaaccuuacaaguaccugggugacuuaugggacaugcaaucaggcgggagagcaucgccgagacaagcguagcguggcucuggcaccccacgugggcauggguuuggauacccggacgcaaacuuggauguccgcagagggggccuggaggcaggucgaaaagguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaaacccacccucgacaucgagcuccagaagacugaagcgacacaacuggcaacccuuaggaaacuguguauugagggacggaucacgaacgucaccacagauagccgcugcccuacucagggcgaagccauuuugccagaggaacaggaccagaauuauguuuguaagcacaccuacguggaucgagguugggggaacggaugcggccucuuuggcaaagggagucugguaacaugcgcuaaguuccaauguuuagaguccaucgagggaaaggccgugcagcacgaaaaucugaaauauacugucauaauuaccgugcauacaggugaccagcaccagguuggcucugagacccaaggggugacugcagaaaucacgccccaggcuagcacagucgaggccauucucccugaauacggaacccuuggccuggagugcuccccaagaacugguuuggacuuuaacgagaugauccuacugaccaugaagaauaaagcguggauggugcauaggcagugguucuuugaucucccgcugcccuggacaucaggggccaccacugaaacaccuacguggaacaagaaagagcuucugguaaccuucaagaaugcacacgcuaaaaagcaagaaguuguggucuugggcagucaggagggagccaugcacacugcucucacaggcgccaccgaaauccagacaagcgggggaacuucuauuuuugcaggucaucugaagugucgguuaaaaauggacaagcuggagcuaaaaggcauguccuaugccaugugccucaacgcuuucgugcugaagaaagaggucucagaaacccagcacgggacgauacuuaucaagguggaguacaagggagaagaugcgccauguaaaauucccuucagcaccgaggacggccaagguaaggcacauaaugggcguuugaucacagccaacccuauaguuacuaaaaaggaggaaccagugaacauugaggcugaacccccguuuggcgagaguaauaucguaaucggaauuggcgauaaagcccugaagaucaacugguacaagaaagggucuuccauuggaaagauguucgaagcaaccgcccgcggugcuagaaggauggccauacucggcgacacagcaugggauuuugggagcgucggaggcgugcuaaauucgcuugguaaaaugguucaccagaucuucgggucugcguauacugcucuguuuuccggcgugucauggauuaugaagaucggaaucggcgucuugcucaccuggauugggcugaacaguaaaaauacgagcauguccuucucuugcauagugaucggaauuaucacauuauaccugggcgccguagugcaggcagacauggguuguguuauuaacuggaaggggaaggagcuaaaaugcggaagcggcaucuuugucaccaaugaggugcauacuuggacagaacaguauaaguuccaagccgauucaccuaaacggcucgcuaccgccauagccggugcuugggagaacggcgugugugggauccgaaguacuacccgcauggaaaaucugcuuuggaagcagauugccaacgaguugaauuacauccugugggaaaacaauauuaaacucacaaucgucguuggagacgugauaggcgugcuggagcaggggaagagaacguuaacaccccagccaauggagcugaaauauuccuggaagacuuggggaaaggcgaaaauuguaacagccgaaacccaaaacagcucuuuuaucauugauggcccuaauacacccgagugcccaucagcuaguagggcauggaacgucugggaaguggaggacuacgguuucgggguuuuuacuaccaacaucuggcuuaaguugcgggaaauguauacgcagcucugugaccaccgccugaugagcgccgcugugaaagaugagagagccguccacgcagacaugggauacuggauagagucccagaagaauggcucuuggaaacuagaaaaggcgucgcugaucgaggugaagacaugcaccuggcccaaaagccauacucucugguccaacgguguucuggaaucagauaugauuaucccuaagagucuugccggcccaauuucucagcacaauuacaggccgggguaucauacccaaacagcuggacccuggcacuugggcaaacuggaguuagacuucaacuacugcgaggggacuaccgugguaaucacagaaaauuguggaacgcguggcccuagccuccggaccacuacagucuccgguaagcugauacacgaguggugcugucgaucaugcacccuuccaccccugagauauaugggggaagauggauguugguacggcauggagauuaggccuaucaacgaaaaagaggagaauaugguaaagagcuuggugucugccgguuccggcaaggcagacaacuuuacuauggggguccucugccuggcuauccuauucgaagagguuaugcgcggaaaauucggcaagaaacauaugauugccggggcacuguuuacauucgugcuccugcuuaguggacagaucaccuggcgggauauggcccacacguugauuaugauaggcagcaaugcuucugacagaauggguauggggguaacuuaucuggcguuaaucgccaccuuuaagauucagccauuccucgcacugggauuuuuccuuaggaaacugacaucccgcgaaaaccuacuccugggcgugggcuuggcuauggccaccacucugcaauuacccgaggauaucgaacagauggccaaugggauugcucucggacugauggcacuuaagcugaucacacaguuugagaccuaccaguuguggacagcccucgucucacugauguguaguaacacuauauucacccuaacgguggcguggcgaacagcuacccugauccuugccguuauuagccuccugccggugugccaaucguccucuaugcggaagacugacugguugccuaugaccgucgcagccaugggugugccaccccugccuuuauuuaucuucagccucaaagauacacugaagcguagaucauggccccuuaaugagggcguuauggcuguggggcuggucaguauuuuggcauccucuuuucucaggaacgacguaccaauggccggaccucugguggcgggcggucuacugaucgcuuguuauguuauaacugggaccagcgccgaucuuacgguggaaaaagcagccgacgucacaugggaggaagaggcugaacagaccggagugucccauaaucucaugauuacuguagacgaugacggcacaaugcgcaucaaggaugacgagaccgagaacauccugacuguguuguuaaaaacagcccugcucauugucucaggcauauuccccuacagcaucccagcaacccugcuuguuuggcacacguggcagaagcagacucaacggaguggggugcugugggaugugccgucuccucccgaaacccagaaagcugaguuggaagagggagucuacagaauuaagcagcaggguaucuuuggcaagacacaaguggggguuggaguacagaaagagggcguguuccauaccauguggcacgucacaaggggugccgugcuaacucacaacgggaagcgacuggaaccaaauugggcgaacguuaaaaaggaccucauuuccuauggaggcggcuggaaacugagcgcccaguggcaaaagggggaggaagugcaggucaucgcaguggagcccggaaagaauccuaaaaacuuccagaccaugccagguauauuucagacgacaacuggcgaaaucggggcuauugcccuugauuucaagcccggaaccucgggcucaccuaucauuaaucgcgaggguaaaguagucggguuauacggaaacggcgugguuacaaagaauggcggguaugugucuggaaucgcucaaaccaacgcagagccggacgguccaacucccgaacuggaggaagagauguuuaaaaagcggaaucucaccauaauggauuugcauccuggcagugggaagacaagaaaauaccugccagccauugucagggaagccaucaagcgucgccuccggacgcugauccuugcucccacuagagugguugcggcagagauggaggaagcccugaaaggauugccuauuagguaucagaccacagcuaccaaguccgagcacacuggccgagaaaucguggaccuaaugugccaugccacauucaccaugcggcugcucagcccgguccgcgugcccaacuacaauuuaauaguaauggaugaggcacacuuuacggacccagccucuauugcugcgagagguuauaucagcacuaggguggggaugggagaagccgcagcuauuuucaugacagccaccccucccggcaccgcagaugccuuuccacaguccaacgcuccuauccaggacgaggagcgggacauacccgaacgaucauggaauaguggcaacgaguggauuacugauuucgccgggaaaacaguuugguuugucccaagcaucaaggcgggaaaugacaucgcaaacugucugagaaagaacgguaaaaaggugauucaacuuucucgcaaaaccuucgauacagaauaccagaagacuaaacugaaugacugggauuuuguggucacgaccgacaucuccgagaugggcgccaacuucaaggcugauaggguaauugacccgcgucggugccucaagccugugauauugacagaugggcccgagagaguuauccuggccggaccaaugcccgugacugucgcuucagcagcccagaggcgcggccgaguggguagaaauccucagaaagaaaacgaccaauacauuuucaccgggcagccacucaauaacgaugaggaccaugcucacuggacagaagccaagaugcugcuugacaauaucaacacccccgagggcaucauuccugcacuauuugaaccggagcgggagaaaagugcggccauagauggagaauauaggcugaagggcgagagccgcaaaacuuucguugaauugaugcguagaggggacuuaccaguguggcuggcucacaaggucgccuccgagggaaucaaauacacggaucggaaguggugcuuugacggugaaaggaauaaccagauucucgaggagaauauggauguggaaaucuggaccaaggagggcgagaagaagaaacugcgcccccgauggcuugacgcaagaacauauucugauccucuggcucucaaggaguucaaagacuuugccgcagggcggaagucgauugccuuggaucugguaacugaaaucggaagggugcccagccaucuagcucaccgcaccagaaacgcgcuggacaaucucguuaugcuucauacaucagagcacggcgguagggccuaccggcacgcagucgaggaacugccagagaccauggaaacuuuauugcugcucgggcugaugauacuucugacaggcggagcuaugcuauucuugaucuccggcaaggggauuggaaaaacgaguaucggucugauuugugugguggccucuagcggcauguuauggauggccgaugucccucuacaguggaucgcauccgcuauaguucuggaguuuuucaugauggugcuccuuauucccgagccagaaaagcaacguaccccucaggacaaccagcuggccuauguagugaucgggauuuugacucuggcggcuaucgucgccgcaaaugagaugggacuccuggaaacaaccaaacgcgaucuuggcaugucaaaggagccgggugugguuucucccaccagcuaccucgacguggaccugcauccagccagugcuuggacauuguaugcagucgccacuacgguaauaaccccuaugcugcgacacacaaucgaaaacuccacugcgaaugugagcuuagcugccauugcaaaccaagccguugugcuaauggggcuggauaaaggcuggcccaucucuaagauggaccucggagucccacuucuggcuuugggcugcuacucacaggugaacccucugacccucacagccgcaguccugcuuuuagugacccauuacgcuauuaucgggcccggacugcaggccaaggcgacuagagaggcccagaaaaggacggcagcuggcauaaugaagaauccgacaguugaugguauuaugaccaucgaccucgauccagugaucuaugacuccaaauuugagaagcaauuggggcagguaaugcugcuagugcugugugccguccagcuccuucugaugcggaccaguugggcauucugcgaggcuuugacucuggccacaggaccuauuacuacccucugggaaggcagccccgguaaauuuuggaacacaacgaucgccguuucgauggcgaauauauuccgcggcucuuaccuggcuggggcaggauuagccuuuuccauuaugaaaagcgugggcaccgggaagagaggaacuggcucacagggugaaacacuuggggagaaauggaagaaaaagcugaaccaacucaguaggaaagaguucgaucuauauaagaaaucuggaaucaccgaggucgaccggacugaggcuaaggaaggccugaagcgaggugagauuacacaccaugccguguccagaggcagcgcaaaauugcagugguucguagaacgcaauauggugaucccagaggggaggguuauagaucugggauguggcagagggggauggucauacuauugcgccggccucaagaaagugaccgaaguccgugguuacacgaaagggggacccggccacgaggagccugugccgaugaguaccuauggcuggaacaucgucaaacuuaugagcgggaaggacguguuuuaccugcccccagaaaagugugauacauugcugugcgacauuggagaguccucuccuagccccacuguugaagaguccagaaccaucaggguacucaaaaugguggagccuugguuaaagaauaaccaguucuguauuaaaguccugaauccauacaugcccacagugaucgaacaccuugagcgccugcagcggaagcaugguggcaugcuaguucgaaacccucucucaagaaauucuacucacgaaauguauuggauuaguaacgggaccggaaauaucgugucgagcgucaacaugguguccaggcuguugcugaaucgcuuuacaaugacccaucggagaccaacuauagagaaagauguagaccucggcgcugguacgcgucacgugaacgcggaacccgagacaccgaacauggacguuauuggggagaggauccggcgcaucaaggaagaacacucuucaaccuggcauuacgaugacgaaaauccuuauaagacuugggccuaccacggaagcuaugaggucaaagcaaccggcuccgcuaguucuaugauuaacggcguggugaaacuucugacaaaaccaugggaugucguucccauggugacgcaaauggccaugaccgacacuacaccuuucgggcagcagcgaguauuuaaggaaaaaguggauaccagaacuccaaggcccaugccgggaacacggaaggucauggagauaaccgcagagugguuauggcgcacacuggguagaaauaagaggccucgauugugcacucgggaagaguucaucaaaaaggugcguaccaacgccgcuaugggcgccguuuuuacggaagagaaucaaugggacagcgcgagagcagccguggaagaugaggaguucuggaaacucgucgaccgcgaaagggagcugcauaagcuagggaaauguggaucaugcguguacaacaugaugggcaagcgggagaagaaacuuggugaguuugggaaggcuaaaggauccagagccauuugguauauguggcugggcgcacgcuaccucgaguucgaagcucugggcuuuuugaaugaggaucacugguucaguagggaaaacagcuacucugggguagagggagaaggucugcauaagcucggcuauauccuucgagacauuuccaaaauccccgggggagccauguacgcugaugacaccgccggcugggacacacggauaacugaggaugaccugcacaaugaggaaaagaucacccagcagauggauccagagcacagaagguuagcaaacgcgauuuuuaaacugacauaucagaauaagguugugaagguccaacgcccuacucccaaagguaccgugauggacaucauuucacguaaggaucagcgggggagcggacaggugggcacguacggcuugaacacauucaccaauauggaagcccagcucaucagacaaauggagggggaaggaguccugucgaaagcugaccuagagaacccacaucuucuggagaagaaaguuacucaguggcucgaaacaaaggguguggagaggcugaagcgcauggccauaucuggcgaugacugcguagugaaacccauugaugaccgauucgcaaaugcuuuguuagcccugaacgauauggggaagguccggaaagacaucccucaguggcagccaaguaagggauggcacgauuggcaacaggugccguuuuguucccaucacuuccacgaacucaucaugaaagacggcagaaaacuuguugugcccugcaggccucaggacgagcugauuggucgcgcaagaauaagccagggggccggauggucacuacgggaaaccgcgugucugggcaaggcuuaugcccaaaugugggcacucauguacuuucauaggcgugauuugcgacuggccuccaacgcuaucugcucugccgucccagugcacuggguacccacuagccgcaccacauggaguauucaugcacaccaucaguggaugacgaccgaggacaugcuuacuguuuggaauagaguguggaucgaggauaacccuuggauggaagacaaaacaccagucaccacuugggaggaugugcccuaucugggcaagcgggaagaccaguggugugggucccucauuggauuaacaagcagggcuaccugggcccaaaauauccugacggcgauacagcagguucgcucuuugaucgguaacgaggaguuccuggauuacaugccuucaaugaaaagauuucggaaggaagaggaaagugagggcgcuauuugguga

SEQ ID NO: 15679 - RNA, 9873 nt, Artificial Sequence
  derived and/or modified CDS sequence (opt3) from DENV-3__AY744682__SS-prME
accagccugugccucaugaugaugcuucccgccacucuggcuuuccacuugacuucccgagacggagaaccuaggaugaucguggggaagaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguugcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucaccauaacagugcauaccggugaccagcaccagguuggcaacgagacucaaggggugacggcagaaauuacaccccaggcuucuaccgucgaggccauccucccugaauacggaacucuuggccuggagugcagcccacgaaccgguuuggacuuuaaugagaugauucuccugacaaugaaaaacaaggcguggauggugcauagacagugguucuuugaucucccgcugcccuggaccuccggggccacuacagaaacgccuaccuggaauaaaaaggagcuucugguaacuuucaaaaacgcacacgcuaagaagcaagaaguuguggucuugggcucacaggagggagccaugcacacagcucucaccggcgccacagaaauccagacaagugggggaaccagcaucuuugcaggucaucugaaauguagguuaaagauggacaaacuggagcuaaagggcaugucuuaugccaugugccucaaugcuuucgugcugaaaaaggaggucuccgaaacgcagcacgggaccauucuuauaaagguggaguacaaaggagaagaugcgccauguaagauccccuucucaacagaggacggccaagguaaagcacauaacgggcgguugauuacugccaacccuaucguuaccaagaaagaggaaccagugaauauagaggcugaacccccguuuggcgagagcaacauuguaaucggaaucggcgauaaggcccugaagauuaauugguacaaaaaggggaguucuaucggaaaaauguucgaagcaacagcccguggugcucgcagaauggccauucucggcgacacugcaugggauuuuggguccgucggaggcgugcugaacagccuugguaagaugguucaccagauauucgggucggcguauaccgcucuguuuucuggcguguccuggaucaugaaaauuggaaucggcgucuugcucacguggaucgggcuaaauucaaagaacacaaguaugagcuucuccugcauugugauaggaaucauuaccuuauaccugggcgccguagugcaggcagacauggguuguguuaucaauuggaaggggaaagagcuaaagugcggaucuggcauuuuugucacuaacgaggugcauacauggaccgaacaguauaaauuccaagccgauagcccuaagaggcucgcuacugccaucgccggugcuugggagaauggcgugugugggauacggucaaccacacgaauggaaaaccugcuuuggaaacagaucgccaaugaguugaacuacauucugugggaaaauaacaucaagcucacgauugucguuggagacgugaucggcgugcuggagcaggggaaacgcaccuuaacuccccagccaauggagcugaaguauaguuggaagacauggggaaaagcgaagauaguaaccgccgaaacacaaaauuccagcuuuauuaucgauggcccuaacacucccgagugcccaucugcuucaagagcauggaacgucugggaaguggaggacuacgguuucgggguuuuuaccacgaauauuuggcuuaaauugagggaaguguauacacagcucugugaccaccggcugaugagugccgcugucaaggaugagcgcgccgugcacgcagacaugggauacuggaucgagagccagaaaaacggcuccuggaagcuagaaaaggcgucucugauagagguuaaaaccugcacuuggcccaagucgcauacccucuggagcaauggugugcuggaauccgauaugaucauuccuaaaucacuugccggcccaaucagucagcacaacuacagaccgggguaucauacacaaacugcuggacccuggcacuugggcaagcuggaguuagacuucaauuacugcgaggggaccacaguagucauuacggaaaacuguggaaccaggggcccuucucuccguacuacaaccgugagcgguaaacugauccacgaguggugcugucgguccugcacucuuccaccccugcgauauaugggggaagauggauguugguacggcauggagauaagaccuauuaaugaaaaggaggagaacauggugaagucauuggucagcgccgguucuggcaaagcagacaauuuuacaauggggguucucugccuggcuauccuauucgaagaggugaugaggggaaaguucggcaaaaagcauaugaucuccggggcccuguuuaccuucguacuccugcuuaguggacagauuacguggcgcgauauggcacacacuuugaucaugauuggcagcaacgccucugaccggauggguaugggggugaccuaucuggcuuuaauagcgacauuuaaaauccagccauuccucgcccugggauuuuuccuuagaaagcugaccuccagggaaaaucuacuccugggcgucggcuuggcaauggcuacuacacugcaauuacccgaggauauugaacagauggccaacgggaucgcccucggacugauggcucuuaagcugauuacccaguuugagacauaccaguuguggacugcacucgugucacugauguguaguaauaccaucuucacgcuaacaguugccuggcgcaccgcgacucugauacuugcugugaucagccuccugccggucugccaaucguccucuaugcgaaaaaccgacugguugccuaugacaguggccgcaauggguguuccaccccugccuuuauuuauuuucagccucaaggauacucugaaacggcguucauggccccuuaacgagggcgugauggccgucgggcugguaaguaucuuggcuuccucuuuucucagaaaugacgugccaauggcaggaccucugguugccggcggucuacugauugcguguuaugugaucaccgggacgagcgcugaucuuacagucgaaaaggccgcagacgugaccugggaggaagaggccgaacagacuggaguaucccauaaccucaugauaacaguggacgaugacggcaccaugaggauuaaagaugacgagacugagaacauccugacagucuuguuaaagaccgcucugcucaucguuucaggcauuuuccccuacagcauaccagccacgcugcuuguguggcacacuuggcagaaacagacccaacgcaguggggugcugugggaugucccgucuccucccgaaacacagaaggcagaguuggaagagggaguguaccggaucaagcagcaggguauuuuuggcaaaacccaaguugggguaggagugcagaaggagggcgucuuccauacaauguggcacgugacuagaggugcuguucuaacccacaaugggaaaaggcuggaaccaaacugggccaaugugaagaaagaccucaucuccuauggaggcggcuggaagcugagcgcgcaguggcaaaagggggaggaaguccaggugauugccguagagcccggcaagaacccuaagaauuuccagacgaugccagguaucuuucagacaacuaccggcgaaauaggggcaaucgcucuugauuucaaacccggaacaucgggcucaccuauuaucaaccgagaggguaaggucgugggguuauacggaaauggcguugugaccaaaaacggcggguaugucucuggaauugcccaaacuaaugcugagccggacgguccaacccccgaacuggaggaagagauguuuaagaagcgcaaccucacaaucauggauuugcauccuggcagugggaaaacgcggaaguaccugccagcaauagugagagaagccauuaaaaggcgucuccgcacucugauccuugcccccacccggguuguggcugcggagauggaggaagcacugaagggauugccuaucagauaucagacaaccgccacuaaauccgagcacacaggcagggaaauugucgaccuaaugugccaugcuaccuucacgaugcgacugcucagcccggugcggguacccaauuacaacuuaaucgugauggaugaggcccacuuuacugacccagcaucuauagccgcucgcgguuauauuagcacaagaguugggaugggagaagcggccgcaaucuucaugaccgcuaccccucccggcacugccgaugcauuuccacaguccaaugccccuauucaggacgaggagagggacauccccgaacggucauggaacaguggcaaugaguggauaacagauuucgcugggaagaccgucugguuugugccaagcauuaaggccggaaacgacaucgcgaacugucugagaaagaaugguaagaaagugauccaacuuucuagaaagacauucgauacugaauaccagaaaacgaagcugaacgacugggauuuugucguaaccacagacauuuccgagaugggcgcaaauuucaaggccgaucgcgugaucgacccgaggcguugccucaaaccuguuauuuugacugaugggcccgagcgggugauacuggcuggaccaaugcccgucaccguggccucagcugcacagagaaggggccgcguuggucgaaacccucagaaggaaaaugaccaauacaucuucacagggcagccacucaacaaugaugaggaccaugcccacuggaccgaagcuaaaaugcugcuugacaacauuaauacucccgagggcaucaucccugcccuauuugaaccggagagagagaagagugcagcgauugauggagaauaucggcugaaaggcgagagcaggaagacguucguggaauugaugcgccguggggacuuaccagucuggcuggcccacaaaguggcuuccgagggaauaaaguacaccgauagaaaguggugcuuugacggugaacggaacaaucagauccucgaggagaacauggauguagaaauuuggacaaaagagggcgaaaagaaaaagcugaggccccgcuggcuugacgcccgaacuuauucugauccucuggcacucaaagaguucaaggacuuugcugccgggagaaagucgaucgcauuggaucuggugaccgaaauuggacggguucccagccaucuagcccacaggacacgcaaugcucuggacaaccucgucaugcuucauaccucagagcacggcgguagagcguacaggcacgccguggaggaacugccagagacuauggaaacauuauugcugcucgggcugaugauccuucugacgggcggagcaaugcuauucuugauauccggcaaagggaucggaaagaccaguauuggucugaucuguguggucgcuucuagcggcauguuauggauggccgauguuccucuacaguggauugccuccgcaaucgugcuggaguuuuucaugaugguacuccuuauacccgagccagaaaaacaacggacuccucaggacaaucagcuggcuuauguggucauugggaucuugacacuggccgcgauuguggcugccaacgagaugggacuccuggaaaccaccaagcgugaucuuggcaugucaaaagagccggguguugugucucccacaagcuaccucgacgucgaccugcauccagcaagugccuggacuuuguaugcuguagcaacgaccgugaucacaccuaugcugcgccacacuauagaaaauuccaccgccaacguuagcuuagcggcuaucgccaaccaagcagugguccuaauggggcuggauaagggcuggcccauuucuaagauggaccucggagugccacuucuggccuugggcugcuacucacaggucaauccucugacacucaccgcugccgugcugcuuuuaguuacucauuacgcaaucauugggcccggacugcaggcuaaagccacgcgagaggcgcagaagagaacagccgcaggcaucaugaaaaacccgaccguggaugguauaaugacuauugaccucgauccaguaaucuaugacuccaaguuugagaaacaauugggacaggugaugcugcuaguccugugugcuguucagcuccuucugaugaggaccaguugggccuucugcgaagcauugacacuggcuacuggaccuaucaccacacucugggagggcagccccgguaaguuuuggaauacgaccauugccgugucgauggccaacaucuuccggggcucuuaccuggcgggggcuggauuagcauuuuccauaaugaaaagcgucggcacugggaaacgcggaacaggcucacagggugaaacccuuggggagaaguggaaaaagaaacugaaucaacucaguagaaaggaguucgaucuauauaaaaagucuggaauuacugagguggacaggacagaggccaaggaaggccugaaacggggugagaucacccaccaugcuguaucccgaggcagcgccaaguugcagugguucguggaaagaaacaugguuauuccagaggggcgcgugaucgaucugggauguggcagaggcggguggucauacuauugcgcagggcucaaaaaggucacggaagugcgggguuacaccaaagggggacccggccacgaggagccugucccgaugaguacauauggcuggaauauagugaaacuuaugagcgggaaggacguauuuuaccugcccccagaaaaaugugauacuuugcugugcgacaucggagaguccucuccuagccccaccguagaagagucccguacaauuagagugcucaagauggucgagccuuggcuaaagaacaaucaguucuguaucaaggugcugaacccauacaugcccacuguuauugaacaccuugagaggcugcagcgcaaacaugguggcaugcuagugcggaauccucucucacgaaacucuacccacgaaauguauuggaucaguaaugggacaggaaacauugucucgagcgugaauaugguauccagacuguugcugaacagguuuaccaugacucaucgccggccaacgaucgagaaggauguggaccucggcgccgguacaagacacguuaacgcugaacccgagaccccgaauauggacgucauaggggagcguauuaggcggaucaaggaagaacacucuucaacuuggcauuacgaugacgaaaacccuuauaaaaccugggcguaccacggaagcuaugaggugaaggccacaggcuccgcaaguucuaugaucaauggcguggucaaacuucugacgaagccaugggauguugugcccaugguaacccaaauggcuaugacugacacaaccccuuucgggcagcagcgcguguuuaaagaaaaggucgauacucgaacaccaagacccaugccgggaaccaggaaggugauggagauuacagccgagugguuauggcggacucugggucgcaacaaaagaccuagguugugcacccgagaagaguucauaaagaaaguucggacgaaugcagccaugggcgcuguguuuaccgaagagaaccaaugggacagcgcccgugcggcagucgaagaugaggaguucuggaagcucguggacagagaacgcgagcugcauaaacuagggaaguguggaucaugcguauacaauaugaugggcaaaagggaaaagaaacuuggugaguuugggaaagccaagggaucccgggcuaucugguauauguggcugggcgccagauaccucgaguucgaagcacugggcuuuuugaacgaggaucacugguucagucgcgaaaauagcuacucugggguugagggagaaggucugcauaaacucggcuauauucuuagggacaucuccaagauucccgggggagcuauguacgccgaugacacagcuggcugggacacucgaaucaccgaggaugaccugcacaacgaggagaagauaacacagcagauggauccagagcaccggcaguuagccaaugcaaucuuuaagcugacuuaucaaaacaagguggucaaagugcagagaccuacccccaaggguacggugauggacauuaucucaaggaaagaucagcgcgggagcggacaggucggcacauacggcuugaauaccuucacuaacauggaagcgcaacucauucgucagauggagggggaaggaguucugucgaaggccgaccuagagaauccauaucuucuggagaaaaaggugacacaguggcucgaaaccaaggguguagagcggcugaaaagaauggcuaucucuggcgaugacugcguggucaagcccauagaugacagguucgccaacgcauuguuagcucugaacgauauggggaaagugcgcaaggacauuccucaguggcaaccaaguaaaggauggcaugauuggcagcagguuccguuuuguucccaccauuuccacgaacucaucaugaaggacggccgaaaacuugugguccccugccggccucaggacgagcugaucgguagagccaggauuagccaaggggcaggauggucacuacgcgaaacugccugucugggcaaagcguacgcucagaugugggcccucauguauuuucacagacgggauuugaggcuggcauccaaugccauaugcucugcugugccaguacauuggguucccaccagccguacaacguggaguauccacgcccaucaccaguggaugaccacugaggacaugcuuacaguguggaaccgagucuggauugaggauaauccuuggauggaagacaagaccccagugacuacaugggaggauguucccuaccugggcaaacgcgaagaccaauggugugggucccucaucggauuaaccagcagagcaacgugggcucagaacauucugacagccauccaacaggugcggucuuugauagguaaugaggaguuccuggauuacaugccuucaaugaagagguuucgcaaagaagaggaaagugagggcgcgaucugguga

SEQ ID NO: 15680 - RNA, 9873 nt, Artificial Sequence
  derived and/or modified CDS sequence (opt3) from DENV-3__AY744683__SS-prME
accagccugugccucaugaugaugcuucccgccacacuggcuuuccacuugacuucccgagacggagaaccuaggaugaucguggggaaaaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuccugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauauucacccuaacgguggcguggcgcacagcuacccugauccuugccguuauuagucuccugccggugugccaaagcucguccaugcgaaaaacugacugguugccuaugaccgucgcagccaugggugugccaccccugccuuuauuuaucuucucucucaaggauacacugaaacggcguagcuggccccuuaacgagggcguuauggcuguggggcuggucucaauuuuggcaaguuccuuucucagaaaugacguaccaauggccggaccucugguggcgggcggucuacugaucgcuuguuauguuauaacugggaccucugccgaucuuacgguggaaaaggcagccgacgucacaugggaggaagaggcugaacagaccggagugagccauaaccucaugauuacuguagacgaugacggcacaaugaggaucaaagaugacgagaccgagaacauccugacuguguuguuaaagacagcccugcucauugucuccggcauauuccccuacucaaucccagcaacccugcuuguuuggcacacguggcagaaacagacucaacgcagcggggugcugugggaugugccgaguccucccgaaacccagaaggcugaguuggaagagggagucuaccggauuaagcagcaggguaucuuuggcaaaacacaaguggggguuggaguacagaaggagggcguguuccauaccauguggcacgucacaagaggugccgugcuaacucacaaugggaaaaggcuggaaccaaacugggcgaauguuaagaaagaccucauuucuuauggaggcggcuggaagcuguccgcccaguggcaaaagggggaggaagugcaggucaucgcaguggagcccggcaagaacccuaagaauuuccagaccaugccagguauauuucagacgacaacuggcgaaaucggggcuauugcccuugauuucaaacccggaaccagcggcucgccuaucauuaaccgagaggguaagguagucggguuauacggaaauggcgugguuaccaagaacggcggguaugugucaggaaucgcucaaaccaaugcagagccggacgguccaacucccgaacuggaggaagagauguuuaagaagcgcaaccucaccauaauggauuugcauccuggcucugggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaaagugagcacacuggcagggaaaucguggaccuaaugugccaugccacauucaccaugcgacugcucuccccgguccgggugcccaauuacaacuuaauaguaauggaugaggcacacuuuacggacccagccagcauugcugcgcgcgguuauaucucuacuagaguggggaugggagaagccgcagcuauuuucaugacagccaccccucccggcaccgcagaugccuuuccacagagcaaugcuccuauccaggacgaggagagggacauacccgaacgguccuggaacucaggcaaugaguggauuacugauuucgccgggaagacaguuugguuugucccaaguaucaaggcgggaaacgacaucgcaaacugucugagaaagaaugguaagaaagugauucaacuuagcagaaagaccuucgauacagaauaccagaaaacuaagcugaacgacugggauuuuguggucacgaccgacaucucugagaugggcgccaauuucaaggcugaucgcguaauugacccgaggcguugccucaaaccugugauauugacagaugggcccgagcggguuauccuggccggaccaaugcccgugacugucgcuuccgcagcccagagaaggggccgcgugggucgaaacccucagaaggaaaaugaccaauacauuuucaccgggcagccacucaacaaugaugaggaccaugcucacuggacagaagccaaaaugcugcuugacaacaucaauacccccgagggcaucauuccugcacuauuugaaccggagagagagaagucagcggccauagauggagaauaucggcugaaaggcgagaguaggaagacuuucguugaauugaugcgccguggggacuuaccaguguggcuggcucacaaagucgccagcgagggaaucaaguacacggauagaaaguggugcuuugacggugaacggaacaaucagauucucgaggagaacauggauguggaaaucuggaccaaagagggcgaaaagaaaaagcugaggccccgcuggcuugacgcacgaacauauuccgauccucuggcucucaaagaguucaaggacuuugccgcagggagaaagucuauugccuuggaucugguaacugaaaucggacgggugcccucgcaucuagcucacaggacccgcaaugcgcuggacaaccucguuaugcuucauacaagcgagcacggcgguagagccuacaggcacgcagucgaggaacugccagagaccauggaaacuuuauugcugcucgggcugaugauacuucugacaggcggagcuaugcuauucuugaucucaggcaaagggauuggaaagacguccaucggucugauuugugugguggccaguucuggcauguuauggauggccgaugucccucuacaguggaucgcaagcgcuauaguucuggaguuuuucaugauggugcuccuuauucccgagccagaaaaacaacggaccccucaggacaaucagcuggccuauguagugaucgggauuuugacucuggcggcuaucgucgccgcaaacgagaugggacuccuggaaacaaccaagcgugaucuuggcauguccaaagagccgggugugguuucacccaccucuuaccucgacguggaccugcauccagccagcgcuuggacauuguaugcagucgccacuacgguaauaaccccuaugcugcgccacacaaucgaaaauaguacugcgaacguguccuuagcugccauugcaaaccaagccguugugcuaauggggcuggauaagggcuggcccaucagcaagauggaccucggagucccacuucuggcuuugggcugcuacucucaggugaauccucugacccucacagccgcaguccugcuuuuagugacccauuacgcuauuaucgggcccggacugcaggccaaagcgacucgagaggcccagaagagaacggcagcuggcauaaugaaaaacccgacaguugaugguauuaugaccaucgaccucgauccagugaucuaugacucaaaguuugagaaacaauuggggcagguaaugcugcuagugcugugugccguccagcuccuucugaugaggacuuccugggcauucugcgaagcucuaacccuggccacaggaccuauuacuacccucugggagggcagucccgguaaguuuuggaauacaacgaucgccguuagcauggcgaacauauuccggggcucguaccuggcuggggcaggauuagccuuuucuauuaugaaguccgugggcaccgggaaacgcggaacuggcagccagggugaaacacuuggggagaaguggaaaaagaaacugaaucaacucucaagaaaggaguucgaucuauauaaaaagaguggaaucaccgaggucgacaggacugaggcuaaggaaggccugaaacggggugagauuacacaccaugccgugucucgaggcuccgcaaaguugcagugguucguagaaagaaacauggugaucccagaggggcgcguuauagaucugggauguggcagagggggauggagcuacuauugcgccggccucaaaaaggugaccgaaguccgggguuacacgaaagggggacccggccacgaggagccugugccgaugucaaccuauggcuggaauaucgucaaacuuaugagugggaaggacguguuuuaccugcccccagaaaaaugugauacauugcugugcgacauuggagagagcuccccuucucccacuguugaagagagccguaccaucagaguacucaagaugguggagccuugguugaaaaacaaucaguucuguauuaagguccugaacccauacaugcccacagugaucgaacaccuugagaggcugcagcgcaaacaugguggcaugcuaguucggaauccucucucccgaaacucaacucacgaaauguauuggauuucuaaugggaccggaaacaucgugaguucggucaauauggugagcagacuguugcugaacagguuuacaaugacccaucgccggccaacuauagagaaggauguagaccucggcgcugguacgagacacgugaacgcggaacccgagacaccgaauauggacguuauuggggagcguaucaggcggaucaaggaagaacacuccucuaccuggcauuacgaugacgaaaacccuuauaaaacuugggccuaccacggaucauaugaggucaaggcaaccggcagcgcuuccaguaugauuaauggcguggugaaacuucugacaaagccaugggaugucguucccauggugacgcaaauggccaugaccgacacuacaccuuucgggcagcagcgcguauuuaaagaaaagguggauacccgaacuccaagacccaugccgggaacaaggaaggucauggagauaaccgcagagugguuauggcggacacugggucgcaacaaaagaccuagguugugcacucgagaagaguucaucaagaaagugcggaccaaugccgcuaugggcgccguuuuuacggaagagaaccaaugggacucugcgcgugcagccguggaagaugaggaguucuggaagcucgucgacagagaacgcgagcugcauaaacuagggaaguguggaagcugcguguacaauaugaugggcaaaagggaaaagaaacuuggugaguuugggaaagcuaagggaucacgggccauuugguauauguggcugggcgcaagauuccucgaguuugaagcucugggcuucuugaacgaggaucacugguuuucccgcgaaaauaguuacagcgggguagagggagaaggucugcauaaacucggcuacauccuuagggacauuucuaagauccccgggggagccauguaugcugaugacaccgccggcugggacacacgaauaacugaggaugaccugcacaacgaggagaaaaucacccagcagauggauccagagcaccggcaguuagcaaaugcgauuuucaagcugacauaccaaaacaagguugugaaaguccagagaccuacucccaaggguaccgugauggacaucauuuccaggaaagaucagcgcgggucaggacaggugggcacguauggcuugaauacauucaccaacauggaagcccaacucauccgucagauggagggggaaggaguccugagcaaggcugaccuagagaauccacaucuucuggagaaaaagguuacucaguggcucgaaacaaaggguguggagcggcugaaaagaauggccauaucgggcgaugacugcguagugaagcccauugaugacagguuugcaaacgcuuuguuagcccugaacgauauggggaaaguccgcaaggacaucccucaguggcaaccaucuaaaggauggcacgauuggcaacaggugccguucuguagucaucacuuucacgaacucaucaugaaggacggccgaaaacuuguugugcccugccggccucaggacgagcugauugguagagcaaggauaucccaaggggccggauggagccuacgcgaaaccgcgugucugggcaaggcuuacgcccagaugugggcacucauguauuuccauagacgggauuugaggcuggccucaaaugcuaucugcuccgccgucccagugcacuggguacccacuucucguaccacauggagcauucaugcacaccaucaguggaugacgaccgaggacaugcuuacuguuuggaaccgaguguggaucgaggauaauccuuggauggaagacaagacaccagucaccacuugggaggaugugcccuaccugggcaaacgcgaagaccaauggugugggagucucauuggauuaacauccagagcuaccugggcccagaacauccugacggcgauacagcagguucggagcuugaucgguaaugaggaguuucuggauuauaugccuucuaugaagagguuccgcaaagaagaggaaucagagggcgcuauuugguga

SEQ ID NO: 15681 - RNA, 9873 nt, Artificial Sequence
  derived and/or modified CDS sequence (opt3) from DENV-3__AY744684__SS-prME
accagccugugccucaugaugaugcuucccgccacacuggcuuuccacuugacuucccgagacggagagccuaggaugaucguggggaagaacgaacggggaaaaucuuuacuguuuaagacggcaucagguauuaauauguguaccuuaauagccauggaucucggcgagaugugcgacgauacagucacuuacaaauguccacugaucaccgaaguugagccggaagacauugauugcugguguaaccuuacaaguaccugggugacuuaugggacaugcaaucaggcgggagagcaucgccgagacaagcguagcguagcucuggcaccccacgugggcauggguuuggauaccagaacgcagacuuggauguccgcagagggggccuggaggcaggucgaaaaaguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagggacuucguugaaggauugucaggugcuacguggguggaugucgugcuggagcauggcgggugcgugacuacaauggccaagaauaaacccacccuggacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagacccaaggggugacugcagaaaucacgccccaggcuucuacagucgaggccauucucccugaauacggaacccuuggccuggagugcagcccacgaacugguuuggacuuuaaugagaugauccuacugaccaugaaaaacaaggcguggauggugcauagacagugguucuuugaucucccgcugcccuggacauccggggccaccacugaaacaccuacguggaauaaaaaggagcuucugguaaccuucaaaaacgcacacgcuaagaagcaagaaguuguggucuugggcucacaggagggagccaugcacacugcucucacaggcgccaccgaaauccagacaagugggggaacuagcauuuuugcaggucaucugaaauguagguuaaagauggacaaacuggagcuaaagggcaugucuuaugccaugugccucaaugcuuucgugcugaaaaaggaggucuccgaaacccagcacgggacgauacuuaucaagguggaguacaaaggagaagaugcgccauguaagauucccuucucaaccgaggacggccaagguaaagcacauaacgggcgguugaucacagccaacccuauaguuacuaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaaccgcccguggugcucgcagaauggccauacucggcgacacagcaugggauuuuggguccgucggaggcgugcugaacagccuugguaagaugguucaccagaucuucgggucggcguauacugcucuguuuucuggcguguccuggauuaugaaaaucggaaucggcgucuugcucaccuggauugggcuaaauucaaagaacacgaguaugagcuucuccugcauagugaucggaauuaucacauuauaccugggcgccguagugcaggcagacauggguuguguuauuaauuggaaggggaaagagcuaaagugcggaucuggcaucuuugucaccaacgaggugcauacuuggacagaacaguauaaauuccaagccgauagcccuaagaggcucgcuaccgccauagccggugcuugggagaauggcgugugugggauccggucaacuacccgaauggaaaaccugcuuuggaaacagauugccaaugaguugaacuacauccugugggaaaauaacauuaagcucacaaucgucguuggagacgugauaggcgugcuggagcaggggaaacgcacguuaacaccccagccaauggagcugaaguauaguuggaagacuuggggaaaagcgaagauuguaacagccgaaacccaaaauuccagcuuuaucauugauggcccuaacacacccgagugcccaucugcuucaagagcauggaacgucugggaaguggaggacuacgguuucgggguuuuuacuaccaauaucuggcuuaaauugagggaaauguauacgcagcucugugaccaccggcugaugagugccgcugugaaggaugagcgcgccguccacgcagacaugggauacuggauagagagccagaaaaacggcuccuggaagcuagaaaaggcgucucugaucgaggugaaaacaugcaccuggcccaagucgcauacucucuggagcaaugguguucuggaauccgauaugauuaucccuaaaucacuugccggcccaauuagucagcacaacuacagaccgggguaucauacccaaacagcuggacccuggcacuugggcaagcuggaguuagacuucaauuacugcgaggggacuaccgugguaaucacagaaaacuguggaacgaggggcccuucucuccguaccacuacagucagcgguaaacugauacacgaguggugcugucgguccugcacccuuccaccccugcgauauaugggggaagauggauguugguacggcauggagauuagaccuaucaaugaaaaggaggagaacauggugaagucauuggugagcgccgguucuggcaaagcagacaauuuuacuauggggguccucugccuggcuauccuauucgaagagguuaugaggggaaaguucggcaaaaagcauaugauugccggggcacuguuuacauucgugcuccugcuuuccggacagaucaccuggcgcgauauggcccacacguugauuaugauaggcaguaacgcuagcgaccggauggguauggggguaacuuaucuggcguuaaucgccaccuuuaaaauucagccauuccucgcacugggauuuuuccuuagaaagcugacaucuagggaaaaucuacuccugggcgugggcuuggcuauggccaccacucugcaauuacccgaggauaucgaacagauggccaacgggauugcucucggacugauggcacuuaagcugaucacacaguuugagaccuaccaguuguggacagcccucgucucccugauguguucaaauacuauaaguacccuaacgguggcguggcgcacagcuacccugauccuugccguuauuagccuccugccggugugccaaucguccucuaugcgaaaaacugacugguugccuaugaccgucgcagccaugggugugccaccccugccuuuauucaucuuuagccucaaggauacacugaaacggcguucauggccccuuaacgagggcguuauggcuguggggcuggucaguauuuuggcauccucuuuccucagaaaugacguaccaauggccggaccucugguggcgggcggucuacugaucgcuuguuauguuauaacugggaccagcgccgaucuuacgguggaaaaggcagccgacgucacaugggaggaagaggcugaacagaccggagugucccauaaccucaugauuacuguagacgaugacggcacaaugaggaucaaagaugacgagaccgagaacauccugacuguguuguuaaagacagcccugcucauugucucaggcauauuucccuacagcaucccagcaacccugcuuguuuggcacacguggcagaaacagacucaacgcaguggggugcugugggaugugccgucuccucccgaaacccagaaggcugaguuggaagagggagucuaccggauuaagcagcaggguaucuucggcaaaacacaaguggggguuggaguacagaaggagggcguguuucauaccauguggcacgucacaagaggugccgugcuaacucacaaugggaaaaggcuggaaccaaacugggcgaauguuaagaaagaccucauuuccuauggaggcggcuggaagcugagcgcccaguggcaaaagggggaggaagugcaggucaucgcaguggagcccggcaagaacccuaagaauuuccagaccaugccagguauauuccagacgacaacuggcgaaaucggggcuauugcccuugauuuuaaacccggaaccucgggcucaccuaucauuaaccgagaggguaagguagucggguuauacggaaauggcgugguuaccaagaacggcggguaugugucuggaaucgcucaaaccaaugcagagccggacgguccaacucccgaacuggaggaagagauguucaagaagcgcaaccucaccauaauggauuugcauccuggcagugggaaaacacggaaguaccugccagccauugucagagaagccaucaaaaggcgucuccgcacgcugauccuugcucccacucgggugguugcggcagagauggaggaagcccugaagggauugccuauuagauaucagaccacagcuaccaaauccgagcacacuggcagggaaaucguggaccuaaugugccaugccacauuuaccaugcgacugcucagcccgguccgggugcccaauuacaacuuaauaguaauggaugaggcacacuucacggacccagccucuauugcugcgcgcgguuauaucagcacuagaguggggaugggagaagccgcagcuauuuuuaugacagccaccccucccggcaccgcagaugccuucccacaguccaaugcuccuauccaggacgaggagagggacauacccgaacggucauggaacaguggcaaugaguggauuacugauuuugccgggaagacaguuugguucgucccaagcaucaaggcgggaaacgacaucgcaaacugucugagaaagaaugguaagaaagugauucaacuuucuagaaagaccuuugauacagaauaccagaaaacuaagcugaacgacugggauuucguggucacgaccgacaucuccgagaugggcgccaauuuuaaggcugaucgcguaauugacccgaggcguugccucaaaccugugauauugacagaugggcccgagcggguuauccuggccggaccaaugcccgugacugucgcuucagcagcccagagaaggggccgcgugggucgaaacccucagaaggaaaaugaccaauacauuuucaccgggcagccacucaacaaugaugaggaccaugcucacuggacagaagccaaaaugcugcuugacaacaucaauacccccgagggcaucauuccugcacuauucgaaccggagagagagaagagugcggccauagauggagaauaucggcugaaaggcgagagcaggaagacuuuuguugaauugaugcgccguggggacuuaccaguguggcuggcucacaaagucgccuccgagggaaucaaguacacggauagaaaguggugcuucgacggugaacggaacaaucagauucucgaggagaacauggauguggaaaucuggaccaaagagggcgaaaagaaaaagcugaggccccgcuggcuugacgcacgaacauauucugauccucuggcucucaaagaguuuaaggacuucgccgcagggagaaagucgauugccuuggaucugguaacugaaaucggacgggugcccagccaucuagcucacaggacccgcaaugcgcuggacaaccucguuaugcuucauacaucagagcacggcgguagagccuacaggcacgcagucgaggaacugccagagaccauggaaacuuuauugcugcucgggcugaugauacuucugacaggcggagcuaugcucuuuuugaucuccggcaaagggauuggaaagacgaguaucggucugauuugugugguggccucuagcggcauguuauggauggccgaugucccucuacaguggaucgcauccgcuauaguucuggaguucuuuaugauggugcuccuuauucccgagccagaaaaacaacggaccccucaggacaaucagcuggccuauguagugaucgggauuuugacucuggcggcuaucgucgccgcaaacgagaugggacuccuggaaacaaccaagcgugaucuuggcaugucaaaagagccgggugugguuucucccaccagcuaccucgacguggaccugcauccagccagugcuuggacauuguaugcagucgccacuacgguaauaaccccuaugcugcgccacacaaucgaaaauuccacugcgaacgugagcuuagcugccauugcaaaccaagccguugugcuaauggggcuggauaagggcuggcccaucucuaagauggaccucggagucccacuucuggcuuugggcugcuacucacaggugaauccucugacccucacagccgcaguccugcuuuuagugacccauuacgcuauuaucgggcccggacugcaggccaaagcgacucgagaggcccagaagagaacggcagcuggcauaaugaaaaacccgacaguugaugguauuaugaccaucgaccucgauccagugaucuaugacuccaaguucgagaaacaauuggggcagguaaugcugcuagugcugugugccguccagcuccuucugaugaggaccaguugggcauuuugcgaagcucuaacucuggccacaggaccuauuacuacccucugggagggcagccccgguaaguucuggaauacaacgaucgccguuucgauggcgaacauauuucggggcucuuaccuggcuggggcaggauuagccuucuccauuaugaaaagcgugggcaccgggaaacgcggaacuggcucacagggugaaacacuuggggagaaguggaaaaagaaacugaaucaacucaguagaaaggaauuugaucuauauaaaaagucuggaaucaccgaggucgacaggacugaggcuaaggaaggccugaaacggggugagauuacacaccaugccgugucccgaggcagcgcaaaguugcagugguucguagaaagaaacauggugaucccagaggggcgcguuauagaucugggauguggcagagggggauggucauacuauugcgccggccucaaaaaggugaccgaaguccgggguuacacgaaagggggacccggccacgaggagccugugccgaugaguaccuauggcuggaauaucgucaaacuuaugagcgggaaggacguguucuaccugcccccagaaaaaugugauacauugcugugcgacauuggagaguccucuccuagccccacuguugaagagucccguaccaucagaguacucaagaugguggagccuugguugaaaaacaaucaguuuuguauuaagguccugaacccauacaugcccacagugaucgaacaccuugagaggcugcagcgcaaacaugguggcaugcuaguucggaauccucucucacgaaacucuacucacgaaauguauuggauuaguaaugggaccggaaacaucgugucgagcgucaauaugguguccagacuguugcugaacagguucacaaugacccaucgccggccaacuauagagaaggauguagaccucggcgcugguacgagacacgugaacgcggaacccgagacaccgaauauggacguuauuggggagcguaucaggcggaucaaggaagaacacucuucaaccuggcauuacgaugacgaaaacccuuauaaaacuugggccuaccacggaagcuaugaggucaaggcaaccggcuccgcuaguucuaugauuaauggcguggugaaacuucugacaaagccaugggaugucguucccauggugacgcaaauggccaugaccgacacuacaccuuuugggcagcagcgcguauucaaagaaaagguggauacccgaacuccaagacccaugccgggaacaaggaaggucauggagauaaccgcagagugguuauggcggacacugggucgcaacaaaagaccuagguugugcacucgagaagaguuuaucaagaaagugcggaccaaugccgcuaugggcgccguuuucacggaagagaaccaaugggacagcgcgcgugcagccguggaagaugaggaguuuuggaagcucgucgacagagaacgcgagcugcauaaacuagggaaguguggaucaugcguguacaauaugaugggcaaaagggaaaagaaacuuggugaguucgggaaagcuaagggaucccgggccauuugguauauguggcugggcgcaagauaccucgaguuugaagcucugggcuucuugaacgaggaucacugguuuagucgcgaaaauagcuacucugggguagagggagaaggucugcauaaacucggcuauauccuuagggacauuuccaagauccccgggggagccauguacgcugaugacaccgccggcugggacacacgaauaacugaggaugaccugcacaacgaggagaaaaucacccagcagauggauccagagcaccggcaguuagcaaaugcgauuuucaagcugacauaucaaaacaagguugugaaaguccagagaccuacucccaaggguaccgugauggacaucauuucaaggaaagaucagcgcgggagcggacaggugggcacguacggcuugaauacauuuaccaacauggaagcccaacucauccgucagauggagggggaaggaguccugucgaaggcugaccuagagaauccacaucuucuggagaaaaagguuacucaguggcucgaaacaaaggguguggagcggcugaaaagaauggccauaucuggcgaugacugcguagugaagcccauugaugacagguucgcaaacgcuuuguuagcccugaacgauauggggaaaguccgcaaggacaucccucaguggcaaccaaguaaaggauggcacgauuggcaacaggugccguucuguucccaucacuuucacgaacucaucaugaaggacggccgaaaacuuguugugcccugccggccucaggacgagcugauugguagagcaaggauaagccaaggggccggauggucacuacgcgaaaccgcgugucugggcaaggcuuaugcccagaugugggcacucauguacuuccauagacgggauuugaggcuggccuccaaugcuaucugcucugccgucccagugcacuggguacccacuagccguaccacauggaguauucaugcacaccaucaguggaugacgaccgaggacaugcuuacuguuuggaaccgaguguggaucgaggauaauccuuggauggaagacaagacaccagucaccacuugggaggaugugcccuaucugggcaaacgcgaagaccaauggugugggucccucauuggauuaacaagcagagcuaccugggcccagaacauccugacggcgauacagcagguucggucuuugaucgguaaugaggaguuucuggauuacaugccuucaaugaagagguuccgcaaagaagaggaaagugagggcgcuauuugguga

SEQ ID NO: 15682 - RNA, 9873 nt, Artificial Sequence
  derived and/or modified CDS sequence (opt3) from DENV-3__AY744685__SS-prME
accagccugugccucaugaugaugcuucccgccacacuggcuuuccacuugacuuccagagacggcgaaccuaggaugaucguggggaagaacgaacggggaaagucuuuacuguuuaagacggccucagguauuaauauguguacccugauagccauggaucucggcgaaaugugcgacgauacagucacuuacaaguguccacugaucaccgaaguugagccggaagacauugauugcugguguaaccuuacaaguaccugggugacuuaugggacaugcaaucaggcgggagagcaccgccgagacaagcguagcguagcucuggcaccccacgugggcauggguuuggauaccaggacgcagacuuggauguccgcagagggggccuggaggcaggucgaaaagguggagaccugggcuuuccggcauccuggauuuacaauccucgcacuguuccuggcccacuacauuggcacuucucucacccagaagguugugaucuuuauauuacugaugcuugucacaccaucgaugaccaugcgcugugugggcguagggaacagagacuucguugaaggauugucaggugcuacguggguggaugucgugcuggagcauggcgggugcgugacuacaauggccaagaauaagcccacccuagacaucgagcuccagaagacugaagcgacacaacuggcaacccuuaggaaacuguguauugagggaaagaucacgaacgucaccacagauagccggugcccuacucagggcgaagccauuuugccagaggaacaggaccagaauuauguuuguaaacacaccuacguggaucgcgguugggggaacggaugcggccucuuuggcaaggggagucugguaacaugcgcuaaguuccaauguuuagaguccaucgagggaaaagccgugcagcacgaaaaucugaaguauacugucauaauuaccgugcauacaggugaccagcaccagguuggcaacgagaugcaaggggugaccgcagaaaucacuccccaggcuucuacggucgaggccauucucccugaauacggaacacuuggccuggagugcagcccacgaaccgguuuggacuuuaaugagaugauccuacugacuaugaaaaacaaggcguggauggugcauagacagugguucuuugaucucccgcugcccuggaccuccggggccacaaccgaaacuccuacauggaauaaaaaggagcuucugguaacguucaaaaacgcacacgcuaagaagcaagaaguuguggucuugggcucacaggagggagccaugcacaccgcucucacuggcgccacagaaauccagaccagugggggaacaagcauuuuugcaggucaucugaaauguagguuaaagauggacaaacuggagcuaaagggcaugucuuaugccaugugccucaaugcuuucgugcugaaaaaggaggucuccgaaacucagcacgggaccauacuuaucaagguggaguacaaaggagaagaugcgccauguaagauucccuucucaacggaggacggccaagguaaagcacauaacgggcgguugaucaccgccaacccuauaguuacaaagaaagaggaaccagugaauauugaggcugaacccccguuuggcgagagcaacaucguaaucggaauuggcgauaaggcccugaagaucaauugguacaaaaaggggaguucuauuggaaaaauguucgaagcaacugcccguggugcucgcagaauggccauacucggcgacaccgcaugggauuuuggguccgucggaggcgugcugaacagccuugguaagaugguucaccagaucuucgggucggcguauacagcucuguuuucuggcguguccuggauuaugaaaaucggaaucggcgucuugcucacuuggauugggcuaaauucaaagaacgccaguaugagcuucuccugcauagugaucggaauuaucaccuuauaccugggcgcaguagugcaggccgacauggguuguguuauuaauuggaaggggaaagagcuaaagugcggaucuggcaucuuugucacgaacgaggugcauacauggaccgaacaguauaaauuccaagcugauagcccuaagaggcucgccacugcaauagcuggugccugggagaauggcgugugugggauccggucaacaacccgaauggaaaaccugcuuuggaaacagauugcgaaugaguugaacuacauccugugggaaaauaacauuaagcucacuaucgucguuggagacgugauaggcgugcuggagcaggggaaacgcaccuuaacaccccagccaauggagcugaaguauaguuggaagacguggggaaaagccaagauuguaaccgcugaaacucaaaauuccagcuuuaucauugauggcccuaacacacccgagugcccaucugcacuuagagccuggaacgucugggaaguggaggacuacgguuucgggguuuuuaccacaaauaucugguugaaacucagggaaaaguauacucagcugugugaccaccggcuaaugucagcugccgugaaagaugagcgcgcaguccacgcggacaugggauacuggauagagagucagaagaacggcagcuggaagcuggaaaaagccucccucaucgaggugaagaccugcacguggcccaaaucucauacacuguggucgaaugguguucuugaaagcgauaugauuaucccuaaguccuuggcuggcccaauuucacagcacaacuacagaccgggguaucauacccaaacugccggacccuggcaccugggcaaauuagagcucgacuucaauuacugcgaggggaccacagugguaaucacugaaaacuguggaauaaggggcccuagucugcguaccacaacggucucugguaaacuuauucacgaguggugcugucggagcugcacccugccacccuugcgauauaugggggaagauggauguugguacggcauggagaucagaccuaucaaugaaaaggaggagaacauggugaaaucccucgugucagcagguagcggcaagacugacaauuuuacaauggggguccugugccuagcuauucuguucgaagagguuaugaggggaaaauucggcaagaaacauaugaucgccggggcacucuuuaccuucgugcugcuuuugucuggacagauuacuuggcgcgauauggcccacacacugauaaugaucggcuccaacgcuagugaccggauggguauggggguaaccuauuuagcgcucauugccacguuuaagauccagccauuccuggcacuuggauuuuuccugagaaagcuaacuagcagggaaaaucuccuguugggcgugggccuggcuauggccaccacauuacaacuccccgaggauauugaacagauggccaacgggaucgcucugggacuuauggcacugaaauugauaacccaguuugagacuuaccagcucuggacagcccugaucucucuaauguguuccaauaccauuuucacacugacugucgcguggcgcaccgcuacgcuuauccucgccgugauuucacuguugccgguuugccaaaguagcucgaugcgaaagacagacuggcugccuaugaccguggcagccaugggugucccacccuuaccucucuuuaucuucucccugaaagauacucuuaagcggcguucuuggccccugaacgagggcgugauggcuguuggguuggugagcauacucgcaucaaguuuucugagaaaugacgucccaauggccggaccucuaguagcgggcggucugcuuauugcuuguuaugugaucaccgggacauccgccgaucucacuguugaaaaagcagccgacgugaccugggaggaagaggcugaacagacgggagucucucauaaccugaugaucacaguggacgaugacggcaccaugaggauuaaggaugacgagacugagaacauauugacaguauuacugaaaaccgcccuccugaucgugagcggcauuuuccccuacuccaucccagcaacucuucuggucuggcacacauggcagaagcagacccaacgcucagggguuuugugggaugugccgagcccucccgaaacgcagaaggcugagcuagaagagggaguguaccggauuaaacagcaggguaucuuuggcaagacucaagucggggugggaguucagaaagagggcguauuccauaccauguggcacgugacaagaggugccguccugacccacaaugggaagaggcucgaaccaaacugggcgaaugugaaaaaggaccugauaaguuauggaggcggcuggaaacuuucugcccaguggcaaaaaggggaggaaguucaggugaucgcagucgagcccggaaagaacccuaaaaauuuccagacaaugccagguauuuuucagacuaccacgggcgaaaucggggcuauugccuuagauuucaagcccggaacauccggcagcccuaucauaaaccgagaggguaaagugguagggcuguacggaaauggcgucgugacuaagaacggcggguauguuucgggaauugcucaaaccaaugcagagccggacgguccaacacccgaacucgaggaagagauguuuaagaaacgcaacuugaccaucauggaucugcauccuggcucagggaagacucggaaauaccucccagccaucgugagagaagccauuaagaggcgucugcgcacccuuauccuggcucccacacgggucguggcggcagagauggaggaagccuugaaaggacuaccuauaagauaucagacgacugcuaccaagucugagcacacaggcagggaaauuguugaccugaugugccaugccaccuucacuaugcgacucuuaaguccggugcggguccccaauuacaaccugaucgugauggaugaggcacacuuuacagacccagccuccauugcugcgcgcgguuauaucagcaccagaguagggaugggagaagccgcagcuauauucaugacggccacuccucccggcacagcagaugccuuuccacagucuaaugcuccuauucaggacgaggagagggacauccccgaacggagcuggaacuccggcaaugaguggaucaccgauuucgccgggaagaccgugugguuuguuccaucaauuaaagcgggaaacgacaucgcaaacugucuucgaaagaaugguaaaaaggucauucaacugaguagaaaaacuuucgauacagaauaccagaagaccaagcucaacgacugggauuuuguggugacaacugacauaagcgagaugggcgccaauuucaaagcugaucgcgucaucgacccgaggcguugcuugaagccuguaauucugacggaugggcccgagcgggugauccucgccggaccaaugcccguuaccguggcuucugcagcccagagaaggggccgcgucggucgaaacucccagaaagaaaaugaccaauacaucuucacagggcagccucugaacaaugaugaggaccaugcucacuggacugaagccaagaugcuucuagacaacauuaauaccccagagggcauaauccccgcacuguuugaaccugagagagagaaaucagcggccauugauggagaauaucgguugaagggcgagaguaggaaaacauucguggaauuaaugcgccguggggaccugccgguuuggcucgcucacaagguggccagcgagggaaucaaguacaccgauagaaaauggugcuuugacggugaacggaacaaucagauucuggaggagaacauggaugucgaaaucuggacuaaggagggcgagaagaagaaacuuaggccacgcuggcuggacgcacgaacguauuccgauccccucgcuuugaaggaguucaaggacuuugccgcagggagaaaaucuauagcccuggaucuagugaccgaaaucggacggguaccuucgcaucuggcucacaggacacgcaaugcgcucgacaaccuugugaugcugcauacuagcgagcacggcgguagagccuacaggcacgcaguugaggaauuacccgagaccauggaaacauugcugcuccuggggcuuaugauucugcucaccggcggagcuauguuguuccugaucucaggcaaggggauuggaaaaacuuccaucgguuuaauaugugucguggccaguucuggcaugcuauggauggccgaugugccacugcaguggauugcaagcgcuaucguccucgaguuuuucaugaugguucuucugauuccugagcccgaaaagcaacggacaccacaggacaaucaguuggccuaugugguaaucgggauacugacgcucgcggcuaucguggccgcaaacgagaugggacugcuugaaaccacuaaacgugaucucggcauguccaaggagccuggugucgugucaccgacaucuuaccuggacguugacuugcaucccgccagcgcuuggacccuguaugcaguggccaccacagucauuacuccaauguuacgccacacgaucgaaaauaguaccgcgaacguaucccuagcugccauugcaaaccaagccgugguucugauggggcucgauaagggcuggccuaucagcaaaauggaccuuggagugccccuguuggcucugggcugcuacucucaggucaauccacucacacugacugccgcagugcuuuuacuggucacccauuacgcuauaauugggccuggacuccaggccaaggcgacacgagaggcccagaaaagaaccgcagcuggcaucaugaagaaccccacuguggaugguaucaugacgauugacuuggauccgguuaucuaugacucaaaauuugagaagcaacugggacaggugaugcuacugguacucugugccgugcagcuucuguugaugaggacauccugggcauucugcgaagcucugacccucgccacuggaccaauaaccacacugugggagggcaguccugguaaguuuuggaauacuaccauugccgucagcauggcgaacaucuuccggggcucguacuuagcuggggcaggacuugccuuuucuauuaugaaauccguuggcacagggaagcgcggaacgggcagccagggugaaacccugggggagaaauggaagaaaaagcucaaucaacuaucaagaaaagaguucgaucuguauaagaagaguggaaucacugagguggacaggacagaggcuaaagaaggcuugaagcggggugagauaacccaccaugccgucucucgaggcuccgcaaaacugcagugguucguggaaagaaacaugguaauccccgaggggcgcgugauugaucucggauguggcagaggcggguggagcuacuauugcgccgggcuuaagaaaguuacugaagugcgggguuacacaaaagggggaccaggccacgaggagcccgucccuaugucaaccuauggcuggaauaucgugaagcugaugagugggaaagacgucuuuuacuugccgcccgaaaagugugauacgcugcucugcgacauuggagagagcuccccaucuccuaccguggaagagagccguacaaucagaguuuuaaaaaugguagagcccuggcugaagaacaaucaguucuguauuaaagugcuuaacccuuacaugccaacugucaucgaacaccuggagaggcuacagcgcaagcaugguggcaugcucgugcggaauccccugucccgaaacucaacccacgaaauguauuggauaucuaaugggacaggaaacauuguuaguucggugaauauggucagcagauugcugcucaacagguuuacuaugacccaucgccggccuacaaucgagaaggauguggaccuuggcgcugguaccagacacguaaacgcggaaccagagacucccaauauggacgugaucggggagcguauuaggcggauaaaagaagaacacuccucuacguggcauuacgaugacgaaaacccguauaagacaugggccuaccacggaucauaugagguuaaagcaaccggcagcgcuuccaguaugaucaauggcgucgugaagcuguuaacuaaaccuugggauguggucccaaugguuacccaaauggccaugacagacacgacccccuucgggcagcagcgcguguuuaaggaaaagguagauacucgaacaccuagaccaaugcccggaaccaggaaagugauggagauuacugcagaguggcuguggcggacauugggucgcaacaagagaccgaggcucugcacccgagaagaguucaucaaaaagguccggacaaaugccgcuaugggcgccguguuuacugaagagaaccaaugggacucugcgcgugcagccguugaagaugaggaguucuggaaacugguggacagagaacgcgagcuacauaaacuugggaaauguggaagcugcgucuacaauaugaugggcaagagggaaaagaaacugggugaguuugggaaggcuaaaggaucacgggccauuugguauauguggcucggcgcaagauaccuggaguucgaggcuuugggcuuucugaacgaggaucacugguucucccgcgaaaauagucauagcgggguggagggagaaggucuccacaaacuuggcuacauccugagggacauaucuaaaaucccugggggagccauguaugcugaugacaccgccggcugggacacgcgaauuaccgaggaugacuuacacaacgaggaaaagaucacacagcagauggaucccgagcaucggcagcuggcaaaugcgauuuuuaaguugacuuaccaaaacaaaguaguuaaggugcagagaccaaccccuaaagguacagucauggacaucauauccaggaaggaucagcgcgggucaggacaggugggcacuuauggccucaauaccuucacgaacauggaagcccaacugauucgucagauggagggggaaggagugcuaagcaaagcugaccuugagaauccccaucugcucgagaagaaggucacacaguggcuggaaaccaaagguguugagcgguugaagagaauggccaucucgggcgaugacugcgugguaaaaccaaucgaugacagguucgcaaacgcuuuacuggcccucaacgauauggggaaggugcgcaaagacauuccccaguggcaaccuucuaagggauggcaugauuggcagcaggucccauuuuguagucaccacuuccaugaacuuauaaugaaggacggccgaaaacuggugguuccgugccggccccaggacgagcuaaucgguagagcaaggauuucccaaggggccggauggagccugcgcgaaacugcgugucucggcaaggcuuacgcccagaugugggcauugauguauuuucacagacgggaucugaggcuugccucaaaugcuaucugcuccgccgugccuguccauugggugccaacaucucguaccacuuggagcauucacgcacaucaccaguggaugaccacagaggacaugcugacgguauggaaccgaguuuggaucgaggauaaucccuggauggaagacaaaaccccugugacuacaugggaggaugucccauaccucggcaagcgcgaagaccaauggugugggaguuuaauaggacugaccuccagagcuacuugggcccagaacaucuugacagcgauucaacaggugcggagccugaucgguaaugaggaguuccucgauuauaugcccucuaugaaaagguuucgcaaggaagaggaaucagagggcgcuauuugguga

SEQ ID NO: 15683 - RNA, 9873 nt, Artificial Sequence
  derived and/or modified CDS sequence (opt3) from DENV-3__AY876494__SS-prME
accagccugugccucaugaugaugcuucccgccacacuggcuuuccacuugacuuccagagacggcgagccuaggaugaucguggcaaagaacgaacgggggaaaucuuuacuguuuaagacggccucaggaauuaauauguguacccuaauagcgauggaucucggugagaugugcgacgauacagucacuuacaaauguccacugaucgcugaaguugagccggaagacauugauugcugguguaaccuuaccaguacaugggugaccuauggcacuugcaaucaggccggggagcaucgccgagacaagcguagcguagcacuggccccccacgugggaaugggcuuggauacaagaacccaaacguggauguccgcugagggugcauggaggccugucgaaaaaguggagacuugggcccuccggcauccaggguucaccauccuggcucuguuucucgcccacuacauuggaacaucuuuaacucagaagguugugaucuucauacugcuuauguuggucacccccucgaugacaaugcgcugugugggcguaggcaacagagacuuuguugaagggcugucaggagcgaccuggguggaugucgugcuagagcaugguggcugcgugacgacuauggcaaagaauaaaccuacacucgacaucgagcugcagaagaccgaagccacucagcuugcuacacugaggaaauuguguauugaggggaagaucaccaacgucacgaccgauagccggugcccaacacaaggagaagccauucuccccgaggaacaggaccagaauuauguuuguaaacacacuuacguggaucgcggcugggguaacgggugcggacuguucggcaagggcaguuuaguaaccugcgcaaaguuucagugucuggagccuaucgaggggaaagugguccaacacgaaaaucucaaguauacagugauaauuacuguucauaccggagaccagcaccagguggguaacgacacacagggcgucaccguggagaucacuccacaagcuuccacggccgaagcgauucuuccggaguacgggacacugguauuggaaugcucuccccgaaccggacuagauuucaaugagaugauccugcucacuaugaaaaacaaggccuggaugguucauagacagugguuuuucgaccugccucuuccauggaccagcggcgcaacaaccgagacucccacauggaauaggaaagaacuguuggugacguuuaagaacgcucacgccaaaaagcaggaggucgugguccucgguucccaagaaggggcuaugcacaccgcccugacuggcgcaacagagauccagaauucaggaggcaccaguauuuucgccgggcauuuaaagugucggcugaaaauggauaagcuagaacucaaaggaaugagcuaugcuaugugccugaacacauuugugcuuaagaaagagguuucugagacucagcacgguaccauauugaucaagguggaauacaagggcgaggacgcgccuuguaaaauuccauucuccacggaagaugggcagggaaaggcacauaacggccgucugaucaccgccaaucccguagucacaaaaaaggaggagccggugaacauagaagcugagccucccuucggugaaucaaauauuguuaucgggaucggcgacaaagcccucaagauuaacugguacaagaaaggaagcaguaucggcaagauguuugaggcaacugcccgcggggcuagaaggauggccauucugggagauaccgcaugggacuucgguucugugggcgggguccuuaauucccugggaaaaauggugcaccaaauauuuggcagcgcguauacagcuuuguucucggguguaucuuggaucaugaagauugggaucggcgugcuccugacuuggaucggauuaaacuccaaaaauaccucaaugaguuuuagcugcauuguuauaggcaucauuacgcuguaccuaggggccgucgugcaggcagauaugggaugugugaucaacuggaagggcaaggaacucaaaugcgguuccgggauuuucgucacaaaugagguucauaccuggacugagcaguauaaguuucaggccgacucuccaaaacggcuggcuacagccaucgcaggagcuugggaaaacggcgugugugguauacgaagcaccacucgcauggagaaucuuuuguggaagcaaaucgccaacgaacugaauuacauucucugggagaacaauaucaaacugaccgugguagucggcgauauuaucgggguguuagaacagggaaagagaacacugacgccucagcccauggagcuuaaauauucauggaagaccuggggcaaggcgaaaauaguuacugccgagacacagaacaguuccuucauuaucgacgggccaaacacccccgaaugcccuagcgcuucuagggcauggaaugugugggaggucgaagacuacggauuuggcguguucacaacuaacauuugguugaagcuccgggagguuuauacccaaucaugugaucaccgccugaugagugccgcuaucaaagacgaaagagccgugcacgcagauauggguuacuggauagagagccagaagaauggguccuggaaacuagagaaggcgucuuuuaucgaaguaaagacgugcacauggccaaaaucgcauacccuguggagcaacggaguccucgaguccgacaugauuaucccgaagucacuggccggccccauuagucagcacaaucauaggccugguuacuauacucagaccgcuggcccauggcaccuugggaaauuggaacuggauuucaacuacugcgagggaacaacuguggugaucaccgagaauuguggcacacgugggcccucuuuacggacgaccacugucagcggaaagcucauacacgaauggugcugucgauccugcacacugccuccacuuagauauaugggcgaggacgguuguugguacgggauggaaauuaggcccaucaacgagaaagaagagaauaugguuaagucacuggugagcgccggaucuggcaagguagauaacuuuaccauggguguguugugccucgcaauccuguucgaggaagucaugcgcggcaaauucgggaagaaacauaugauugcuggagugcuauuuacuuucguucugcuccuguccggccaaaucacauggcgggacauggcccacacccuuauuaugauagggaguaaugcaagcgauagaacgggaaugggcgugacuuauuuggcccugaucgcuaccuuuaagauucagccguucuuagcgcucgguuuuuuccugaggaaacuuacaucucgcgagaaccugcuacucggggucggacuggccauggcaaccacuuugcagcugccugaagacaucgagcaaauggcuaauggcauugccuuaggccucaugacacugaagcuuaucacccaguuugaaacauaccagcuguggacugccuuggugucccucaccuguucaaacacgauauucacacugaccguugcuuggcgaacugcaacccuaauccuggccggggugagucuucucccacugugccagagcucguccaugcggaagacagauugguugcccaugacugucgcggcuaugggaguaccuccccugccauuauuuauuuucucucucaaagacaccccuaagcguagaagcuggccccugaaugagggugugauggccguuggccuugugucaauccuggcaaguuccuugcucaggaacgaugucccaauggccgggccgcugguggcuggaggccuacugauugcauguuauguaaucacggguacaucugccgaccuuaccguggagaaagcggcugacgucacuugggaagaggaagccgagcaaacagggguuagccauaaccucaugauaaccguggaugacgauggaacuaugcgcauuaaggacgaugaaacagagaauaucccuaccgugcuguugaaaacggcauuacugaucgucuccggcauuuuucccuacucaauaccagccacucuccugguguggcacaccuggcagaagcagacacagcggagcggcguucuuugggacguacccaguccuccagagacccaaaaagcugaacuggaggaagggguguacagaaucaagcagcagggaauuuucgguaagacacaggucggcguggggguucaaaaagagggaguguuucauacuauguggcacgucaccaggggcgccguguugacgcacaacgguaagcgacuagagcccaauugggcaucuguaaaaaaggaucugaucuccuaugggggaggcuggcgccucagcgcucaguggcagaaaggcgaagagguccaagugauugccguugaaccugggaagaacccgaagaauuuccagacaaugccaggaaucuuccagacuaccacaggugagauaggcgcgaucgcccuggacuuuaaacccgggaccucgggaucaccuauuaucaaccgggaaggcaagguggucggucuuuacgggaauggagugguuacuaaaaacggcggcuaugugucugggauugcacagaccaaugcugagccagauggacccacaccugaguuagaagaggaaauguucaagaaaagaaaccugacgaucauggaccuccauccggguaguggcaagacuaggaaguacuugcccgccauaguccgugaggcuauuaaacgccggcugagaacccucauccuggcaccaacaagggugguagccgccgaaauggaggaggcucuuaaggggcugccuauccgauaucaaaccacugcgacaaaauccgaacacaccggacgggagauuguggauuugaugugccaugcaacguuuacuaugcgccuacugagccccguuagagucccaaauuacaaccucaucauaauggacgaagcccacuucacagauccugcuucuauugccgcaaggggcuauaucagcacccggguggguaugggggaggccgcugcgauuuuuaugaccgccacucccccaggaacagcagaagcuuucccgcaguccaaugccccuauccaggacgaggagcgagacauacccgaaagaucauggaacaguggcaaugaguggauuaccgauuuugugggcaagacagucugguucguaccaagcaucaaagcagggaacgacaucgccaacuguuuacgcaagaauggaaagaaagugauucagcugucuaggaagacuuuugauacggaauaccaaaaaacccgucuuaacgacugggauuucguugugacaacugacaucuccgagaugggugcuaauuuuaaggccgaucgggucauugaccccagaaggugccugaaaccugugauacucaccgauggcccagagcgcguuaucuuggcggggcccaugccugugacagcagccucagcugcccagcgaagaggacgggucggcaggaacccgcagaaggaaaaugaccaguacauuuucaccggucaaccacugaacaaugaugaggaccaugcucacuggacugaagcaaagaugcuccuggacaacaucaauacgcccgaggggaucauuccugcccuuuucgaacccgagcgcgagaaaagugcugccauagauggcgaauaucgucuaaagggagagagcagaaaaaccuuuguggaacugaugcggaggggcgacuugccaguaugguuagcacacaagguggcguccgaggggaucaaauacacagaucgcaaguggugcuucgacggagaacgaaacaaucagauucuggaggagaacauggauguugaaaucuggacuaaagagggugaaagaaagaagcuccggccuagguggcuggacgcccgcaccuauucugauccccuugcucugaaagaguuuaaggacuucgccgcaggcagaaaaucgauugcucucgauuuggucacagaaaucgggagggugccaagccaucuggcccaccggacccguaaugcacuagacaaccuggugaugcuccauacuucagagcacggaggccgcgccuaccgacacgcugucgaggaacuuccugagacaauggaaacgcuguuauugcugggucucaugauacugcuuaccgggggcgcgaugcuguuucucaucuccggaaagggcauugggaaaacuaguaucggauugauuuguguuaucgugucuagcgguaugcuguggauggccgauguaccguuacaguggauagcauccgcuauugugcuagaguucuuuaugaugguccugcucauccccgagccagaaaagcagagaacaccucaagacaaucagcuugccuaugugguuauuggcauccugaccuuggccgcaauaguggcugccaacgagauggggcugcucgaaaccacaaagagggaucugggaaugucaaaagagcccggcgucguaucuccaacuagcuaccuugacguggaccuccauccugcgagugcuuggacgcuguaugccguugcaaccacagugaucacucccauguugcggcacaccauugaaaauuccacagccaacgucagccuggcugcaaucgccaaccaggcgguggucuuaaugggucuagauaagggguggccgauuucuaaaauggaccugggcgugccacuccuugcucugggaugcuacucacaaguuaauccuuugacccugacugccgcagugcuccugcuuguaacgcauuacgccaucauaggccccggguuacaggcuaaggccacacgcgaggcacagaaaagaaccgcugccggaauuaugaagaacccaacuguggauggcaucaugaccaucgaccuggaucccgucauuuaugacuccaaguucgagaaacagcucggucaaguuauguugcuggugcuaugugcgguccagcugcuccuuaugaggacaaguugggcccugugcgaagcauugacucuggcuaccgggccuaucacaacgcucugggagggaagcccgggcaaguuuuggaauaccacuauagccgugucgauggcaaacauuuuccgggguucuuaccuggcuggcgccggguuagccuuuuccaucaugaaaagcguaggaacaggcaagcgagggaccggaucacagggcgaaacucuuggugagaaauggaagaagaaacugaaucagcucaguagaaaggaauucgaucuauauaaaaagucugggauuacagagguggaccgcaccgaggcgaaagaaggacugaagaggggcgagacgacccaccaugcuguuucccgggguagcgcaaaauugcaaugguuuguggaacguaacauggucauccccgagggcagagugauagaucugggguguggaaggggcggguggucauacuauugcgccggacucaagaaggucacagaagugcgcggcuacacuaaaggugggccaggacacgaggagccuguucccaugaguaccuauggcuggaauaucguaaagcuuaugagcggcaaagacguguucuaccugccuccagaaaagugugauacauugcugugcgacauuggggaguccucucccagcccuacugucgaagagucccggaccauccgagugcucaaaaugguugagccaugguuaaagaacaaucaguucuguauuaaggugcugaaccccuacaugccgacagucaucgaacaccuugagagacugcagaggaaauauggagguaugcuagugcgcaauccucucucacggaacucuacccaugaaauguacuggauuaguaauggcacugggaacaucguaucgagcgugaauaugguuuccagacuguugcugaaccguuuuacgaugacacacaggcggccaaccauagagaaggaugucgaccucggagcuggcacucgccaugugaacgccgaacccgagaccccuaauauggacgugauuggugagcgaaucaaaagaaucaaggaagagcacucuucaacauggcacuaugaugacgaaaacccauacaaaacgugggcauaucaugggagcuacgaggucaaggccaccggauccgcuaguucuaugauuaauggcguugugaagcuucugacuaaacccugggauguagugccgauggucacacagauggcgaugaccgacacuacaccuuucggccaacagaggguguuuaaggaaaaaguugauacccggacaccccgcccaaugccugggacuagaaaggugauggagauaaccgccgagugguuauggaggacgcugggacgaaacaaacggccccguuugugcaccagagaagaguucacaaagaagguccgcacuaaugcagcuaugggugccguguuuaccgaagagaaccagugggacagcgcaagggccgcuguagaagaugaggaguucuggaaucucugggaccgggaaagagagcugcacaaacuaggcaagugugggucaugcguuuauaacaugaugggaaaacgcgaaaagaaacuuggcgaguuugguaaggccaaaggguccagggcgaucugguacauguggcugggagcacgauaccucgaguucgaagcccugggcuuuuugaaugaggaucauugguucagucgggaaaacagcuauucuggcguggagggggaaggacugcacaagcucgguuacauucuuagagacaucuccaagauuccaggcggggcuauguaugccgaugacacagcaggaugggacacuaggaucaccgaggaugaccugcauaaugaggaaaaaauaacgcaacagauggaucccgagcaccgccaguuagcuaacgccaucuuuaagcugacauaccagaauaaagucgugaaggugcaacguccuaccccaaaaggcacugucauggacauuaucucacggaaggaucagagagguagcgggcagguuggaacauauggcuugaacaccuucacuaauauggaagcucagcucgugaggcaaauggagggcgaagggguacugucgaaggccgaccuagagaacccgcaccuucuggagaaaaagauuacccccuggcucgaaccuaaaggaguggagcgccugaagcgaauggcaaucucuggugaugacugcgucgugaaaccaauagaugaccgguuugcgaacgccuuguuagcucugaaugauaugggcaagguuagaaaggacauuccccaguggcagccuaguaaaggguggcaugauuggcagcaagugccauucuguucccaccauuuccacgaacucaucaugaaggacggaaggaaacuugucgugcccugccgcccucaggacgagcugaucggcagagcccggauuagccagggugcaggguggucacuaaaggaaacagcuugucugggaaaagccuacgcacagauguggucccucauguauuuucacaggcgugauuugcgacuggccucuaacgcgauaugcagcgcuguaccgguucauugggugccaacgagucgcaccacuugguccauccacgcccaucaccaauggaugacaaccgaggacaugcuuacugucuggaauagaguguggauugaggauaaccccuggauggaagacaagacaccuguuaccacgugggaggaugugcccuaccugggcaagcgggaagaccagugguguggcagccucaucggguuaacaucuaggucaaccugggcacagaauauucugacugccauccaacagguccgcaguuugauaggagaugaggaguuccuggacuacaugccauccaugaaaagauuucggaaggaagaggaaagcgagggugcuaucugguga

SEQ ID NO: 15684 - RNA, 9873 nt, Artificial Sequence
  derived and/or modified CDS sequence (opt3) from DENV-3__AY923865__SS-prME
accagccugugccucaugaugaugcuucccgccacacuggcuuuccacuugacuuccagagacggcgagccuaggaugaucguggggaagaacgaacggggaaaaucuuuacuguuuaagacggcaucagguauuaauauguguacccuaauagccauggaucucggcgagaugugcgacgauacagucacuuacaaauguccacugaucgcggaaguugagccggaagacauugauugcugguguaaccuuaccaguacaugggugaccuaugggacuugcaaucaggcuggagagcaucgccgagacaagcguagcguagcccuggcaccccacgugggcauggguuuggauacaagaacccaaacguggauguccgccgagggggcuuggaggcaggucgaaaaaguggagacuugggcacuccggcauccuggauucaccauccuggcccuguuucucgcucacuacauuggcacaucuuuaacucagaagguugugaucuucauacugcuuauguuggucaccccaucgaugacaaugcgcugugugggcguagggaacagagacuuuguugaaggacugucaggugccaccuggguggaugucgugcuagagcauggcgggugcgugacgacuauggcgaagaauaaacccacacucgacaucgagcugcagaagaccgaagcaacucaacuugccacacugaggaaauuguguauugagggaaagaucaccaacauuacgaccggcagccggugcccuacacagggugaagcuauccucccagaggaacaggaucagaauuaugucuguaaacacacuuacguugaccgcggguggggaaacggcugcggccuguucgggaagggaaguuuagugaccugcgccaaguuucaaugucuggagcccauagaggguaaaguagugcaguaugaaaaucucaaguacacagucauuaucacugugcacaccggcgaucagccucagguugggaacgacacacaaggagugaccgucgagauuacuccacaggcauccacgguggaagcuguacuucuggaguauggcacauugggucuaaaaugcucuccgcgaaccgggcuggacuucaaugaaaugauccuccugacuaugaagaccaaagccuggaugguucauagacagugguuuuucgaucuuccccugccuuggacaagcggcgcgaccacugagacaccaacguggaacaggaaggaguugcucgugaccuuuaaaaaugcccacgcaaagaagcaagaagucgugguccugggaucccaggagggcgcuaugcauacugccuuaacaggggcuaccgaaauccagaacucaggagguacaaguauuuucgccggccaccugaaaugucggcuaaagauggacaaacucgagcugaaggggaugagcuacgcaaugugccuuaauacuuuuguguugaaaaaggaaguuucugagacccagcacggaacgauacugaucaagguggaguacaaaggcgaagaugcccccuguaagauuccuuucuccaccgaggacggucaagggaaagcucauaacggccgucucaucacagcgaacccaguagucacuaagaaagaagagcccgugaauauagaggcagaaccgccuuucggagagucaaacauuguuaucggcaucggggauaaggcccugaagauuaauugguauaaaaagggaagcaguaucgguaaaauguuugaagcuaccgcccgcggcgcaagaaggauggccauucuuggggacacagcuugggauuucggaucugugggcgguguccugaacuccuuggggaagauggugcaccagauauuuggcagcgccuacacugcacucuucucgggaguaucuuggaucaugaaaauuggcaucggggugcuguuaaccuggaucggacugaauuccaagaacacgucaaugaguuuuagcugcauuguuauaggcaucauuacacuauaucucggugcggucgugcaggcugacauggggugugugaucaauuggaagggaaaagagcugaagugcggcuccgguauuuucgucaccaacgaaguucauacuuggacagagcaguacaaauuucaagccgauucucccaagcggcuugcaaccgccaucgcuggcgccugggagaaugggguguguggaauacgaagcacuacccgcauggaaaacuugcuguggaaacagaucgcaaaugagcucaacuauauucugugggaaaauaacaucaaguuaacagugguagucggcgacauuaucggggugcuggagcagggaaaaagaacgcuuaccccacagccuauggaauugaaguacucauggaagacuuggggcaaagcuaagauaguuacagccgagacccaaaauaguuccuucauuaucgauggucccaacacaccagagugccccagcgcgucuagggccuggaacgugugggaagucgaggacuauggguuuggaguguucacuaccaauauuuggcucaaacugcgggaaguuuacacgcagucaugugaccaccgccuaaugagugcugcaaucaaggaugagagagccgugcaugcugacaugggcuacuggauagaaagccagaaaaacgguuccuggaagcuggagaaggccucuuuuaucgagguaaaaacaugcaccuggccuaagucgcacacucucuggagcaauggcguccuggaauccgauaugauuaucccaaaaucacuugcagggccgauuagucagcacaaccauaggcccggauaucacacccaaacagcgggcccuuggcauuuggggaagcuggaguuagacuucaauuacugcgaaggaacuaccguggugaucacagagaacuguggcacgcgugguccaucucuccggaccacuacagucagcgggaaacugauacacgaguggugcugucgauccugcacccuucccccucugagauauaugggagaagauggcuguugguacgguauggagauuaggccaaucaaugaaaaggaggaaaacaugguuaagucauuggugagcgccggcucugggaaaguagacaauuuuacuaugggagugcucugccuggcuauccuauucgaggaggucaugcgcggcaaguucgggaaaaagcacaugauugccggagugcuguuuacauucguucuccugcuuuccggccagaucaccuggcgggauauggcacauacguugauuaugauagguaguaacgcuagcgacagaauggggaugggagugacuuaucuggccuuaaucgcaaccuuuaaaauucagcccuuccucgcccugggcuuuuuccuuaggaagcugacaucucgcgaaaaucuacuccugggcgucggguuggcuauggcgaccacucugcaauuaccggaggauaucgaacagauggccaacggaauugcacucggucugaugacacuuaagcugaucacccaguuugagacauaccaguuguggacugcucucgugucccugaccuguucaaauacgauauucacacuaaccguugccuggcgaacugccacccugauccuugcuggcgugagucuccugccuuugugccaaagcucguccaugcggaaaacagacuggcugccaaugacugucgcagccauggggguacccccuuuaccccucuuuauuuucucucugaaggauaccccaaaacguagaagcuggccucuuaacgaaggagugauggcgguuggccuggugucaaucuuggcuaguucccuccugaggaaugacguccccauggccgguccacuaguggcagggggacugcuuauugccuguuauguaaucacgggcacaucugcugaucucaccguggagaaggcagccgacgucacuugggaggaagaggcggaacagacaggcguuagccacaaccugaugauaaccguggacgaugacgggacuaugcgcauuaaagaugacgagacagaaaacaucuugaccguguuacugaagacggcucuccugaucgucuccggaauuuuuccguacucaauaccugccacucuucugguguggcauaccuggcagaaacagacacaacggagcgguguuuugugggauguacccaguccacccgagacccagaaggcagagcuagaagagggcguguacagaaucaagcagcaggggauuuucggaaaaacacaagucggcguggguguucagaaggaagggguguuucacacuauguggcaugucaccaggggagccgugcugacgcacaauggcaaacgacucgagccuaacugggcuucuguaaagaaagaccugaucuccuauggcgggggauggcgccuuagcgcccaguggcaaaagggugaggaaguccaggugauugcaguugagccaggcaagaaucccaaaaacuuccagacaaugccugggaucuuccagacuaccacaggagaaauaggcgcuaucgccuuagauuuuaagccggguaccucggggucaccaauuaucaaucgggagggaaaaguggucggccuguacggcaacggggugguuacuaagaauggagguuaugugucuggcauugcgcaaaccaacgccgaacccgacgggccuacaccagagcucgaggaagagauguucaaaaagagaaauuugacgaucauggaucugcaccccggaaguggcaagacuaggaaauaccucccugcaauaguccgugaagcuauuaagcgccggcugagaacccuuauccuggccccgacaagggugguagcugcagagauggaagaggccuugaaaggucuacccauccgauaucagaccacugccacaaaguccgagcauaccgggcgggaaauuguggaccugaugugccacgcuacguuuacuaugcgccucuuaagcccaguuagagucccuaacuacaaucugaucauaauggaugaggcgcauuucacagaccccgcaucuauugccgcuaggggauauaucagcacccgggugggcaugggcgaagccgcagccauuuuuaugaccgcuacuccaccugggacagcggaggccuucccccaguccaacgcaccaauccaggaugaagagcgagacauaccggagagaucauggaauaguggaaacgaauggauuaccgacuuuguggguaaaacagucugguucguaccuagcaucaaggcuggcaaugauaucgccaacugucuucgcaagaacgggaaaaaggugauucaacugucuaggaaaacuuuugacacggaguaccagaagacccgucucaaugauugggacuucuugguuacaacugauaucuccgaaaugggagcaaacuuuaaagccgaccgggugauugaucccagaaggugccugaagccagucauacucaccgacggccccgagcgcgugauccuggcugguccuaugccaguuacagccgcgucagcagcccagcgaagagggcgggugggcaggaauccccagaaggagaacgaucaauacauuuucaccggacagccucuuaauaacgacgaagaucacgcucauuggacugaggccaaaaugcuacuggacaauaucaacacgccggaaggcaucauuccagcuuuguucgagcccgaacgcgagaagagugcagccauagacggggaguaucguuuaaaaggagaaagcagaaagaccuuugucgagcugaugcggaggggugaucucccuguguggcuggcucacaaaguagccuccgaaggcaucaaguacacagaccgcaaauggugcuucgauggggagcgaaauaaccagauucuugaagagaauauggacguggagaucuggacuaaggaaggagagagaaagaaacugcggcccagguggcucgaugcacgcaccuauucugacccauuggcgcugaaggaauuuaaagauuucgccgcuggcagaaagucgauugcccuagaccugguuacagagaucgguagggucccuagccaccucgcacaucggacccguaacgcucuugauaaucuggugauguuacacacuucagaacaugggggccgcgccuaccgacacgcaguggaggaguugcccgaaacaauggagacgcugcuccugcuuggacugaugauacucuugaccggcggggccaugcuguuuuuaaucuccggaaaagguauuggcaagacuaguaucgggcuaauuugugucaucguuucuagcggaaugcuguggauggcugacgugccacuccaguggauagcguccgccauuguacuugaauucuuuaugauggugcuguugaucccugagccggagaagcaaagaacaccccaggauaaccagcuggcauaugucgugauuggcauccucacccuggcugccauaguugccgcaaaugaaaugggucuucucgagaccacaaaaagggaccuggggaugucaaaggaaccaggcguggucucuccuacuagcuacuuggauguagaccugcaccccgcuagugccuggacguuauaugcgguggcuaccacaguuaucacuccaaugcuacggcauaccauugagaacuccacagccaaugugagccuggcagccaucgcuaaccaagcagucgugcucaugggacuugacaaaggcuggccuauuucuaagauggaucuggggguccccuugcuggcccucggaugcuacucacaggugaacccgcugacccuuacugcggcuguuuuacugcucgugacgcacuacgccaucauaggcccagguuugcaggcaaaagccacacgcgaagcucagaagagaaccgccgcagggauuaugaagaauccuacuguagacggaaucaugaccaucgaucuggaccccgugauuuaugauuccaaauucgagaagcaacuaggccaggucaugcugcucguucuuugugcugugcagcuguugcugaugaggacaaguugggcccucugcgaggcgcugacuuuagccaccgguccaaucacaacgcuuugggaaggcagccccgggaaauuuuggaacaccacuauagcagucucgauggcuaauauuuuccggggaucuuaccuggccggcacagggcucgcauuuuccaucaugaagagcgugggaaccggccgaagagguacugggucacagggagagacacuaggcgaaaaauggaagaagaaacugaaccaauugagucgcaaggaguucgaccuguauaaaaagucugguauuaccgaaguagauaggacggaggcuaaagagggccucaagcggggggaaaccacacaucacgccgugucccguggaagcgccaaacuucagugguuuguugagagaaauauggugaucccugaaggcagggucauagaccugggguguggacgcggcgguuggucauacuauugcgcgggguugaagaaggugacugagguccggggauacaccaaaggcggcccggggcaugaagagcccgugccaaugaguacauauggauggaacaucguuaagcugaugagcgguaaagauguauucuaccucccucccgagaagugugacacuuuacugugcgauauuggcgaauccucuccuagcccaaccguggaggaaucccgaacaaucagaguccuuaaaaugguggagcccuggcugaagaauaaccaguucuguauuaagguucuaaauccuuacaugccaaccgugaucgagcaccucgaaaggcugcagcgcaaauaugggggaauguugguccggaacccccugucaagaaauucuacucacgagauguacuggauuaguaacggcacggguaauaucgugucgagcguaaacauggugucccgucuccuucugaauagguuuacaaugacccaucggcgcccgacuauagaaaaggacguugauuuaggggcuggaacccgacacgucaacgcagagccugaaacaccaaacauggacgugauuggcgagagaaucaaaaggaucaaggaggaacauucuucaacguggcacuaugacgaugagaaucccuacaaaaccugggccuaucacggcagcuacgaagugaaggcuacuggguccgccaguucuaugauuaacggagucguuaagcuguugacaaaaccuugggacgugguaccaauggugacccaaauggcaaugacugauacaacccccuucggucagcagcgggucuuuaaggagaaaguggacacacgcacuccgagaccuaugcccggcaccaggaagguuauggaaauaacggccgaguggcucuggcgaacccuggggcggaauaaaaagccacgucuaugcacaagagaggaauucacuaagaaagugcgcaccaacgcugcgaugggagccgucuuuacagaggaaaaucaaugggauagcgcaagggcugccguggaggacgaagaguucuggaagcuuguagaucgggagagagaacugcauaaacucggcaagugugguucaugcguuuauaacaugauggggaaacgcgagaagaaacugggagaauuuggcaaggcaaagggcuccagggccaucugguacaugugguugggggcucgauaccuggaguucgaggcccucggauuucuuaaugaagaccacugguucagucgggagaacagcuauucugguguggaaggcgaggggcugcauaaauuaggauacauucugagagauaucuccaagauuccuggcggugcgauguaugcagacgauacugccgggugggacaccaggaucacggaagacgauuugcacaaugaggagaaaauaacacagcagauggaccccgaacaucgccagcucgcuaacgccaucuuuaagcugaccuaccaaaauaaagucgugaaggugcagcguccaacucccaagggaacagucauggauauuaucucacggaaagaccagagaggcagcggccagguugggaccuauggacuaaacacuuucaccaauauggaggcacaacuugugaggcagauggaaggugagggcguacugucgaaggcugaucucgaaaacccucaccuguuggagaaaaagauuacacagugguuagagacgaaagggguggaacgccugaagcgaauggccaucucuggagacgauugcgucgugaagccaauagacgaucgguuugcuaaugcccuccuugcacugaacgacaugggcaaaguuagaaaggauauuccgcaguggcaacccaguaaagguuggcacgacuggcagcaggugccuuucuguucccaucacuuccaugagcuaaucaugaaggaugggaggaaacuggucgugccaugccgcccccaggacgaacucaucggaagagcgcggauuagccaaggcgccggcuggucauugaaggagaccgcuugucuggggaaggccuacgcacagauguggucccuuauguauuuucacaggcgugaccugcgacucgcuucuaacgccauaugcagcgcaguaccuguucacugggugccaacuagucgcacaaccugguccauccaugcccaccaucaguggaugacuacagaagauauguuaaccgucuggaauagaguguggauugaggacaaccccuggauggaggauaaaacgccuguuacaaccugggaagacgugccguaccugggaaagcgggaggaucaauggugugguagcuugaucggccugacuucuagggcgaccugggcucagaauauucucacagccauccagcagguccgcucacuuauaggggacgaagaguuccuggauuacaugccaaguaugaaaagauuucggaaggaggaagaguccgaaggagcaaucugguga

SEQ ID NO: 15685 - RNA, 9867 nt, Artificial Sequence
  derived and/or modified CDS sequence (opt3) from DENV-4__KR922405__SS-prME
agcacaaucacacugcucugccuuauucccacugugauggccuuccaccuguccacgagagacggagagccuuugaugauagucgcuaagcaugaaagagggcggccauuacuguuuaaaaccacagagggaaucaacaaguguacuuugauugcaauggaucucggugaaaugugcgaggacaccguuacauacaaauguccgcugcuugugaauaccgaacccgaggauaucgacugcugguguaaccugacuucugccuggguaauguauggaacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauaugguggaccggggcuggggcaacgggugcggacuguucgguaaaggcggggucguuacgugcgccaaguuuucuuguuugggaaaaauuaccggcaaucucgugcaaaucgagaaccuggaauauacaguaguggucacugugcauaauggugauacccacgcaguugggaacgacacaagcaaucacggcgugacugcuaccauuacaccucguuccccaucagucgaggugaaguuaccggauuacggagaacugacccucgacugcgagccccgcaguggcaucgacuucaacgagaugauccuuaugaagaugaaaacuaagacguggcugguacauaaacagugguuuuuggaucuaccucugccauggacaaccggggccgacacucucgaaguucacuggaaucauaaggagagaauggugaccuucaaagucccccacgcgaagaggcaggaugugacaguccugggaagccaggaaggugccaugcacucugcacuugcuggcgccaccgagguggacuccggggauggaaaccauauguuugcuggccaccugaaauguaagguucggauggaaaaguugcgaauuaaagguaugucauacacuaugugcagcgggaaguucaguauagacaaagagauggccgagacacaacauggcacgaccgugguaaaggucaaauaugaaggaacuggcgcaccuuguaaggugccaaucgagauucgcgauguuaauaaggaaaaaguggucgggagaaucauaucuuccacacccuucgccgagaacaccaacagcgugacaaauauugagcucgaaccgccuuuuggagacucguacaucguaaucggugugggcgauucugcucugacuuuacacugguucaggaagggguccucaauuggaaaaauguuugagaguaccuaucggggcgcgaagcgcauggcaauccugggugaaacggccugggacuucgggagcguuggcggacuacucaccucccugggcaaagcuguccaucagguguuugggucuguguacacaacuauguucggaggcgucagcuggaugguuaggauucuuauagguuugcuggugcucuggaucgggaccaacucaaggaauacaaguauggccauguccugcauugcagugggaggcaucacucuguuucuugguuucaccguacacgccgauaugggcugugucgugagcuggucugggaaggagcugaagugcggaucaggcaucuuuguuauugacaacgugcacacguggacagaacaguauaaauuccaacccgagaguccagcucguuuggccagcgcaauacucaaugcgcauaaggagggggucuguggaauccgguccaccacucgacuggaaaacgugauguggaaacagauuacaaaugaguuaaacuacguucugugggaaggcggucacgaccuaaccgugguagcuggggaugucaagggagugcucucuaaaggcaagagagcccuggcaccucccgugaaugaccuuaaguauucguggaaaacuugggguaaggccaaaaucuuuaccccagagacaaggaacagcacguucuuggucgauggccccgacaccuccgaaugcccuaaugagcgccgggcuuggaacuuucuggagguugaagauuacggguucggaauguucacuacaaauauuuggaugaaguuuagagagggcucaagugaagugugugaccauaggcucaugucugccgcaaucaaagaucagaaggcuguacacgccgacaugggguacuggauagagagcuccaaaaaccagaccuggcaaaucgaaaaggcgucacugauugaggugaagacaugcuuauggccaaaaacucacacccuguggagcaauggaguccuugagucucagauguugaucccgaaggccuaugcuggccccauuucccagcauaacuaccgccaggguuaugcaacgcaaacagccgggccuuggcaccucggaaaacuggaaaucgauuucggcgagugcccagguaccacugugaccauacaggaagacugugaucaucgaggccccagucuacggacaacuaccgcuagcgggaagcugguuacacaguggugcugucguucuugcacgaugccuccacucagauuucugggagaggacggcuguugguacgggauggagauuaggccccuuaacgaaaaagaggaaaauauggugaagucccaggucucagccggacaaggcaccagugagacuuucagcauggguuugcugugcuuaacacucuuuguggaagagugucugcgccggagaguuaccaggaagcacaugauccuuguggucguaacuacacugugcgcaauuauccuaggcgggcucaccuggauggaucugcuacgagcgcugauaaugcucggggacacgaugucgggccgcaugggagggcagauccaucuggccauuauggcuguguucaaaauguccccggguuauguucuuggcaucuuuuugcggaagcugacuucuagagagaccgccuuaauggugauugggauggcaaugacaaccguccucagcaucccucacgaccugauggaguucauagauggaauuucacuuggccugauccuacucaaaauggugacucacuuugacaacacacagguagguacccuggcuuuggcccugacauucaucaagaguacuaugccauuagugauggcauggaggaccauuauggccguccucuuuguugugacgcugaucccccuuugucguacauccugccugcagaaacaaucucauuggguggagauuaccgcuuugauacucggggcgcaggcccugccugucuaccuaaugacucugaugaagggagcaagcaagcgcuccuggccccuuaaugaaggcaucauggcugugggccucguuucacuguuggggagcgcccugcuaaagaacgauguaccacucgccggaccuaugguggcugguggccugcuucuggcagccuaugucaugagugggucuuccgcggacuugagccucgagaaggcugccaaugugcagugggaugaaauggcagacauuaccggaucgucacccaucauugagguuaaacaagaugaggacggcucuuucaguauccgggauguggaagagacaaacaugauaacucugcuagucaagcuggcccuuaucaccguguccggucucuacccacuggcuauuccgguaacgaugacauugugguacauguggcaggucaaaacccagagaagcggggcauuaugggacgugccuucucccgccgcggcucagaaggccacucugacagaaggaguuuauaggaucaugcaacgaggccucuuuggcaagacccaggugggggucggcauucacacugaggguguguuccauacaauguggcacguuacccggggcagcgugaucugucaugaauccgggcgccuggagccaucaugggcagaugucagaaaugacaugauaaguuacggaggcgguuggaggcuuggggauaaaugggacaaggaggaagacgugcagguacuggccauugagcccggcaaaaacccuaagcacgugcagacgaaaccaggcuuguucaagacucuaaccggcgaaaucggggcuguuacacuggauuuuaaacccggaaccagcgguucuccuaucauuaaucggaagggcaaggucauagggcucuauggaaacggcguggugacaaaauccggugacuacgucucagccaucacucaagcagagcgaauuggggagccggauuaugaaguagacgaggauaucuucagaaagaaacgccugaccauuauggaccuucacccaggagcuggcaagacgaaaaggaucuuacccaguauagugcgugaagcccugaagcggagacucaggacauugauccuggcgccuacucgcguuguggccgcagagauggaagaggcucuccgaggccugccaauuagauaccagacccccgccgucaagagcgagcauacagggcgggaaaucguggaucuuaugugccacgcuaccuuuacuaccaggcuguuguccucuacacgcguuccuaauuauaaccuaauugugauggacgaggcacauuucacggauccgucgagcgucgccgcccguggauacaucucaacuagaguggaaaugggugaggcugcggcaauauuuaugaccgccacacccccaggcaccacugacccuuucccccaguccaauaguccaauugaagauaucgagcgggagaucccugaaaggucuuggaacacaggguuugacuggauuaccgacuaccagggaaaaacgguaugguucgugcccagcaucaaggcuggcaaugauauagccaacugccugcgcaaauccgguaagaaaguuauucaacucucacgaaagacuuuugacacagaguauccaaagaccaaauuaaccgauugggacuucgucgugacuacagauaucucugaaaugggggcaaacuuuagagccggccgggugauugacccgaggcgcugucugaagccugucauccuuaccgauggacccgagagaguuauacuggcuggcccaauucccgugaccccugcgagcgccgcacagaggcgggggcguaucggacgcaauccagcucaggaagacgaucaauacguauucaguggugacccccuccgaaacgaugaggaccacgcccacuggacugaggcaaaaauguugcuggauaauaucuauacgccugaaggcauuaucccgacccucuucgggccagagagagaaaagacacaggccauugacggagaguuuaggcugcggggcgagcagcgcaaaacuuucguggaacuuaugagaaggggugaccuacccgucuggcuguccuacaagguggcuagcgccgggauaucuuauaaggaucgggaguggugcuuuaccggcgaacgaaacaaucagaucuuggaggaaaacauggagguugagauuuggacaagagaaggagagaaaaagaaauuacgcccuaaguggcuggacgcgaggguguacgcagaucccauggcccucaaagacuucaaggaauuugcuucaggccggaaguccaucacccuggauauccuuacugagauugccagucugccaauguaucucagcucgcgugcuaaauuggcacuggacaauauagucaugcuacauacgaccgaaagagggggaaaggccuaccaacacgcucugaacgagcucccugagucucuugaaacacugauguuaguagccuugcugggugcaaugacugcgggcaucuuccucuuuuucaugcaggggaaaggaauuggcaagcuguccaugggucuuaucgccauugcuguggccagcgggcugcucuggguugcagagauccagccccaguggauagcugccucaaucauuuuggaauuuuuccugauggugcuauuagucccagagccugaaaaacaaaggaccccgcaggauaaucagcugaucuacgugauucucacaauccuuaccauaauugcacuggucgccgcuaacgagaugggcuugaucgagaagacuaaaacagacuuuggauucuaucaggugaaggcggaaacgaccauucuggauguugaccuccgccccgccagugcauggacucuguacgcuguggccacaaccauccuuaccccaaugcuccggcauacaauagagaauacuucugccaaccuguccuuggcagcuaucgccaaucaagcggcuguacugaugggcuuagggaagggauggccucuacaccgaauggaucugggcgugccccuccuugccauggguuguuauagccaggucaacccaacgacccugacagcaucauugguuaugcugcucgugcauuacgccauuaucgggccuggacugcaggcuaaagcaacuagagaagcccagaagaggaccgcggcuggcauuaugaaaaaucccacagucgacgguaucaccgugauagaucuugagccgauuaguuaugacccaaaguuugagaaacaauuaggccagguaaugcugcucguguugugcgccgggcagcugcuacugaugcgcacuacgugggcauucugugaaguucucacacuugccaccggaccuauccugacuuugugggagggcaaccccgggcgguucuggaacaccacaaucgcugugagcacugccaauauuuuuagaggauccuaccuggcaggcgcuggucucgccuucucucugaucaagaacgcgcaaaccccacguagggggacaggaacgaccggcgaaacuuuaggugagaaguggaaacggcagcuuaauagccuggaccgcaaggaauuugaggaguauaaacgauccggcauacucgaagucgauagaacagaggccaagucagcacuaaaagacgggucuaagauuaaguucgcugugaguaggggaaccucgaaaauccgguggauugucgaacgcggcauggugaagcccaaagggaagguuguagaucugggaugcggcagagguggguggagcuacuacauggccacuuugaaaaacgugacagaggucaagggauauaccaagggcggcccugggcacgaagaaccggugcccauggcaacguacggauggaaucugguuaaacuccacuccgguguggacgucuuuuauaagccaaccgaacagguggauacacuucugugugacaucggcgaaucuucaagcaacccuacuauagaggaagggaggaccuugcgaguacugaaaaugguggagcccuggcucuccaguaagccugaguucugcaucaaaguuuuaaauccauacaugcccacagucauugaggagcuggaaaaacuucagcggcgucauggaggcucucuggugagauguccucuaagccgcaacucaacucacgagauguauuggguguccggugucagugggaauaucguuagcucugugaacaccacauccaaaaugcuccugaauagguuuaccacucggcauagaaagccaacguacgaaaaggaugcugacuugggagccggcacacgcucaguaagcaccgagacugagaaacccgauaugaccauuaucggcaggcgacugcaacggcuccaggaagaacacaaggaaacauggcacuaugaccaugagaacccguacagaacgugggccuaccacgggucguaugaagcgccuucuaccggaagugcuuccagcauggugaauggugucgugaaacuucugacuaagccaugggauguugugcccauggucacacaguuagcaaugaccgacacuacaccuuucggccagcaaaggguguuuaaagagaagguagacacccgcacaccacagcccaagccggggacucguguuauuaugaccacgaccgccaacuggcuguggacauugcucggacggaaaaagaauccuagacugugcacuagggaggaguucaucucaaaagugcgcuccaacgcugccauaggcgcagucuuucaggaggaacaggguuggaccucugccagcgaggcugugaaugauagucgauucugggaguuaguggacaaggagcgggcgcuucaucaagaggggaaaugugaauccugcgucuacaacaugaugggaaagagagagaagaaacugggcgaauuuggcagggccaaggggagccgcgcaauuugguauauguggcucggagcuagauuccuggaguucgaagccuuggguuuucugaacgaggaucacugguucggccgggaaaauucuuggucagggguugaaggagagggccuccauaggcuugguuacauccuggaagacaucgauaaaaaggacggggauuuaauuuaugcagacgauacagccggaugggacacucguauaaccgaggaugaccuguugaacgaggaacucaucacggagcagauggcuccccaccacaaaauucuggccaaggcgaucuuuaagcuaacauaccagaauaaagugguaaaggugcuucgaccaaccccuaaaggcgcagucauggauauuaucagucgcaaggaccaaagaggcuccggacaggugggaacuuauggucugaacacauucaccaauauggaaguucagcucauacggcagauggaggccgaaggcgugaucacucaagacgauaugcauaaccccaaagggcugaaggagagggucgagaaaugguugaaggaaugcggaguggaccgcuuaaagagaauggcuauuagcggcgaugacuguguaguuaaaccacuggaugagcgguuuucuaccucgcuccuuuuccugaaugacauggguaaggugaggaaagauaucccccagugggaaccuucaaagggguggaaaaacuggcaggaggucccauuuugcagccaccauuuccacaagauuuuuaugaaggacggacgaucccuagugguuccgugucguaaucaggaugaacugaucggcagagcccgcauaagucaaggcgcaggguggucucuccgggagacagcuugcuugggaaaagccuacgcucagauguggagccugauguacuuccacaggagagaccuucgccuggccuccauggcaauuuguucagcggugcccacggagugguuuccuaccagucggacuacauggucuauccaugcccaccaucaguggaugaccacugaagauaugcucaaggucuggaacaggguguggaucgaggacaauccaaacaugauugacaaaacacccguacacagcugggaagauauaccuuauuuagguaagcgagaggaccuguggugcggcuccuugaucgggcugucaagcagagcuaccugggccaaaaauauucauacggcaaucacacaggugcggaaccucauuggaaaggaagaguacgucgauuauaugccagcuaugaggcgcuacucugcccacuucgaguccgaaggcguucuuuga

SEQ ID NO: 15686 - RNA, 9867 nt, Artificial Sequence
  derived and/or modified CDS sequence (opt3) from DENV-4__KP188557__SS-prME
agcaccaucacucugcucugccuuauucccacugugauggcauuccaccuguccacgcgagacggcgaaccuuugaugauagucgcuaagcaugaaagagggcggccauuacuguuuaaaaccacagaaggaaucaacaaguguacucugauugcaauggaucucggugaaaugugcgaagacaccguuacauacaaauguccgcugcuugugaauaccgaacccgaggauaucgacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcucgcauauucaccccagaagcccggaacaauacuuuucugaucgauggccccgacacaucggagugcccuaacgaaagaagggcauggaauagcuucgagguggaggauuacggguucggaauguuuaccacaaacauuuggaugaaauuccgcgaaggcuccucagagguaugugaccaucgacuuaugagugcugccaucaaggaucagaaagcggugcacgccgacaugggguauuggauugaaucuagcaagaaucaaacuuggcagaucgagcgggcuuccuugauagaagucaaaaccugccuguggccaaagacgcauacacucuggucaaacggagugcuggagagccagauguuaaucccgaagucuuacgcaggccccuuuucccagcacaacuaucgucaagguuacgccacccagacuguugggccuuggcaccugggaaaacuugagauugauuucggcgaaugcccagguaccacagugacuauccaggagaauugugaccauagaggccccaguuugaggaccacaacggcuagcgggaagcucgucacccaguggugcugucgcucuugcacuaugccuccacugcgguuucuaggagaagauggcuguugguaugggauggagauuagaccccuguccgagaaagaagagaacauggugaagucacaaguuacagccggacagggcaccagugaaacuuucagcaugggucuccugugccuuacauuguuuguggaggaaugucugaggcgacgcgucacccggaaacacaugaucuuagcaguagugauaacgcucugcgcgauuauccuagggggacuuacuuggauggaccuguugagagcccucauuaugcugggcgauaccaugucgggcaggaucgggggacagacacaucuagcuauaauggccguuuucaagauguccccggguuacgugcugggcgucuuucuccguaagcugaccucucgcgagacugcacuuauggugaucgggauggcuaugacaaccacauugagcauuccucacgaccugauggaguuaaucgacggaauuucacucggccugauccuucugaaaauaguaacucaguucgauaauacccaaguggguacgcuagcccucagucugacauuuauucgguccaccaugucuuuggucauggcauggagaacuaucauggccguucuguucguggugaccuuaaucccacucuguaggacaagcugccugcagaagcagucccauugggucgaaauuacugcucuuauccugggggcgcaagccuugcccguguaucucaugacccugaugaaaggagcaucacgacggagcuggccucuaaacgagggcauuauggcuguuggccugguaagucuucucgggucugcccuguugaagaaugacgugccccuggccggaccaauggucgcugguggcuuacuccuggcagccuacgugauguccgggagcucggcggaucuuucacuggaaaaagcugccaacguucgcugggacgagauggcagauauaacgggaucuaguccuaucauugaagugaagcaggacgaggauggcuccuuuagcaucagagacgucgaggaaacaaauaugauuaccuugcucgugaagcuggcccuaaucacuguaucuggucuguacccccuugcuauaccaaucacaaugacccucugguauauguggcaggucaaaacucagaggagcggggcacugugggaugugccguccccugccgcgacacaaaaggcugccuugucagagggaguuuaccggauuaugcagcgaggcuuauucggcaaaacccaggugggggucggaauccacauggaagguguguuccacacgauguggcauguuacuagaggcagugugauuugucacgagaccgggcgccuggaacccagcugggcagacgucaggaacgauaugaucucuuauggaggcgguuggcgucucggggacaagugggauaaagaggaggacgugcagguacuggccauagaaccaggaaagaaucccaagcaugugcaaacaaaaccuggccuuuuuaagacccugacaggcgagauuggggcuguuacuuuggacuucaaaccaggaaccuccgguucacccaucaucaaccggaagggcaaagucauugggcuauacggaaauggcguggugacgaagaguggugauuaugucagcgccauaacacaggcagaaagaaucggggagccugacuacgagguagaugaagacauuuuuaggaaaaagcgccugacuaucauggaucuccacccgggagcuggcaagaccaaacggauucugccauccaucgugagagaggcccuuaagagaagguuacgcacacugauacucgcgcccacccguguuguggccgcagaaauggaggaggcuuugagaggccugccuauccgguaucagacuccagccgucaaaucugagcauaccgggagggagauuguggaccucaugugccacgcuacauucacgacucgccugcuuucgagcacccgaguucccaacuacaaucugaucgugauggaugaagcacacuuuacagacccuucauccgucgccgccagaggauacauuaguacccggguggagaugggugaagcugcggcaaucuucaugacugccacaccgcccggcgcuaccgauccauuuccucagucuaacagccccauagaggacauugaaagggagaucccagagcgcuccuggaauacgggguucgauuggaucacugacuaucaaggaaagacaguaugguuugugccuucaauuaaagccggcaacgacaucgcaaacugcuugagaaagucugguaagaaaguuauacagcuaagcaggaagaccuucgauaccgaauaccccaaaacuaagcugacagacugggauuuugucgugaccacagacauuagugagaugggggccaauuuccgggcuggccgugugaucgauccacgccgaugucucaaaccggucauuuuaacugacgcgccugaaagaguuauccuggccggacccauaccagugacgcccgcauccgcugcccagaggcggggccgcauugggagaaacccugcacaagaggaugaccaguauguauucagcggagauccacuuaagaaugacgaagaucaugcccacuggaccgaggcuaagaugcugcucgacaacaucuacacacccgaggguaucauuccuacuuuguuuggcccggaaagggagaaaacccaggccaucgauggggaguuccggcugcgaggagagcagagaaagacauuuguggagcucaugcgcaggggcgaccugccagucuggcuuucuuauaaaguggcgucagcagguauuuccuacaaggaccgggaauggugcuucaccggggagcguaauaaccaaauacuagaagagaauauggaaguugagaucuggacuagagagggcgagaaaaagaagcugaggcccaaaugguuggaugcccgcguguaugcugacccuauggccuuaaaggauuuuaaagaguucgcuaguggaagaaagagcauuacgcuggacauccucaccgaaaucgcaucgcugcccacauaccuuucuucccgagccaaacuggcucucgauaacauugucauguugcauacuaccgagagaggcgggagggccuaccagcacgcacugaaugaacuaccagagagccuggagacacucaugcuuguagcgcuguuaggagccaugaccgcugguauauuuuuguucuuuaugcagggcaaggggaucggaaagcugucaaugggccucauuacuaucgccguggcaaguggucugcuuuggguugcugaaauucagccucaauggaucgccgcaucuauaauccuggaguucuuucucaugguguugcugauucccgaaccagagaaacagcgcacaccucaggacaaccaguuaaucuaugucauucuaacgauccugaccauaauugggcucaucgccgcuaaugaaaugggccuuauugagaagacuaaaacagauuucggauuuuaccaagugaagaccgagaccacaauccuggacgucgauuugcggccggcguccgccuggacucuguaugcaguggcuacgaccauacucacacccaugcugagacacacuaucgaaaacaccagcgccaaucuuucacucgccgcaauugcuaaccaggccgcgguucugaugggcuuggggaaaggauggccacugcaucguauggacuuaggcgugccucuacuggcuauggguuguuacagucagguaaaucccacaacccucacugccagccuugugaugcuguugguccacuaugcaaucauugggccaggacugcaggccaaggcuacgagggaggcacaaaaacggacagccgcgggcaucaugaagaacccuaccguugaugguauaacugugauugaccucgaacccaucuccuacgauccgaaguucgagaaacagcugggccaggucaugcuuuuagugcugugcgcugggcaacucuugcugaugcgcaccacaugggccuucugugagguacuaacucuggcaaccggaccaauccucacacuuugggaaggcaacccugggcgauuuuggaauacgaccauugccgugucuacugcuaacaucuucagaggaagcuaucuggccggcgcagguuuggcuuuuucccugauaaagaaugcccagacacccaggcgggggaccggaacugcgggcgagacacucggugaaaaauggaagcgccagcugaacucauuagacagaaaagaguucgaagaguacaagaggucuggcauucuugagguugaccgaaccgaagccaagagugcacugaaagaugggucgaagaucaaacaugcugugagccggggauccucuaagauucguuggaucgucgagagaggcauggugaaaccaaaggggaaggucguggaccucggaugcggccgcgguggguggucauacuauauggccacgcucaaaaauguuaccgaaguaaagggauacacaaaaggcggccccgggcacgaggaaccuauaccgauggcaacuuauggauggaaccuggugaaguugcauagcggugucgauguguuuuacaaacccaccgagcagguugacacacugcucugugauaucggcgaguccaguucuaauccaacuauugaagaggggaggacccuucgggugcugaagauggucgaaccuugguugagcucaaagcccgaguucugcaucaaagugcugaacccuuauaugccaacaguaauugaagaacuagagaaguuacaaagaaaacacggaggcaaucuggugcgcuguccccuuuccaggaacaguacccacgaaauguacuggguuagcggugcuucugggaauaucgucuccucagugaacacuacgagcaagaugcugcuaaaucgauuuacaacccggcauagaaaaccuacuuaugagaaggacguggaucucggagccggcaccaggucggucucuacagaaacggagaaaccagacaugaccauuaucggccgccgucugcagcgguugcaggaggaacacaaggagacuuggcauuacgaucaggaaaaccccuacagaacaugggccuaucacgggaguuacgaggcgccguccaccggaagcgcuucauccaugguuaauggugugguaaagcugcucacuaaaccuugggacgugauaccaauggucacacaacuugcaaugaccgauacaacucccuucggccagcagaggguguuuaaggaaaaaguugacacccgcacgccucagccaaagcccgggacccgaauggugaugacaacuaccgccaacuggcugugggcuuuacugggcaaaaagaagaauccgcgguugugcacaagagaggaguucauuucuaaagucaggagcaacgccgcaaucggcgccguguuucaagaagaacaggguuggacaagugcuuccgaagcgguaaacgacagccgcuucugggagcucguugauaaggaaagagcccugcaccaggaggggaaaugugagucuugcguguauaauaugaugggaaagcgggagaaaaagcuaggcgaguuuggcagggcaaaggggucacgugcuaucugguacauguggcuuggagcccgauuccuggaguucgaggcacucgguuuucugaacgaagaccauugguucggccgcgagaauaguugguccggggucgagggagaaggcuugcacagacuggguuauauucucgaggaaauagauaaaaaggacggggaucuuauguacgccgacgauaccgcuggaugggacacgcggaucacagaggaugaccugcaaaacgaggaauuaauuaccgagcagauggccccucaucacaaaauccuggcgaaggcaauuuuuaaauugacuuaucagaauaagguggugaagguccucaggcccacaccacgcggcgccguuauggauaucauaagcagaaaagaccagcggggcucugggcaagugggaaccuacggucugaacacuuucaccaauauggaaguacagcuaaucaggcagauggaggcugaaggcgugauuacacaggaugacaugcaaaacccuaaggggcuuaaagagcgagucgagaaguggcugcgugaaugcggaguggacagacucaaacgcauggccaucucgggcgaugacuguguugugaagccccuggaugagcgguuugguacgucauuguuauuccugaaugacauggggaaagucaggaaggauauuccacagugggaacccagcaagggauggaaaaacuggcaggaggugccuuuuugcucccaucacuuccacaagaucuuuaugaaagacggcagaagucucguaguuccaugucgcaaucaggaugaacuuauaggccgggcaaggauuucucaaggggcuggauggagccugcgagagaccgccugccuagguaaggcuuacgcccagauguggucccugauguauuuccauagacgggaccucagguuggcaucaauggcgaucuguagugccgugccgacugagugguuucccacaucucgcaccacuuggagcauccacgcucaucaccaguggaugacaaccgaagauaugcugaaagucuggaaccguguguggauugaggacaauccuaacaugauagauaagacgccaguucacuccugggaagacauccccuaccuuggcaagagagaggaccuguggugcgggucacucauuggauuaagcucucgagccacaugggccaaaaauauccauaccgcuauuacucaggugaggaaccugaucggcaaggaagaguaugucgauuacaugccugugaugaaacgguauuccgccccaagugagagcgaagguguauuguga

SEQ ID NO: 15687 - RNA, 9867 nt, Artificial Sequence
  derived and/or modified CDS sequence (opt3) from DENV-4__KP188558__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcaugauggugacacucacgccgucgggaaugauaccagcaaccacggcgugacagcaaccauuacuccucguuccccaucaguagagguuaaguuaccggacuacggagaacugacgcucgacugcgagccccgcaguggcaucgauuucaaugagaugauucuuaugaagaugaaaaagaaaacauggcuggugcauaagcagugguuuuuggaccuaccucugccauggaccacuggggcugauaccagcgaaguccacuggaacuacaaagagagaauggugacauucaaggucccccaugccaaaaggcaggacgugaccguucucggaucucaggaaggugcgaugcacuccgcccuggcaggcgcuacugagguggauucaggggacggaaaucacauguuugccggccaucuuaaguguaagguacggauggaaaaacugcgaaucaaggguaugagcuauacaaugugcagugggaaauucucuaucgauaaggagauggcugagacgcaacacggcaccacugucgugaaaguuaaguacgaaggagccggcgcaccuuguaaggugccaauugagauacgcgacgucaacaaagaaaaggugguagggagagugaucuccgccacacccuuggcugagaauaccaacagcguuacaaacauugagcucgaaccgccuuucggagauucguauaucgucauaggugugggcaauucugcgcugacuuuacauugguuuaggaaaggguccucaauuggaaagauguucgagaguaccuaccggggcgcaaaacgcauggccauccugggugaaacggcuugggacuuugggagcgugggcggacuauucaccucccucggcaaggccguccaccagguuuuugggucuguguauacaacuauguucggaggcgugagcuggaugaucagaauucugaucgguuuucuuguauuguggauugggaccaacucaaggaauacaaguauggcaaugacuugcauagccgucggaggcaucacccuguuccucgguuuuacggugcaggcugauaugggcuguguuguguccuggagcgggcgugagcugaagugcggaucuggcauuuucgucguggacaacguucauacauggaccgaacaauacaaauuucagcccgagucaccagcccggcuugcaagugcgauccugaaugcucacaaggacgggguguguggaauccgaagcacuacaagauuggagaacguaauguggaaacagauuaccaaugaacucaacuauguccugugggagggcggucacgauuuaacugugguggccggggacgucaagggaguucugaccaaaggcaagagggcacuaacaccucccgccuccgaucucaaguacucuuggaaaacgugggguaaggcuaaaauauucaccccagaagcccgcaauucgacuuuucugaucgacggccccgauacaagcgagugcccuaacgaacggagagcauggaauuccuucgagguggaggacuacggguucggaauguuuaccacaaacauuuggaugaaguucagggaaggcucaagugagguaugugaucaucgccuuaugucugcugccaucaaagaccagaaggcggugcacgccgauaugggguauuggauugaaagcuccaaaaaucaaacuuggcagaucgagcgagcuucauugauagaagucaagaccugccuguggccaaagacgcauacacucuggagcaacggagugcuggagucucagauguuaaucccgaaauccuacgcaggccccuuuagucagcacaauuaucggcaagguuacgccacccagacuguugggccuuggcaccugggaaagcuugagauugacuucggcgaaugcccagguaccacagugacuauccaggagaacugugaucaucguggccccagcuugagaaccacaacggcuucugggaaacucgucacccaguggugcuguagguccugcacuaugccuccacugcgcuuucuaggagaagacggcuguugguaugggauggagauucggccccugucagagaaggaagagaacauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaucuguugcgggcccucauuaugcugggcgacaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgauggaauuagucucggccugauccuucugaagauaguaacucaguucgacaauacccaaguggguacgcuagcccucucccugacauuuauucgcucuaccaucagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaacgagggcauaauggcuguuggccugguaucucuucucggguccgcccuguugaaaaaugaugugccccuggccggaccaauggucgcugguggcuuacuccuggcagccuacgugaugagcgggucgucagcggaccuuucucuggaaaaggcugccaacguucagugggaugagauggcagacaucacgggaaguuccccuauuaucgaagugaagcaggaugaggacggcagcuuuucuauucgggaugucgaggaaacaaauaugaucaccuugcucgugaaacuggcccuaauaacuguaagcggucuguacccccuugcuaucccaauuacaaugacccucugguauauguggcaggucaagacucaacgcuccggggcacugugggacgugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagaugucagaaacgacaugauauccuauggaggcgguuggcgccucggggauaaaugggacaaggaggaggacgugcaaguacuggccauugaaccaggaaagaaucccaaacaugugcagacaaagccuggccuuuuuaaaacccugacaggcgagaucggggcuguuacuuuggauuucaagccaggaaccucagguagucccaucauuaacaggaaaggcaaggucauagggcuauacggaaauggcguggugacgaaaagcggugacuaugucuccgccaucacacaggcagaacguauuggggagccugauuacgagguagacgaagauaucuuucggaagaagagacugacuauuauggaccuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaucucaugugccacgcuacauucacgacucggcugcuuagcucaaccaggguucccaacuacaaucugauugugauggacgaagcacacuuuacagauccuuccagugucgccgcccgcggauacaucucuacccgaguggagaugggugaagcugcggcaauauucaugacugccacaccgcccggcgcuaccgacccauuuccucaaagcaacucccccauugaggauaucgaaagagagaucccagagcggucauggaauacgggguucgacuggauuacugacuaucagggaaaaacaguaugguuugugccuucuaucaaggccggcaacgauauagcaaauugcuugaggaagagcgguaaaaagguuauucagcuaagucgcaaaaccuucgacaccgaauaccccaagacuaaacugacagauugggacuuugucgugaccacagauaucuccgagaugggggccaacuucagagcuggcagggugauugacccacggcguugucucaagccggucaucuuaacugauggaccugaacgcguuauacuggcgggccccauuccagugacgcccgccagcgcagcucaacgaagagggaggaucggacggaacccugcccaggaggacgaucaguauguauucucuggugacccacuuaagaaugaugaagaccaugcacacuggaccgaggccaaaaugcugcucgauaacaucuacacacccgagggcauuaucccuacuuuguuugggccggaacgcgagaagacccaggcuauugacggagaauucagacugaggggcgagcaacggaaaacauuuguggagcucaugcgaagaggugaccugccagucuggcuuucauauaagguggccuccgcggggauaaguuacaaagaucgcgaauggugcuucaccggcgagaggaauaaccagauccuagaagagaauauggaaguugagauuuggacucgggagggagaaaagaagaaacugcgucccaagugguuggacgcaagaguguaugccgauccuauggcuuuaaaagacuuuaaggaguucgccagcggcaggaaaucgaucacgcuggauauccucaccgaaauugcuucucugcccacauaccuuuccagccgcgcaaagcuggcccucgacaacauagucauguugcauacuaccgagcgggggggacgagcuuaccagcacgcccugaaugaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggauaaccaauuaauuuaugucauccuaacgauacugaccauuaucggccucauugcagccaaugaaaugggacuuaucgagaaaacuaagacagacuucggcuuuuaccaggugaaaaccgagaccacaauacuggaugucgacuugaggccggcuagcgcguggacucuguaugccguggcaacgaccauccucacacccaugcugcgccacacuauugaaaacaccucagcuaaucuuagucucgccgccaucgcaaaccaggcugccguucugaugggguugggaaagggcuggccacugcaucggauggauuuaggugugccucuacuggcgaugggguguuacagccagguaaaucccacaacccucacugcuucccuugugaugcuguugguccacuaugccauuaucggaccaggccugcaagcaaaagccacgagagaggcucagaagcguacagcagccgguauaaugaagaacccuaccguugacggcauuacugugaucgaucucgaacccaucucuuacgacccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaauccuggacgguuuuggaacacgaccaucgcagugagcacugccaacauauuccgcggcuccuaucuggcuggugccggguuggcauuuucacugauuaaaaaugcucagacaccccgaagaggaaccggcacugccggugagacacucggcgaaaaguggaaaaggcagcugaacucuuuagaccggaaggaguucgaagaguacaagcgcagugggauccuugagguugauagaaccgaagcgaaaucggcccugaaggacggaagcaaaauuaagcaugcaguguccaggggcucuucaaaaauccgauggauagucgagcgggggauggugaagccaaagggaaaagucguggaucucggcugcggucgugggggauggagcuacuauauggcuacgcuaaagaauguuaccgaaguaaaaggcuacacaaagggcgggcccggacacgaggaaccuaucccgauggccacuuaugguuggaaccuggugaaauugcauuccggcgucgacguguuuuacaagcccaccgagcaaguugauacacugcucugugacauuggggagaguucuagcaauccaacuaucgaagagggaagaacccuucgcgugcugaagauggucgaaccuugguugucauccaaacccgaguucugcauuaaggugcugaacccuuauaugccaacaguaaucgaagagcucgagaaauuacagaggaagcacggcgguaaucuggugcgguguccccuuaguagaaacagcacccacgaaauguacuggguuucuggggcauccggaaauauugucucaagcgugaacacuacgucgaaaaugcugcuaaaucgcuuuacaaccaggcaucgaaagccuacuuaugagaaagauguggaccucggcgcuggcacccggucugucaguacagaaacggagaagccagauaugaccaucauagggagaaggcugcagcgcuugcaggaggaacacaaggagacuuggcauuacgaccaagaaaaccccuaccguacaugggccuaucacggauccuacgaggccccgagcaccgguucagcguccucuaugguuaauggcgugguaaaacugcucacuaagccuugggaugugauuccaauggucacacagcuugcuaugaccgacacaacucccuucgggcagcagcggguguuuaaagaaaagguugacaccagaacgccucaaccaaaacccggaaccaggauggugaugacaacuaccgcaaacuggcugugggccuuacugggcaagaagaaaaauccgcgcuugugcacacgagaggaguucaucagcaagguccggaguaacgcugccaucggugcaguguuucaggaagagcagggguggacuuccgccagcgaagcuguaaaugauucuagauucugggagcucguugacaaagaaagggcgcugcaccaagagggaaagugugagucaugcguguauaacaugaugggcaaacgcgaaaagaagcuaggcgaguuugggagagccaaaggaagucgggcaauuugguacauguggcuuggugcuagguuccuggaauucgaggcccucggcuuucugaacgaagaucauugguucgggcgugagaauuccuggagcggagucgagggcgaagguuugcaccgacugggguauauacucgaggaaaucgacaagaaagauggagaccuuauguacgcagaugacaccgccggcugggauacgcgcauuacagaggacgaucugcagaacgaggaauuaaucaccgagcagauggcuccucaucacaagauucuggccaaagcgaucuuuaaguugacuuaucagaauaagguggugaaaguccucagacccacaccacggggcgcaguuauggacauaaucucuaggaaggaucaacgcgggucgggacagguggguaccuacggccugaacacuuucaccaauauggaaguacagcuaauuagacagauggaggccgaaggggugaucacacaagacgacaugcagaacccuaaaggacuuaaggagcgggucgagaaauggcugagggaaugcggcguggaucgacucaagcguauggcuauuucaggugacgauuguguugugaaaccccuggacgagagauuugggacgagcuuguuauuccugaaugauaugggaaagguccgcaaggacaucccacagugggaacccuccaaaggcuggaagaacuggcaggaggugccuuuuugcagucaucacuuccacaaaauauuuaugaaggauggccggucucucguaguuccauguaggaaucaagacgaacuuauugggagagcccgcaucagccagggagcagguuggucccugcgggagaccgcuugccuaggcaaagccuacgcucagauguggucacugauguauuuccauaggcgagaucucagauuggccaguauggcaaucuguucugcggugccgacugagugguuucccacaagccggaccacuugguccauucacgcccaucaccaguggaugacaaccgaagacaugcugaaggucuggaacaggguguggauagaggauaauccuaacaugaucgacaagacgccaguucacucaugggaagacauucccuaccuugggaaacgcgaggaucuguggugcggaagccucaucggcuuaucuucccgugcuacaugggccaagaauauucauaccgcaaucacucaagugagaaaccugauagguaaagaagaguaugucgacuacaugccugugaugaagcgauauagugcuccaagcgagucggaagggguauuguga

SEQ ID NO: 15688 - RNA, 9867 nt, Artificial Sequence
  derived and/or modified CDS sequence (opt3) from DENV-4__KP188563__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaaucgccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauagggaggaggacgugcaaguacuggccauugaaccaggaaagaaccccaagcaugugcagacaaaaccuggccuuuuuaagacccugacaggcgagaucggggcuguuacuuuggacuucaaaccaggaaccucagguagucccaucauuaaucguaagggcaaagucauagggcuauacggaaacggcguggugacgaagagcggugauuaugucuccgccaucacacaggcagaacggauuggggagccugacuacgagguagaugaagacaucuuuagaaaaaagaggcugacuauuauggaucuccacccgggagcuggcaagaccaaacgcauccugccaucuauagugcgagaggcccuuaagagacgguuaaggacacugauccucgcgcccacccgcguuguggccgcagaaauggaggaagcuuugcguggccugccuauuagauaucagacuccagccgucaaaucggagcauaccgggcgggagaucguggaccucaugugccacgcuacauucacgacuaggcugcuuagcucaacccgcguucccaauuacaaccugauugugauggaugaagcacacuuuacagacccuuccagugucgccgcccgaggauacaucucuaccagaguggagaugggugaagcugcggcaauauucaugacugccacaccgcccggcgcuaccgauccauuuccucaaagcaauucccccauugaggacaucgaacgggagaucccagagaggucauggaacacgggguucgauuggauuacugacuaucagggaaagacaguaugguuugugccuucuaucaaagccggcaaugacauagcaaacugcuugcgcaagagcgguaagaaaguuauucagcuaaguagaaagaccuucgauaccgaauaccccaaaacuaagcugacagacugggauuuugucgugaccacagacaucuccgagaugggggccaacuucagggcuggccgggugauugauccacgucgcugucucaaaccggucaucuuaacugacggaccugaacgaguuauacuggcgggccccauuccagugacgcccgccagcgcagcucaaagaagggggcggaucggacgcaauccugcccaggaggaugaccaguauguauucucuggugauccacuuaagaacgacgaagaucaugcacacuggaccgaggccaagaugcugcucgacaauaucuacacacccgagggcauuaucccuacuuuguuugggccggaaagagagaaaacccaggcuauugauggagaauucaggcugcggggcgagcaacgaaagacauuuguggagcucaugagacgcggugaccugccagucuggcuuucauauaaaguggccuccgcggggauaaguuacaaggacagggaauggugcuucaccggcgagcggaacaaucagauccuagaagagaacauggaaguugagauuuggacucgugagggagaaaaaaagaagcugagacccaaaugguuggaugcaaggguguaugccgacccuauggcuuuaaaggauuuuaaagaguucgccagcggccgcaagucgaucacgcuggacauccucaccgaaauugcuucucugcccacauaccuuuccagccgggcaaaacuggcccucgauaauauagucauguugcauacuaccgagcgagggggaagagcuuaccagcacgcccugaacgaacuaccagagucacuggagacacucaugcuuguagcacuguuaggugcgaugaccgccggcaucuuuuuguucuuuaugcaggggaagggaauuggcaagcugaguaugggucucaucacuauugcuguggccucugggcugcuuuggguugcagaaauccaaccucaguggauagcugccuccaucauucuggaguucuuucucaugguguugcugauccccgaaccagagaaacagaggacaccucaggacaaucaauuaauuuaugucauccuaacgauacugaccauuaucggccucauugcagccaacgaaaugggacuuaucgagaagacuaaaacagauuucggcuuuuaccaggugaagaccgagaccacaauacuggacgucgauuugcgcccggcuagcgcguggacucuguaugccguggcaacgaccauccucacacccaugcugcggcacacuauugaaaauaccucagcuaaccuuagucucgccgccaucgcaaaucaggcugccguucugaugggguugggaaaaggcuggccacugcauagaauggacuuaggugugccucuacuggcgaugggguguuacagccagguaaaccccacaacccucacugcuucccuugugaugcuguugguccacuaugccauuaucggaccaggccugcaagcaaaggccacgcgugaggcucagaaaaggacagcagccgguauaaugaagaauccuaccguugauggcauuacugugaucgaccucgaacccaucucuuacgauccgaaguucgagaaacagcuggggcaagucaugcuuuuagugcugugcgcgggacagcucuugcugaugcggaccacaugggcuuucugugagguacuaacucuggccaccggcccaauucucacacuuugggaagggaacccuggacgcuuuuggaacacgaccaucgcagugagcacugccaauauauuccgaggcuccuaucuggcuggugccggguuggcauuuucacugauuaagaacgcucagacacccagaaggggaaccggcacugccggugagacacucggcgaaaaauggaagcggcagcugaauucuuuagaccgcaaagaguucgaagaguacaagagaagugggauccuugagguugacaggaccgaagcgaagucggcccugaaagauggaagcaagauuaaacaugcagugucccgaggcucuucaaagauccgguggauagucgagcgugggauggugaaaccaaagggaaaggucguggaccucggcugcgguagagggggauggagcuacuauauggcuacgcuaaaaaacguuaccgaaguaaagggcuacacaaaaggcgggcccggacacgaggaaccuaucccgauggccacuuaugguuggaaucuggugaaguugcauuccggcgucgauguguuuuacaaacccaccgagcaaguugacacacugcucugugauauuggggagaguucuagcaacccaacuaucgaagagggacgcacccuuagggugcugaagauggucgaaccuugguugucauccaagcccgaguucugcauuaaagugcugaauccuuauaugccaacaguaaucgaagagcucgagaaguuacagcggaaacacggcgguaaccuggugagauguccccuuagucgcaauagcacccacgaaauguacuggguuucuggggcauccggaaacauugucucaagcgugaauacuacgucgaagaugcugcuaaacagguuuacaacccgacaucggaaaccuacuuaugagaaggacguggaucucggcgcuggcaccagaucugucaguacagaaaucgagaaaccagacaugacgauaauugggaggcgccugcagcguuugcaggaggaacacaaggagaccuggcauuacgaucaagaaaaucccuaccggacuugggccuaucacggauccuacgaggccccgagcacagguucagcguccucuaugguuaacggcgugguaaagcugcucaccaaaccuugggacgugaucccaauggucacucagcuugcuaugacagauaccacacccuucgggcagcagagaguguuuaaggaaaaaguugacacuaggaccccucaaccaaagcccggaacgcgcauggugaugaccacaacugcaaauuggcugugggccuuacugggcaaaaagaagaacccgcgauugugcacccgggaggaguucaucagcaaagucagaaguaaugcugccauuggugcaguguuucaggaagagcagggguggacauccgccagcgaagcuguaaacgacucuagguucugggagcucguugauaaggaacgcgcgcugcaccaagagggaaaaugugagucaugcguguauaacaugaugggcaagagagaaaaaaagcuaggcgaguuugggcgggccaagggaaguagggcaauaugguacauguggcuuggugcucguuuccuggaauucgaggcccucggcuuucugaaugaagaccauugguucgggcgagagaacuccuggagcggagucgagggcgaagguuugcaccgccugggguauauccucgaggaaauugauaaaaaggacggagaucuuauguacgcagacgauacugccggcugggacaccagaaucacggaggaugaccugcagaaugaggaauuaauuacagagcagauggcuccucaucacaaaauccuggccaaggcgauauuuaaauugaccuaucagaacaagguggugaagguccuccggcccacuccaaggggcgcaguuauggauaucauuucucgcaaagaccaaagagggucgggacagguggguacauacggccugaauaccuucacuaacauggaaguacagcuaauccggcagauggaggccgaaggggugauuacccaagaugacaugcagaauccuaagggacuuaaagagagggucgagaaguggcugcgagaaugcggcguggaccgucucaaaagaauggcuaucucaggugaugacuguguugugaagccccuggaugagcgcuuugggacaagcuuguuauuccugaacgacaugggaaaaguccggaaggauauaccacagugggaacccuccaagggcuggaaaaauuggcaggaggugccuuuuugcagucaucacuuccacaagauuuuuaugaaagacggcaggucucucguaguuccauguagaaaccaagaugaacuuaucgggcgcgcccggaucagccagggagcagguuggucccugagggagacggcuugccuaggcaaggccuacgcucagauguggucacugauguauuuccaucgaagagaccuccgguuggccaguauggcaauuuguucugcggugccgaccgagugguuucccacuagcaggacaaccugguccauacacgcccaucaccaguggaugacuacagaagauaugcugaaagucuggaaucgcguguggaucgaggacaacccuaauaugauugauaagaccccaguucacucaugggaagacauccccuaccuugggaagcgugaggaccuguggugcggaagccucauuggcuuaucuuccagagcuacgugggccaaaaacauccauacagcaauaacccaagugcgaaaucugaucgguaaggaagaguaugucgauuacaugagugugaugaaaagguauagcgcuccuucggaguccgaagggguauuguga

SEQ ID NO: 15689 - RNA, 9867 nt, Artificial Sequence
  derived and/or modified CDS sequence (opt3) from DENV-4__KP188564__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccaucgcucaggggaagccuacgcuggauuuugaacuaacuaagacaaccgccaaagagguggcgcuccugcgcacuuacuguauugaagcacuuaucaguaauauuacaaccgccacgcgaugcccaacccaaggagagcccuaucugaaggaggaacaggaccagcaguacaucuguagaagggaugucguugaccggggcuggggcaacgggugcggauuguucgguaaaggcggggugguaacaugcgcuaaguuuuccuguucuggaaaaauaacuggcaaucucgugcaaauugagaaccuggaauauaccgucgugguuacagugcauaauggugauacucacgccgucgggaacgacaccagcaaucacggcgugacagcaaccaucacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuauugacaaggagauggcugagacgcaacacggcaccacugucgugaaaauaaaguacgaaggagccggcgcaccuuguaagguuccaaucgagauucgcgaugugaauaaagaaaaggucguggggagaguaaucuccgccacacccuuggcugagaacaccaacagcgugacaaauauagagcucgaaccgccuuucggagacucguauauuguuaucggugucggcaacucugcgcugacuuuacauugguuuaggaaaggguccucaaucggaaagauguucgagaguaccuaccggggcgcaaaacgcauggccauucugggugaaacggcuugggauuuugggagcgugggcggacuauucaccucccucggcaaggccgugcaccaggucuuugggucuguuuauacaacuauguucggaggcgugagcuggaugaucagaauucugauagguuuucuuguguuguggaucgggaccaauucaaggaacacaaguauggcaaugacuugcauugccguaggaggcaucacccuguuccucgguuuuacgguccaggcugacaugggcugugugguuuccuggagcgggcgugagcugaagugcggaucuggcaucuucguggucgauaaugugcauacauggaccgaacaauacaaauuucagcccgagucaccagcccggcuugcaagugcgauucugaacgcucacaaggacgggguuuguggaauacgaagcacuacaagauuggagaaugugauguggaaacagaucaccaacgaacucaauuauguacugugggagggcggucacgacuuaacugucguggccggggaugugaagggaguccugaccaaaggcaagagggcacuaacaccucccgccuccgaccucaaguacucuuggaaaacgugggguaaggcuaaaauuuucaccccagaagcccgcaacucgacuuuucugaucgauggccccgacacaagcgagugcccuaaugaacggagagcauggaacuccuucgagguugaggauuacggguucggaauguuuaccacaaauauuuggaugaaguucagggaaggcucaagugaggugugugaccaucgccuuaugucugcugccaucaaagaucagaaggcgguacacgccgacaugggguauuggauagaaagcuccaaaaaccaaacuuggcagaucgagcgagcuucauugauugaagugaagaccugccuguggccaaagacgcauacacucuggagcaauggaguccuggagucucagauguuaaucccgaaauccuacgcaggccccuuuagucagcacaacuaucggcaagguuacgccacccagacuguggggccuuggcaccugggaaagcuugagauugauuucggcgaaugcccagguaccacaguuacuauccaggagaacugugaccaucguggccccagcuugagaaccacaacggcuucugggaaacucgugacccaguggugcuguagguccugcacuaugccuccacugcgcuuucuaggagaagauggcuguugguaugggauggagauacggccccugucagagaaggaagagaauauggucaaaagucaagugacagccggacagggcaccagcgaaacuuucucgaugggucuccugugccuuacauuguuuguugaggaaugucugagaaggcgagugacccgcaagcacaugauuuuagcagucguaaucacgcucugcgcgauuauccuggggggacuuacuuggauggaccuguugcgggcccucauaaugcugggcgauaccauguccggcagaaucgggggacagacacaucuagcuauuauggccguguucaagaugucuccggguuacguucugggcguguuucucaggaaacugaccagccgugagacugcacuuauggucaucgggauggcuaugacaaccacauugucaauuccucacgaccugauggaguuaaucgacggaauaagucucggccugauucuucugaagaucgugacucaguucgauaacacccaaguagguacgcuagcccucucccugacauuuauccgcucuaccaugagcuuggugauggcauggcggacuauuauggccguccuguucguugugaccuuaaucccacucuguagaacauccugccugcagaaacagucacauuggguggaaauuacugcucuuauacugggggcgcaagccuugcccgucuaucucaugacccugaugaagggagcaagcaggcgaaguuggccucuaaaugagggcaucauggcugugggccugguuucucuucucggguccgcccuguugaaaaacgacguaccccuggccggaccaaugguggcugguggcuuacuccuggcagccuacgucaugagcgggucgucagcggaucuuucucuggaaaaggcugccaaugugcagugggacgagauggcagauauuacgggaaguuccccuaucauugaaguuaagcaggacgaggauggcagcuuuucuauccgggacguggaggaaacaaacaugauaaccuugcucgucaaacuggcccuaaucacugugagcggucuguacccccuugcuauuccaaucacaaugacccucugguauauguggcagguaaagacucaacgcuccggggcacugugggaugucccgucaccugccgcgacacagaaagcugccuugagugagggaguguacagaauuaugcagaggggcuuauucggcaagacccagguuggggugggaauccacauggaaggugucuuccacacgauguggcaugugacucggggcagcguuauaugucacgagaccgggcgacuggaacccucuugggcagacgugagaaaugauaugauuuccuauggaggcgguuggcgccucggggacaaaugggauaaggaggaggacguccaagugcuggccaucgaaccaggaaagaaccccaaacauguacagacaaagccuggccuuuuuaaaacccugacaggcgagaucggggcugugacuuuggacuucaagccaggaaccucagguagucccauuauaaauaggaaaggcaagguuaucgggcuauacggaaacggcgucgugacgaaaagcggugauuauguguccgccauuacacaggcagaacguaucggggagccugacuacgaggucgaugaagacauuuuucggaagaagagacugacuaucauggaucuccacccgggagcuggcaaaaccaagaggauacugccaucuaucguacgcgaggcccuuaaacgaagauuacggacacugauucucgcgcccaccagggugguugccgcagaaauggaggaagcuuugcgcggccugccuauccguuaucagacuccagccgugaagucggagcauaccgggagagagauugucgaccucaugugccacgcuacauucacgacucggcugcuuagcucaaccagggugcccaauuacaaccugaucguuauggaugaagcacacuuuacagacccuuccaguguggccgcccgcggauacauaucuacccgagucgagaugggugaagcugcggcaauuuucaugacugccacaccgcccggcgcuaccgauccauuuccucaaagcaauucccccaucgaggacaucgaaagagagauuccagagcggucauggaacacgggguucgauuggaucacugacuaucagggaaaaacagugugguuuguaccuucuauaaaggccggcaaugacauugcaaacugcuugaggaagagcgguaaaaaggugauccagcuaagucgcaaaaccuucgauaccgaauaccccaagacuaaacugacagacugggauuuuguugucaccacagacauuuccgagaugggggccaacuucagagcuggcagggugaucgauccacggcguugucucaagccggugauauuaacugacggaccugaacgcgucauucuggcgggccccaucccaguuacgcccgccagcgcagcucaacgaagagggaggaucggacggaauccugcccaggaggaugaccaguauguguucucuggugauccacuuaagaacgacgaagaucaugcacacuggaccgaggccaaaaugcugcucgacaauauuuacacacccgagggcaucauuccuacuuuguuugggccggaacgcgagaagacccaggcuauagauggagaauucagacugaggggcgagcaacggaaaacauuuguagagcucaugcgaagaggugaccugccaguguggcuuucauauaaggucgccuccgcggggaucaguuacaaagaccgcgaauggugcuucaccggcgagaggaacaaucagauucuagaagagaacauggaaguggagaucuggacucgggagggagaaaagaagaaacugcgucccaagugguuggaugcaagaguuuaugccgacccuauggcuuuaaaagauuuuaaggaguucgccagcggcaggaaaucgaucacgcuggacauucucaccgaaauagcuucucugcccacauaccuuuccagccgcgcaaagcuggcccucgauaauaucgugauguugcauacuaccgagcgggggggacgagcuuaccagcacgcccugaacgaacuaccagagucacuggagacacucaugcuugucgcacuguuaggugcgaugaccgccggcauuuuuuuguucuuuaugcaggggaagggaaucggcaaacugaguaugggucucauuacuaucgcuguagccucugggcugcuuuggguggcagaaauacaaccucaguggaucgcugccuccauuauccuggaguucuuucucaugguuuugcugauucccgaaccagagaagcagagaacaccucaggacaaucaauuaaucuaugugauacuaacgauucugaccaucauuggccucaucgcagccaacgaaaugggacuuauagagaaaacuaagacagauuucggcuuuuaccaggucaaaaccgagaccacaauccuggacguggauuugaggccggcuagcgcguggacucuguaugccgucgcaacgaccauucucacacccaugcugcgccacacuaucgaaaauaccucagcuaaccuuagucucgccgccauugcaaaucaggcugccgugcugaugggguugggaaagggcuggccacugcaucggauggacuuagguguuccucuacuggcgaugggguguuacagccaggugaaccccacaacccucacugcuucccuuguaaugcuguuggugcacuaugccaucauaggaccaggccugcaagcaaaagccacgagagaggcucagaagcguacagcagccgguauuaugaagaauccuaccgucgauggcaucacuguuaucgaccucgaacccauuucuuacgauccgaaauucgagaagcagcuggggcaagugaugcuuuuaguccugugcgcgggacagcucuugcugaugaggaccacaugggcuuucugugaggugcuaacucuggccaccggcccaacacucacgcuuugggaagggaacccuggacgguuuuggaacaccacuaucgcaguaagcacagccaauauauuccgcggcuccuaucuggcuggugccggguuggcauuuucacugauuaaaaacgcucagaccccccgaagaggaacuggcacagccggugagacccucggcgaaaaguggaaaaggcagcugaauucuuuagaccggaaggaguucgaagaguacaagcgcagugggauccuugagguggacagaacggaagcgaaaucggcccugaaggauggaagcaaaauuaagcaugcaguuuccaggggcucuucaaaaauccgauggauaguggagcgggggauggucaagccaaagggaaaaguggucgaccucggcugcggucgugggggauggagcuacuauauggcuacccuaaagaacgugacagaaguuaaaggcuacacuaagggcgggcccggacacgaggaaccuaucccgauggccaccuaugguuggaaucugguaaaauugcauuccggcguggaugucuuuuacaagcccacagagcaaguggacacucugcucugugauauuggggagaguucuagcaacccaaccaucgaagagggaagaacacuucgcguucugaagaugguggaaccuugguugucauccaaacccgaguucugcauuaagguccugaauccuuauaugccaaccgugaucgaagagcucgagaaauuacagaggaagcacggcgguaaccugguacgguguccccuuaguagaaauagcacucacgaaauguacugggugucuggggcauccggaaacauuguuucaagcgucaauacgacaucgaaaaugcugcuaaaccgcuuuaccacuaggcaucgaaagccuaccuaugagaaagacguggaucucggcgcuggcacacggucugugaguacggaaaccgagaagccagacaugacuaucauagggagaaggcugcagcgcuugcaggaggaacacaaggagacauggcauuacgaucaagaaaaucccuaccguaccugggccuaucacggauccuacgaggccccgagcacugguucagcguccucuauggucaacggcguugugaaacugcucacaaagccuugggacguaauuccaauggugacccagcuugcuaugacagauacuacccccuucgggcagcagcgggucuuuaaagaaaagguggacacgagaaccccucaaccaaaacccggaacaaggaugguuaugacuaccacagcaaauuggcugugggccuuacugggcaagaagaaaaacccgcgcuugugcacucgagaggaguucaucagcaaggugcggaguaaugcugccaucggugcagucuuucaggaagagcagggguggaccuccgccaacgaagcugugaacgacagcagauucugggagcucguagauaaagaaagggcgcugcaccaagagggaaagugugagucuugcguuuauaauaugaugggcaaacgcgaaaagaagcuaggcgaguuugggagagccaaaggaucacgggcaauuugguacauguggcuuggugcuagguuccuggaauucgaggcccucggcuuucugaacgaagaccauugguucgggcgugagaauaguugguccggaguggagggcgaagguuugcaccgacugggguauauacucgaggaaaucgauaagaaagacggagaucuuauguacgcagacgauacggccggcugggacacacgcauuaccgaggaugaccugcagaacgaggaauuaaucacugagcagauggcuccucaucacaagauucuggccaaagcgaucuuuaaguugacauaucagaauaaggucgugaaagugcucagacccaccccacggggcgcagucauggauauaaucagcaggaaggaccaacgcgggucuggacagguugguacuuacggccugaacaccuucacaaauauggaagugcagcuaauuagacagauggaggccgaagggguaaucacgcaagaugacaugcagaacccuaaaggacuuaaggagcggguggagaaauggcugagggaaugcggcgucgaccgacucaagcguauggcuauuucgggugaugacugugugguuaaaccccuggaugagagauuugggaccucauuguuauuccugaaugacaugggaaaggugcgcaaggauaucccacagugggaacccagcaaaggcuggaagaacuggcaggaggucccuuuuugcucccaucacuuccacaaaauauuuaugaaggacggccggagucucgugguaccauguaggaaucaagaugaacuuauugggagagcccgcaucucucagggagcagguuggagccugcgggagacugcuugccuaggcaaagccuacgcucagauguggucccugauguauuuccauaggcgagaccucagauuggccucaauggcaaucuguagugcgguuccgacagagugguuucccaccucucggacuacauggagcauucacgcccaucaccaguggaugaccacggaagauaugcugaagguguggaacagggucuggauagaggacaauccuaacaugaucgauaagacaccagugcacuccugggaagacauucccuaccuugggaaacgcgaggaccuguggugcggaucacucaucggcuuaagcucucgugcuaccugggccaagaauauucauacugcaaucacccaaguuagaaaccugauagguaaagaagaguauguggauuacaugccugucaugaagcgauauuccgcuccaagugagagcgaagggguguuguga

SEQ ID NO: 15690 - RNA, 9867 nt, Artificial Sequence
  derived and/or modified CDS sequence (opt3) from DENV-4__JN983813__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgucaccugccgcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuauauauccgccaucacacaggcagaacguauuggggagccugacuacgaggucgaugaagacaucuuucggaagaagagacugacuauuauggaucuccacccgggagcuggcaaaaccaagaggauccugccaucuauaguacgcgaggcccuuaaacgaagauuacggacacugauccucgcgcccaccagggugguugccgcagaaauggaggaagcuuugcgcggccugccuauucguuaucagacuccagccgugaagucggagcauaccgggagagagaucgucgaccucaugugccacgcuacauucacgacucggcugcuuagcucaaccagggugcccaauuacaaccugauuguuauggaugaagcacacuuuacagacccuuccaguguggccgcccgcggauacaucucuacccgagucgagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacagugugguuuguaccuucuaucaaggccggcaaugacauagcaaacugcuugaggaagagcgguaaaaaggugauucagcuaagucgcaaaaccuucgauaccgaauaccccaagacuaaacugacagacugggauuuuguugucaccacagacaucuccgagaugggggccaacuucagagcuggcagggugauugauccacggcguugucucaagccggugaucuuaacugacggaccugaacgcgucauacuggcgggccccauuccaguuacgcccgccagcgcagcucaacgaagagggaggaucggacggaauccugcccaggaggaugaccaguauguguucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguagagcucaugcgaagaggugaccugccaguguggcuuucauauaaggucgccuccgcggggauaaguuacaaagaccgcgaauggugcuucaccggcgagaggaacaaucagauccuagaagagaacauggaaguggagauuuggacucgggagggagaaaagaagaaacugcgucccaagugguuggaugcaagaguuuaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagugauguugcauacuaccgagcgggggggacgagcuuaccagcacgcccugaacgaacuaccagagucacuggagacacucaugcuugucgcacuguuaggugcgaugaccgccggcaucuuuuuguucuuuaugcaggggaagggaauuggcaaacugaguaugggucucaucacuauugcuguagccucugggcugcuuuggguggcagaaauccaaccucaguggauagcugccuccaucauucuggaguucuuucucaugguuuugcugauccccgaaccagagaagcagagaacaccucaggacaaucaauuaauuuaugugauccuaacgauacugaccauuaucggccucauugcagccaacgaaaugggacuuaucgagaaaacuaagacagauuucggcuuuuaccaggucaaaaccgagaccacaauacuggacguggauuugaggccggcuagcgcguggacucuguaugccgucgcaacgaccauccucacacccaugcugcgccacacuauugaaaauaccucagcuaaccuuagucucgccgccaucgcaaaucaggcugccgugcugaugggguugggaaagggcuggccacugcaucggauggacuuagguguuccucuacuggcgaugggguguuacagccaggugaaccccacaacccucacugcuucccuuguaaugcuguuggugcacuaugccauuaucggaccaggccugcaagcaaaagccacgagagaggcucagaagcguacagcagccgguauaaugaagaauccuaccgucgauggcauuacuguuaucgaccucgaacccaucucuuacgauccgaaauucgagaagcagcuggggcaagugaugcuuuuaguccugugcgcgggacagcucuugcugaugaggaccacaugggcuuucugugaggugcuaacucuggccaccggcccaauucucacacuuugggaagggaacccuggacgguuuuggaacacgaccaucgcaguaagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguggacagaaccgaagcgaaaucggcccugaaggauggaagcaaaauuaagcaugcaguuuccaggggcucuucaaaaauccgauggauaguggagcgggggauggucaagccaaagggaaaaguggucgaccucggcugcggucgugggggauggagcuacuauauggcuacgcuaaagaacgugaccgaaguuaaaggcuacacaaagggcgggcccggacacgaggaaccuaucccgauggccacuuaugguuggaaucugguaaaauugcauuccggcguggaugucuuuuacaagcccaccgagcaaguggacacacugcucugugauauuggggagaguucuagcaacccaacuaucgaagagggaagaacccuucgcguucugaagaugguggaaccuugguugucauccaaacccgaguucugcauuaagguccugaauccuuauaugccaacagugaucgaagagcucgagaaauuacagaggaagcacggcgguaaccugguacgguguccccuuaguagaaauagcacccacgaaauguacugggugucuggggcauccggaaacauuguuucaagcgucaauacuacgucgaaaaugcugcuaaaccgcuuuacaaccaggcaucgaaagccuacuuaugagaaagacguggaucucggcgcuggcacccggucugugaguacagaaacggagaagccagacaugaccaucauagggagaaggcugcagcgcuugcaggaggaacacaaggagacuuggcauuacgaucaagaaaaucccuaccguacaugggccuaucacggauccuacgaggccccgagcaccgguucagcguccucuauggucaacggcguugugaaacugcucacuaagccuugggacguaauuccaauggugacacagcuugcuaugaccgauacaacucccuucgggcagcagcgggucuuuaaagaaaagguggacaccagaacgccucaaccaaaacccggaaccaggaugguuaugacaacuaccgcaaauuggcugugggccuuacugggcaagaagaaaaacccgcgcuugugcacacgagaggaguucaucagcaaggugcggaguaaugcugccaucggugcagucuuucaggaagagcagggguggacuuccgccagcgaagcugugaacgacucuagauucugggagcucguagauaaagaaagggcgcugcaccaagagggaaagugugagucaugcguuuauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggaguggagggcgaagguuugcaccgacugggguauauacucgaggaaaucgauaagaaagacggagaucuuauguacgcagacgauaccgccggcugggacacgcgcauuacagaggaugaccugcagaaugaggaauuaaucaccgagcagauggcuccucaucacaagauucuggccaaagcgaucuuuaaguugacuuaucagaacaaggucgugaaagugcucagacccacaccacggggcgcagucauggauauaaucucuaggaaggaccaacgcgggucgggacagguugguaccuacggccugaauacuuucaccaacauggaagugcagcuaauuagacagauggaggccgaagggguaaucacacaagaugacaugcagaauccuaaaggacuuaaggagcggguggagaaauggcugagggaaugcggcgucgaccgacucaagcguauggcuauuucaggugaugacugugugguuaaaccccuggaugagagauuugggacgagcuuguuauuccugaacgacaugggaaaggugcgcaaggauaucccacagugggaacccuccaaaggcuggaagaauuggcaggaggucccuuuuugcagucaucacuuccacaaaauauuuaugaaggacggccggucucucgugguaccauguaggaaccaagaugaacuuauugggagagcccgcaucagccagggagcagguuggucccugcgggagaccgcuugccuaggcaaagccuacgcucagauguggucacugauguauuuccauaggcgagaccucagauuggccaguauggcaaucuguucugcgguuccgacugagugguuucccacaagccggaccacuugguccauucacgcccaucaccaguggaugacaaccgaagauaugcugaagguguggaauagggucuggauagaggacaacccuaauaugaucgauaagacgccagugcacucaugggaagacauucccuaccuugggaaacgcgaggaccuguggugcggaagccucaucggcuuaucuucccgugcuacaugggccaagaacauucauaccgcaaucacucaaguuagaaaucugauagguaaagaagaguauguggauuacaugccugucaugaagcgauauagugcuccaagcgagucggaagggguguuguga

SEQ ID NO: 15691 - RNA, 9867 nt, Artificial Sequence
  derived and/or modified CDS sequence (opt3) from DENV-4__KF041260__SS-prME
agcaccaucacacugcucugccuuauucccacugugauggccuuccaccuguccacgagagacggagagccuuugaugauagucgcuaagcaugaaagggggcggccauuacuguuuaaaaccaccgagggaaucaacaaguguacucugauugccauggaucucggugaaaugugcgaggacaccguuacauacaaauguccgcugcuugugaauaccgaacccgaggauaucgacugcugguguaaccugacuucugccuggguaauguauggaacaugcacccagucaggggagcgccgacgugaaaagagaaguguggcguugacgccucacagcggaaugggccucgagacuagggcugaaaccuggauguccucugagggugccuggaaacaugcacagcgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauguggucgaccggggcuggggcaacgggugcggacuguucgguaaaggcgggguugugacgugcgccaaguuuucuuguagcggaaaaauuaccggcaauuugauccaaauugagaaccucgaauauacaguaguggucacugugcauaauggugauacccacgcaguugggaacgacacauccaaucacggcgugacugcuaccgucacaccucguucaccaaguguggagguagaacugccggauuacggagaguuaacccuggacugcgagccccgcagcggcaucgacuucaacgaaaugauccucaugaagaugaauaagaaaacuuggcuuguucauaagcagugguuucuggauuugccucuaccauggacggccggggcggacacaucugaggugcacuggaaccauaaagaaagaauggucaccuucaaggugccccacgccaaaaggcaggaugucacugugcugggaucccaggagggugcaaugcacucagcucucaccggcgccacagaaguugacagcggggauggaaaucauauguuugcuggccaccugaaguguaaagugcggauggagaaacuucgaauuaaggguaugaguuacaccaugugcucugggaaauucuccauagacaaggagauggccgaaacucaacauggcacaacgguagucaaagugaaguaugagggagcaggcgccccuuguaaaguuccaaucgaaauucgcgaugugaacaaggagaaggucguggggagaaucauaagcucgacccccuucgcugagaacacuaauucuguaacaaacauugaacuggagccgccuuuuggagacuccuacaucgugaucgguguuggcgauucagcguugacccuccacugguucaggaaagggaguagcauuggaaagauguuugaauccacauaucggggcgcaaaacgcauggccauccugggugagacugcuugggacuucgggucugucggcggauuacugaccagccuaggcaaggccgugcaucagguguuugggucagucuacacgaccauguucggaggcguuaguuggauggugaggauucucauagguuuucuggugcuuuggaucgggacaaauuccaggaacacuagcauggcaaugucuugcauugccguaggaggcaucaccuuguuccuggguuuuacaguccacgcugauaugggcugugccgugucauggagugggaaagaacucaagugcggaagcggcaucuucauuauagacaauguucacacuuggaccgagcaguauaaguuucaacccgaguccccagcacgucuggcgucugcuauccuuaacgcccauaaagacgggguguguggcauucggucgacgacacgacuggaaaaugucauguggaagcagaucaccaacgaguugaauuacgugcucugggaaggcggucacgaucugacuguuguggcaggggacguaaaaggagucuuaagcaagggcaaaagagcccuggcuccucccgugaacgaucuaaaguauuccuggaagacaugggguaaagccaagauuuucaccccagagacuagaaauucaaccuuucucaucgacggccccgauacaagugaaugcccuaacgagcgccgggcauggaauuuccuggagguggaagacuacggguucggaauguuuacgaccaacauauggaugaaauucagagagggcucuagcgaagucugugaucauaggcuuauguccgcugccaucaaggaccagaaagcgguucacgccgauaugggguacuggauugagucaagcaagaaucagacuuggcaaaucgaaaaggcuucuuugauugaggugaagacaugccuguggccaaagacccacacacucugguccaacggaguacuggagagucagauguuaaucccgaaagcauaugccggccccuuuagccagcauaacuaccgccaggguuaugcuacucaaaccauggggccuuggcaccugggaaaacuugaaauagacuucggcgagugcccagguacgacagugaccauucaggaagauugugaccaucgaggccccucuuugcggacuaccacagccuccgggaaacucgucacucaguggugcugucguucaugcaccaugccuccacugagauuucuaggagaggauggcuguugguacgggauggagaucaggccccugagugaaaaggaggaaaauauggugaaaagccagguuucggcaggacaaggcacauccgagacguucucuaugggucuccugugccuuaccuuguuuguggaagagugucugcgccggagagucacuaggaagcacaugauuuuagugguugugacaacccucugcgcgaucauacuaggcgggcuuacuuggauggaccuguugcgagcccucaucaugcuggggaacacaaugagcucacgcaugggcgggcagacccaucuagcuauuauggccgucuucaagaugaguccgggauauguacuggguaucuuucuccggaaacugacguccagagagacugcacuuauggugauuggcauggcuaugaccacaguuuugucuaucccucacgaccugauggaguucauagaugggauuagcuuaggacucauccugcuuaagauggugacccacuuugacaauacucaggucggcacacuggcccuaucccucaccuucaucaaaucaacaaugccacuggugauggcauggaggacuauuauggccguauuguuuguggucacccugauccccuuaugucguacgagcugccuccagaagcaaagucauuggguugagauuacagcucugauacuuggugcgcaggcccugccuguguacuugaugacccucaugaaaggggcaucuaagcgcuccuggccccugaacgaaggaaucauggcugugggccuagucagccugcuuggcucggcccuccugaagaaugaugugccauuggccgggccuaugguugcuggaggucuguuacucgcagccuauguaaugucaggcucuagugcggaccugucccuugagaaagcugccacugugcagugggaugaaauggcagacauuaccgggagcucucccaucauugaggucaagcaagaugaggacggcagcuucuccauccgggauguggaagagacaaacaugauaacucuguugguuaaacucgcccugaucaccgugucaggccuauacccacuggcuauuccggucacgaugacacuuugguacauguggcaagugaagacccagagaaguggugcacucugggacguaccuagccccgccgcgacucagaaagcuacacugaccgaaggggucuauaggaucaugcaacgaggauuguucggcaagacucaggugggcguugggauucacauggagggaguguuucauacaauguggcacgucacccgggguucugugaucugucaugaauccggccgcuuagagccaucaugggccgauguuaagaaugacaugauaaguuacgggggaggcuggagacugggugauaaaugggacaaggaggaagacgugcagguccucgcaguggagcccgggaaaaacccuaagcacguacagacgaaaccaggacuguucaagacucuuaccggcgaaauuggcgccgugacacuggauuuuaaacccgggaccagcggauccccuaucaucaauaggaaggguaagguuauuggcuuguaugggaacggagucgugacaaaaucuggcgacuacgugucggcuauaacucaagccgagcggaucggugagccggauuaugaagucgacgaggauauuuuccgaaagaaaagacuaaccaucauggaccugcacccaggggcaggaaagacgaaacgcauucuccccagcaucguaagggaagcucugaagcgucggcuuagaacauuaauacuggccccuacuagggugguugcggccgagauggaagaggcacuccgcggcuugccaauccgauaccagacccccgcugugaagacagagcauaccggcagagaaauugucgaucugaugugccacgccacuuuuaccacacggcuccugucauccacgagggugccuaauuauaaccuuaucguuauggacgaggcucauuucacugauccgaguucuguggcagcccgcggguacauuagcacccgugucgaaaugggagaggccgcugcgaucuuuaugacagcaacacccccagguacuacagacccuuucccccaguccaauucaccaauagaagauauugagagagagaucccugaacggucuuggaacaccggcuuugacuggaucacggacuaccaggggaaaacugugugguucguacccagcauuaaggccggaaaugauaucgcuaacugccugaggaaaaguggcaagaaagugguucaauugucccgcaagacauuugacaccgaguauccaaagaccaaacuaacugauugggacuucgucgugacaaccgauauaagcgaaaugggugccaacuuccgagcagggagagugauugacccgcggaggugucugaagccugucaucauuacagauggccccgagcgcguuauccucgccggaccaauacccgugacuccugcuucugcggcccagagaaggggccggauugggcguaauccagcacaggaagacgaucaauacguauuuucaggagaccccuuacgcaacgaugaggaccacgcucacuggacggaggccaaaaugcugcuugauaauauccauaccccugaagguaucauuccgacacuguucggcccagagcgagaaaagacucaggcaaucgacggggaguuuagacucaggggagagcagcggaaaaccuucguggaauugaugcgcagaggcgaccugcccgucuggcucuccuauaagguggccagugcugguauuagcuacaaggauagggaguggugcuuuacaggggaacggaacaaucagauacuggaggaaaacauggagguugagaucuggacccgagaaggcgagaaaaagaaacuuagaccuaaguggcuagacgcccgcguguaugcggaucccgucgcacugaaagacuucaaggaauuugccucgggaaggaagucuauuacuuuggauaucuuaacggagaucgcuucccugccaaccuaccucagcucacgggccaaacuggcucuugacaauauuguaaugcugcacacaacugaacguggcgggaaggcauaucaacaugcccucaacgaguugccugagagucuggaaacccuaaugcugguggcucuccuuggagccaugacagcagguauauuccuguuuuucaugcagggcaaagggaugggaaaguuaucuaugggcuugaucgcgauugccguugcuuccggucugcucuggguggccgagauccagccccaguggauugcagcuagcaucauacuggaauuuuuccuuauggcccugcucaucccagagccugaaaaacaaagaaccccgcaggauaaucaguugauuuacgucauccugacuauuuuaacaaucauagggcuaguggcagccaacgagaugggccugauugagaagacgaaaaccgacuuuggauucuaccaggucaagacugaaacaaccauccucgauguggaccuuaggcccgcuucagcguggacccuguaugccguugcaacaacuauuuugacgccaaugcugcgccacaccaucgagaauacaagugcuaaccucagccuggccgccauagcaaaucaagcugccgugcuuaugggccucgggaagggauggccucugcaucggauggauuugggcguaccccuguuagcgauggguuguuacucccaggugaacccaacuacccuaacagcuucucuggucaugcuccuuguucacuaugccaucauugggccuggacugcaggcaaaagccacccgagaagcucagaagagaacugcagccggcaucaugaaaaaucccacgguggacgguauuacagucaucgauuuggagccgauaagcuacgacccaaaguucgagaaacaacugggccaggugaugcuccugguacuuugcgcggggcaguuacugcucaugaggaccacuugggcuuuuugugaaguguugacccuggccacaggaccuauucuaacucugugggagggcaaccccgggcgcuucuggaacaccacaaucgcaguuuccacggccaauaucuuucggggaucauaucucgcuggcgccggucuugcauucucucugauuaagaacacccaaacuccaagacgugggacaggaaccacuggcgaaacauugggugagaaguggaaaaggcagcugaauagucucgaccggaaggaauuugaggaguacaaacgcucgggcauccuggaaguggaucgaaccgaggcuaagagcgccuuaaaagacggguccaagauaaaguaugcggucucuagaggaacgucaaaaauuagguggaucguggaacggggcauggucaagcccaaagggaaggugguugaucuuggaugcggccgcgguggguggagcuacuacauggccacccugaaaaacguaacagaggugaagggauauacuaagggcggcccugggcacgaagaaccgauucccauggcaaccuacggauggaaucucgucaaacuacauuccgguguggacguuuucuauaagccaacagaacagguggauacucuguugugugacaucggcgaaaguucuagcaacccuaccauagaggaagggagaacacugaggguccucaaaaugguggagcccuggcuuucauccaagccugaauuuugcaucaaaguacugaauccauacaugcccaccgugauugaggaguuggaaaagcugcagcgaaaacacggaggcagucucguucgguguccuuuaagccguaacucuacucaugagauguauugggucuccggugugucagggaauaucgugagcucggucaacacgacaucuaagaugcugcuuaauagauucaccacucgcuacaggaagccaaccuaugaaaaagaugcugaccugggagccggcacacggaguguuuccacggagaccgagaagcccgauauggcaauuaucggcagacgccuacaaaggcuccaggaggaacacaaagaaacuuggcacuacgaccaggagaacccguaccgaacaugggcuuaucaugggagcuacgaagccccuucaaccggauccgccucuagcauggugaaugguguagugaagcuguugacuaaaccaugggaugucauucccauggugacacagcuggcgaugaccgacacaacuccuuuuggccaacagcggguuuucaaggagaagguggacaccagaacgccacagcccaaaccggggaccaggaugaucaugacaacuaccgcuaacuggcucugggcacuucugggaaagaaaaagaauccucgcuuaugcacacgugaggaauuuauaaguaaaguccgguccaacgccgcuauuggcgccguguuccaggaggaacaagguuggacuagcgcaucugaggccguaaaugauucaagauuuugggaacugguugacaaggagagggcuuugcaccaggaggggaagugugaaaguugcguguauaacaugaugggaaaacgcgagaagaaacucggcgaguucggccgagcgaaggggucccgggccaucugguacauguggcugggagcaagauuccuagaguuugaagcucuugguuuccugaacgaggaucauugguuuggcagggagaauagcuggucuggggucgaaggagagggccuccaccgccuggguuauaucuuggaagacauugauaaaaaggacggggaucugauauacgccgacgauaccgcaggaugggacacgagaaucacagaggaugaccuccuuaacgaggaacugauuaccgagcagauggcaccccaucacaagaucuuagcuaaagccauuuucaagcugacuuaucaaaauaaaguggugaaggucuugcggccaacaccuaaaggcgcgguuauggauaucauaucgaggaaggaccagcguggcucaggacaggugggaaccuacggucucaacacuuuuaccaauauggaaguacagcugauccgacaaauggaggcagaaggcgugauuacacgcgacgauaugcacaaccccaaagggcuaaaggagagagucgagaaguggcuuaaagaaugcggaguggaccggcugaagaggauggccaucagcggcgaugacuguguugugaaaccacucgaugagcgcuucuccacgagucuguuguuuuuaaaugacauggguaaggucagaaaagauauuccccagugggaaccuucuaagggguggaagaacuggcaggaggugccauucugcagccaucacuuucauaaaaucuucaugaaggacggacggucccugguaguuccguguaggaaucaggaugaacucauaggccgagcucguauuucacaaggcgccggguggagucuuagagagaccgcaugccugggaaaggcuuacgcccagauguggucucuaauguauuuucaccgccgggaccugaggcucgcuagcauggccaucuguuccgcagugcccacugagugguucccuacaucaagaaccacuuggagcauccacgcgcaucaccaguggaugacaaccgaagauauguugaaggucuggaaccgcguguggauugaggacaauccaaacaugacggacaaaacacccguucauucuugggaagauauaccuuaccuggguaagcgggaggaccuuuggugcggcucccugaucgggcucaguagcagggccaccugggcuaagaauauucacacugccaucacccaggugcgaaacuuaauuggaaaagaagaguaugucgauuacaugccagugaugaagagauauucggcacccuuugaguccgaaggcguacuguga

SEQ ID NO: 15692 - RNA, 9867 nt, Artificial Sequence
  derived and/or modified CDS sequence (opt3) from DENV-4__FJ024476__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacugccacauggguaauguauggcaccugcacgcagucuggggagcgccgacgugaaaagagaucaguggcguugacuccucacaguggaaugggccucgagaccagggcugaaacauggaugagcuccgagggugccuggaaacaugcacaacgggucgagucuuggauucugcgcaauccaggguucgcccugcucgcuggauuuauggcauacaugaucggccagacuggcauacagagaaccguguucuuuguuuuaaugaugcugguggcccccucguaugggaugaggugugucggaguggguaaccgggauuucguagaaggcguuucagggggagcuuggguggaccuugucuuggagcacggcgguugcgugacaaccauggcccaggggaagccuacgcuggauuuugaacuaacuaagacaaccgcgaaagagguggcacuccugcgcacuuacuguaucgaagccagcauuaguaauaucacaaccgcuacgcgaugcccaacccaaggagagcccuaucuuaaggaggaacaggaccagcaguacauuuguagaagggaugucguugaccggggcuggggcaacgggugcggacuguucgguaaaggcggggugguaacaugcgccaaguuuuccuguucuggaaaaaucacuggcaauuuggugcaaauagagaaccucgaauauaccgucgugguuacagugcauaauggugauacucacgcagucgggaacgacaccagcaaucacggcgugacagcuaugauuaccccucguuccccaucaguagagguuaagcugccggauuacggagaauuaacucuggacugcgagccccgcaguggcaucgacuucaacgagaugauucucaugaagaugaaaaagaaaacguggcuugugcauaagcagugguuucuggauuugccucuaccauggacagccggggcggacaccagcgaaguccacuggaauuacaaagagagaauggugacuuucaaggucccccaugccaaaaggcaggaugugaccguucugggaucucaggaaggugcaaugcacuccgcucucgccggcgcuacagagguggacucaggggauggaaaccacauguuugccggccaucugaaguguaagguacggauggaaaaacuucgaaucaaggguaugagcuauaccaugugcagugggaaauucucuaucgacaaggagauggcagagacucaacacggcacaacggucgugaaaguuaaguacgaaggagccggcgcuccuuguaaggugccaauugagauacgcgaugucaauaaagaaaaggugguagggagaaucauuuccagcaccccccuggcggagaacacuaacucggugacaaauaucgaguuggaaccgccuuucggagacucuuauauaguuauuggugucggcaacuccgcacucacccugcauugguuuaggaaagggucaaguaucggaaagauguucgagagcacauaccggggcgccaaacgcauggcuaucuuaggugaaacugccugggauuuuggguccgugggcggacuguucaccucucuaggcaaggcagugcaccaggucuuugggagcguuuauacgaccauguucggaggcgugucauggaugauuagaauccucauuggucugcuuguguuguggauagggacaaauaguaggaacacuuccauggccaugaccugcaucgcuguaggaggcauuacacuguuucucgguuucacuguccaggccgacaugggcugugugguuagcuggucugggaaggagcugaaaugcggaucaggcaucuuuguggucgauaaugugcauaccuggacggaacaauacaaguuccagcccgagaguccagcacgucuugcgagcgcuauccugaacgcccacaaagacgggguuuguggaauucgguccacaacccgauuggagaaugugauguggaagcagauaacuaacgaacucaauuauguacugugggagggcggucacgacuuaacagucguggcaggggaugugaaaggaguccugaccaagggcaagagagcccuaacuccucccguuucugaccucaaauacucguggaagaccugggguaaagcuaggaucuuuacaccagaagcccgcaacagcacguuccugauugauggccccgacaccuccgagugcccuaaugaacggagagcauggaacucacuugagguggaggauuacggguuuggaauguucacuacaaauaucuggaugaaguucagggaaggcaguucugagguaugugaccaucgcuugaugagcgcugccauuaaagaucagaaggcggugcacgccgacaugggguauuggaucgaauccucaaaaaaccaaaccuggcagauagagcgagcuagccugaucgaagucaagacaugccucuggccaaagacucauacccuguggucuaauggaguguuagagucccagaugcugauuccgaaaaguuacgcaggccccuuuagccagcacaacuaucggcaagguuacgccacgcagacaauggggccuuggcaccuuggaaaguuggagaucggcuucggugaaugcccaggcaccacuguuaccauucaggaggauugugaccaucgugggcccucucucagaacaacuaccgcuuccggaaaacuggugacacaguggugcuguaggucaugcacgaugccuccacuacgcuuucugggcgaagauggguguugguauggaauggagauccggccccucagugagagagaagagaacauggucaagagccaagugaccgccggccaggguacuucggaaacauucuccauggggcugcuuugcuugacccuguuuguugaggaauguuuaaggcgacgcgugacucggaaacacaugauacucgucguagugauuacacugugcgcaaucauucuuggaggccugaccuggauggacuugcucagagcgcugaucaugcuaggcgauacgaugucugggaggauaggaggucagauccaucuggccauuauggcuguuuucaagaugagcccgggcuacgugcucggggucuuucugcguaagcuuacuucacgcgagaccgccuugauggugaucggaauggcaaugacaaccguacugaguauuccucacgacuuaauggagcucaucgacggcauaucccugggucuuauucugcuaaaaaucgugacucaguucgauaauacacaagucgggacccucgcucugucuuugacauuuauccggagcacuaugccacugguuauggccuggagaaccauuauggcaguguuauucguggucacgcucaucccccuguguaggacauccugccuucagaagcagucacauuggguggaaauuaccgcccugauauugggagcucaagcgcucccuguuuaucugaugacucuaaugaaaggcgccagccgacggaguuggccccugaacgagggcaucauggcaguagggcuugugucucuccugggauccgcuuugcugaagaaugacgucccauuagccgguccuaugguggccggcgggcuccugcuugcugcauacguuaugagcggaucgucagccgaucugucuuuggaaaaagcggcuaacgugcagugggacgagauggccgauauuaccggcaguucccccaucauugaagucaagcaggacgaggaugguagcuuuucuauccgcgacguggaggaaacaaauaugauaacucuccugguaaagcuagcacugaucaccgucagcgggcuuuacccacucgccauuccggugacgaugacacugugguauauguggcagguuaaaacccaaagauccggagcuuugugggaugugccuucacccgcagccacucagaaggcggcuuuaagugagggcgucuacaggaucaugcagcggggccuguucgggaaaacacaggugggaguugguauucacauggaaggcguguuucacaccauguggcaugucacucgagggagcgugaucugucacgagacaggaagacucgaaccaucuugggccgacguacgcaacgauaugauauccuauggcgguggguggaggcugggagacaagugggauaaagaggaggacgugcaaguucuugcaauugaacccggcaagaauccuaagcauguccagaccaaaccaggccuguucaagacguugacuggggagaucggagccgugacccuagacuucaaacccgguacaucaggcaguccuaucauuaaccguaaggggaaagugauaggacuguacggcaauggugucguaaccaagagcggggauuauguguccgcuaucacacaggccgaacggauuggagagccggacuacgagguugaugaagacaucuuuagaaaaaagaggcucacuauuauggaucugcacccaggcgcaggcaagaccaaacgcauccuucccucuauagugcgagaggcuuuaaagagacggcugaggacgcucaucuuggccccuacacgcgucguggcggccgaaauggaggaagcacugcgugggcucccaauuagauaucagacucccgcuguuaaaucggagcauaccggacgggagaucguggaccugaugugccacgccacauucaccacuaggcuucugagcucaacccgcgucccuaacuacaauuugauugugauggaugaagcucacuuuacagacccguccaguguagcagcccgagguuacaucucuacgagaguggagaugggcgaagccgcugcgauauucaugacugcaacccccccaggggccacagauccuuuuccccaaagcaacuccccaauugaggacaucgaacgggagaucccugagaggucauggaauaccggauucgauuggauuacugacuaucagggcaagacaguuugguuuguccccucuaucaaagcugguaacgacauagccaauugccuacgcaagagcgggaagaaaguggugcagcugaguagaaagaccuucgauacggaauacccaaaaacuaagcucacagacugggauuuugucguuaccaccgacauuuccgagaugggcgcaaacuucagggccggacgggugaucgauccgcgucgcuguuuaaaaccuguaauucugacugacggccccgaacgagugauccuugcugggccaauacccgucacaccugcgagcgccgcacaaagaaggggacggauuggucgcaacccagcucaggaggaugaccaguauguguuuucuggcgauccccugaagaaugacgaagaucaugcccacuggaccgaggcaaagaugcucuuggacaacaucuacacaccugaggggaucauuccgacucuguucggaccagaaagagagaaaacgcaggccaucgauggcgaauucaggcuccggggugagcaacgaaagaccuuuguugagcugaugagacgcggggaccuucccguguggcuaucauauaaagucgcuuccgccggcauuaguuacaaggacagggaauggugcuucacaggagagcggaauaaccagauacuggaagagaauauggaaguagagaucuggacucgugagggcgaaaaaaagaaguugagaccuaggugguuagaugcgcgcguguaugcagaccccauggcccugaaagauuuuaaggaguucgcuagcgggcggaaaucgauuacccucgacauccugacagaaaucgccucucuuccaaccuaccuguccagccgagcuaagcucgcauuggauaacauuguuaugcugcauacuacggagagaggagguagggccuaccagcacgcucuaaaugaacugccugagucacucgagacccuuaugcugguggccuuauugggcgcaaugacagcggggauauuucuguucuuuaugcagggaaaaggcaucgguaagcucaguauggggcugauuacuaucgccgucgcuucuggccuucuguggguggccgaaauucaaccccaguggaucgcagcuuccauaauccucgaguucuuuuugaugguccuguuaauuccagaaccugagaagcagcgcaccccgcaggacaaccaacuaaucuaugugauucugacaauccucaccauaauuggacuuaucgccgcaaaugaaaugggccugauugagaaaacuaagacagauuucggguuuuaccagguuaaaacggagaccacuaucuuggacguggaucugcggcccgccagcgcuuggacacucuaugcgguagccaccaccauacugacaccaaugcuuagacacacuaucgaaaacacgucagcaaaucucagucuggcugccauugccaaccaggcagcuguguugaugggacugggcaaggguuggccuuuacaucguauggaccuaggggucccccugcucgccaugggauguuacagccagguuaauccaaccacacuuacugcgucccuggugauguugcugguccacuaugcuaucauuggcccuggucuccaagccaaagcaaccagggaggcccagaagcggacagcugcaggcaucaugaaaaaccccaccguggaugggauaacuguaauugaccuggaaccgaucucuuacgauccaaaguucgagaagcagcuuggacaagugauguuacugguucucugcgccggccaguugcugcuaaugcgcacgacaugggcguuuugugaggugcugacccucgcuacugggccuauccuuacccugugggaaggaaaucccggccgauucuggaacacaacuauugccgucagcaccgcaaacaucuucagagguuccuauuuggccggggcuggacuggccuuuucacucauaaaaaaugcacagacaccaaggcggggcacggguaccacuggcgagacacugggggaaaaguggaaacgccaguuaaacucucuugacagaaaggaguucgaagaguacaaaaggaguggaauucuggagguggaccgaaccgaagcuaagucggcccucaaggauggcagcaaaaucaagcaugcggucucccgggggucuucaaaaauucguuggaucguggagagaggaaugguuaagcccaaaggcaagguaguggaccuagguugcgggcgcggaggcuggagcuacuauauggccacucugaagaaugucacagaagugaaaggcuacaccaaggggggaccuggucacgaggaaccgauacccauggcaacguauggcuggaacuugguuaaacugcauuccgggguggaugucuuuuacaagccaaccgagcaaguggacacacuccuuugugauaucggagagaguucuagcaauccuacuauugaagagggcaggacccugcggguauugaaaaugguggaacccuggcugucauccaagccugaguucugcaucaagguucucaacccauauaugcccacagucauugaagaguuagagaaacugcagagaaagcacggugggaaucuugugcgcuguccucugaguaggaacagcacucacgaaauguacugggugucuggagcuuccggcaauaucgucucaagcguuaacaccacaucgaaaaugcuacucaaucgauuuaccacucggcauagaaagccaacguaugagaaagacguggaucugggcgccgggacaaggucuguaaguaccgaaacugagaagcccgacaugaccauuaucggacgccguuugcagcggcugcaggaggaacacaaagagacauggcauuacgaucaagaaaacccguacagaacgugggcauaucacgguuccuacgaggcuccuagcaccggcucagccuccucuauggugaauggggucgugaagcuccuuacuaagccaugggacguuauacccauggugacacagcuggccaugaccgauacuacaccuuucggacagcagagggucuuuaaagaaaagguggacacccgcacaccacaacccaaaccgggcacucgaaugguaaugaccacgaccgcgaacugguuaugggcucuguuggguaagaaaaagaauccucggcucugcacaagagaggaguucauuagcaagguuaggaguaacgcagccaucggggcuguguuucaggaagagcagggauggacuuccgccagcgaagcagucaaugacucucgcuucugggagcugguggauaaagaaagagcccuacaccaagagggcaagugugagucaugcguguauaacaugaugggcaaacgggaaaagaaacuuggggaguuuggaagggcuaaggguagucgugcgaucugguacauguggcugggcgcccgauuccucgaauuugaggcacugggguucuugaacgaagaccauugguucggacgcgagaauuccuggagcggcgucgagggugaagggcugcacagacucggauauauucuugaggaaauagauaagaaagacggcgaucugauguacgcugacgauaccgccggcugggacacacggaucacugaggaugacuuacagaacgaggaacugauuaccgagcagauggcaccccaucacaagaucuuggccaaagcuauuuuuaagcucacguaucagaauaaaguugugaagguacugaggccaacaccucgcggggccgugauggauaucauaucuagaaaggaccaacggggaucgggucaggucggcaccuacgggcuaaacacuuucacaaauauggaagugcagcuuaucaggcagauggaggcggaaggaguuauuacccaagaugacaugcagaaccccaaaggccugcgagagcguguggagaaguggcucaaagaaugcggugucgacagacugaagcgcauggcaaucucaggggaugacugugugguaaaaccauuggaugagcgguuuggaacuagcuuacuguuccucaaugacaugggcaagguuaggaaagauauuccccagugggaaccuuccaagggcuggaagaacuggcaggaggugccauuuugcagucaucacuuccacaaaaucuuuaugaaggacgggagaucucuugucgugccgugucgcaaucaagaugaacugauaggacgggccaggauuagccagggugcuggcuggucccuacgagagaccgccugccuggggaaagcauacgcucagauguggucacucauguauuuccauagacgggacuugaggcuggccaguauggcuaucuguucugccguucccacagagugguuuccuacgagccgcaccacuugguccauccacgcacaucaccaguggaugacaaccgaagauaugcuuaagguguggaaccgugucuggauugaggacaauccaaacaugacugauaaaacacccgugcacucaugggaagacauaccuuaccugggaaagagagaggaccucuggugcggcagcuuaaucggucugucuucccgagcgaccugggccaagaauauucauacggcuaucacacaaguaaggaacuugauugggaaagaagaguauguggauuacaugccagucaugaagcgguauagugcccccagcgagucggaaggaguucuguga

SEQ ID NO: 15693 - RNA, 9867 nt, Artificial Sequence
  derived and/or modified CDS sequence (opt3) from DENV-4__GQ868579__SS-prME
agcaccaucacucugcucugccuuauucccacuauaauggccuuccaccuguccacgagagacggcgagccuuugaugaucguggcuaagcaugaaagggggcggccauuacuguuuaaaaccacagagggaauuaacaaguguacucuaaucgcaauggaucucggugaaaugugcgaggacaccgucacauacaaauguccgcugcuuauuaauaccgaacccgaggauaucgacugcugguguaaccugacuucuacauggguuauguauggaaccugcacgcagucaggggagcgccgacgugaaaagagaaguguggccuugacuccucacagcggaaugggccucgagaccagggcggaaacauggauguccucugagggugcuuggaaacaugcccaacggguagagucguggauacugcgcaauccaggguucgcacugcucgccggauuuauggcuuacaugaucggccagacuggcauucagagaaccguguucuuuaucuuaaugaugcuggucgcacccucauaugggaugaggugugugggaguugguaaccgggauuucguggaaggcgucagcgggggagccuggguggaccuuguauuggagcacggcgguugcguuacaaccauggcucaggggaagccuacgcuggauuuugaacuaacuaagacaaccgccaaagagguggcgcuccugcgcacuuacuguauugaagcacuuaucaguaauauaacaaccgccacgcgaugcccaacccaaggagagcccuaucugaaggaggaacaggaccagcaguacauuuguagaagggaugucguggaccggggcuggggcaacgggugcggauuguucgguaaaggcgggguggucacaugcgcuaaguuuuccuguucuggaaaaaucacuggcaaucucguucaaauugagaaccuggaauauaccgugguagugacaguccauaauggugauacucacgccguggggaacgacaccagcaaucacggcguuacagcaaccaucacuccucguuccccaucaguggaggucaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccgcuggggccgacacuagcgaaguacacuggaauuacaaagagagaaugguuaccuucaaggugccccaugcgaaaaggcaggaugucacagugcucggaucucaggaaggugccaugcacuccgcacuggcuggcgccaccgaggucgacucaggggauggaaaccacauguuugcuggccaucuuaaguguaaggugcggauggaaaaacugcgaauaaaggguaugagcuauacuaugugcagugggaaauucucuaucgacaaggagauggccgagacacaacacggcacgaccguugugaaaguaaaguacgaaggagcaggcgccccuuguaaggucccaauugagauccgcgaugugaauaaagaaaagguuguggggagagucauauccagcacucccuuggcugagaacacaaacucggugaccaauauugagcucgaaccgccuuucggagacucuuauaucguaaucggugugggcaacuccgcgcugacauuacauugguuuaggaaagggucaaguauuggaaagauguucgagagcacuuaccggggcgcaaaacgcauggccauccugggugaaaccgcuugggauuuuggguccguuggcggacuauucacgucucucggcaaggccguccaccagguguuugggagcguguauaccacaauguucggaggcgucucauggaugauuagaauacugaucgguuuucuuguuuuguggauugggacuaauaguaggaacaccuccauggcaaugacaugcaucgccgugggaggcaucacucuguuccucgguuuuaccgugcgugcugacaugggcuguguagucagcuggucugggcgggagcugaagugcggaucaggcauuuucgugguugauaaugugcauacguggacagaacaguacaaauuucaacccgagaguccagcccgacuugcaagcgcgauacugaacgcucacaaggacggggucuguggaaucagauccaccacuagguuggagaaugugauguggaaacagauuacaaacgaacucaauuauguucugugggagggcggucacgacuuaaccgugguagccggggaugucaagggagugcugacuaaaggcaagcgcgcacuaaccccucccgugucugaccucaaguacucguggaaaacaugggguaaggccaaaaucuucacgccagaagcucggaacagcaccuuucugauugauggccccgacacuuccgagugcccuaaugaaagaagggccuggaacucacuugaggucgaggauuacggguucggaauguucacaaccaauaucuggaugaaguuucgcgaaggcaguucugagguuugugaccaucgauugaugagcgcagcuauaaaagaucagaaggccgugcacgcggacaugggguauuggaucgaauccagcaagaaccagacauggcaaauugagcgggccagccugaucgaaguaaagacuugccucuggccaaagacccauacgcuguggucuaauggaguguuagagucccagaugcugauuccgaaaaguuacgcuggccccuucagccagcacaacuaucgucaggguuacgcaacacaaaccgucgggccuuggcaccuuggaaaguuggagaucgauuuuggcgaaugcccagguacuaccgugacaauacaggaggacugugaucauagaggccccucucucaggacuaccacagccuccgggaaacugguuacgcaguggugcugucgcucaugcaccaugccuccacuacgguuccugggagaagacggcuguugguaugggauggagauuagaccccucagugagaaggaagagaacauggugaaaagccaggucacugcuggacaaucgacauccgaaaccuuuucuaugggccugcuuugcuugacucuguucguggaggaauguuuaaggcgacgcguuacacggaagcacaugauccucgccguggucauuacccugugcgcaaucauacuuggugggcugacguggauggauuugcucagagcgcugaucaugcuaggagacacuaugagcggcaggauuggcgggcagacccaucuggccaucauggcuguauuuaagaugucaccgggauacgugcucgguguuuuccugcguaaacuuacaagucgcgagaccgccuugauggugauuggcauggcaaugacuacaacccuguccaucccucacgacuuaauggagcucauagaugggauuucucugggacuuauccugcuaaagaucgucacacaguuugacaauacucaggugggcacccucgcucugagcuugacguucauucgguccacaaugucacugguaauggccuggagaaccaucauggcaguguuauuugucguuacucucauuccacuguguaggaccagcugccuucaaaaacagagucauuggguggaaauaacagcccugaucuugggugcucaggcgcuccccguguaucugaugacucuaaugaagggggccucucgacgguccuggccucugaacgagggaauuauggcagucggccuugugagccuccugggcucggcuuugcugaaaaaugauguucccuuagccgggccaaugguagccggaggucuccugcuugcugcauacgugaugucaggcucuagugccgaccuguccuuggaaaaggcggcuaacguccaaugggaugagauggccgacaucaccgggagcucuccuauuaucgaagugaagcaggaugaggacggaucauucuccauacgcgauguugaggaaacgaauaugaucacacuccuggugaaacuagcacugauuaccgucucaggccuuuacccccucgccaucccagugacuaugacacugugguauauguggcagguaaagacccagagaaguggugcuuugugggacgucccgagcccugcagccacucaaaaagcggcuuuaucugaggggguguacaggauuaugcagcggggacuguuuggcaagacacagguuggcguggggauccacauggaaggagucuuccacaccauguggcaugugacgcgagguuccguuauaugucacgagacuggcagacucgaacccucaugggccgaugugcgcaacgacaugauuaguuaugggggaggcuggaggcugggugauaaaugggaccgugaggaggacguccaggugcuugcaaucgaaccagggaagaaucccaagcauguacaaaccaaaccuggacuguucaagacauugaccggcgagaucggcgccgugacacuagauuuuaaaccagggacuagcggaucccccauuauaaacaagaaagguaagguuaucggccuguacgggaauggagucgugaccaaaucuggcgacuaugugucggcuauuacgcaggccgaacggaucggugagccugauuacgaggucgacgaagauauuuucagaaagaagaggcucacaaucauggaccugcacccgggggcaggaaaaacuaagcgcauacuuccaagcaucguacgagaggcuuuaaaaagacggcugaggacccucauuuuggcccccacacgcgugguugcggccgaaauggaggaagcacugcguggccucccuaucagauaucagaccccagcugugaagucagagcauacuggccgggagauugucgaucugaugugccacgccaccuuuacaacgaggcuucuguccaguacucgcgugcccaacuacaauuugaucguuauggacgaagcucacuucaccgauccuucuagcguggcagcccgaggguacauauccacaagagucgagaugggagaagccgcugcgauuuuuaugaccgcaacuccgcccggugccacagacccauucccucagucaaacucucccaucgaggauaucgaacgggagauuccagagaggagcuggaauaccggcuuugacuggaucacggacuaucaagggaaaacugugugguucguaccuaguauaaaggcuggaaacgauauugccaauugccuacgcaaguccggcaaaaaggugauccagcugagcagaaaaacauuugacaccgaauaccccaagaccaaacucacugauugggacuucguugucacaaccgauauuucugagaugggugcaaacuuuagggccgggcgggugaucgacccacgucgcuguuuaaagccggugauacugacagauggcccugaacgagucauucuugcuggacccaucccaguuacucccgcgucagccgcacagagaaggggccggaucgggcgcaacccugcucaagaggacgaucaguauguguucuccggagacccacugaagaaugaugaagaccaugcccacuggacggaggcaaaaaugcucuuggauaacauuuacacccccgaggguaucauuccuacacuguucggcccggaaagagagaagacucaggccauagacggggaauuuaggcuccggggagagcagcgaaaaaccuucguagagcugaugagacgcggcgaccuuccaguguggcuaaguuauaaggucgcuagcgccgguaucucguacaaagauagggaauggugcuuuacaggggagcggaauaaccaaauucuggaagagaauauggaaguggagaucuggacccgugagggcgaaaagaagaaauugagacccaggugguuagacgcgcgcguuuaugcagauccuauggcccugaaggacuucaaagaguuugcuucuggacggaaguccaucacucucgauauucugacggaaauagccagccuucccaccuaccugucaagucgagcuaaacucgcauuggacaacaucgugaugcugcauacaacugagagaggcgggagggccuaccagcacgcucuaaaugaacugccagagucucucgagacccuuaugcuggucgccuuauugggagcaaugacagcggguaccuuccuguuuuucaugcagggcaaggggauuggaaagcucuccaugggccugaucacuauugccauggcuagcggucuucuguggaucgccgaaauacagccucaauggaucgcagcuucaauuauccucgaguuuuucuugaugguacuguuaauucccgaaccagagaaacagcgcacaccucaggauaaccagcuaaucuaugugauacugacgauucucgccaucauugggcuuaucgcagccaaugaaaugggccugauagagaagaccaaaacugacuuuggauucuaccaaguuaagacagagaccaccaucuuggauguggaccugcggccggcuagugcguggacacucuaugccgucgcaacuacgauucugacccccaugcuuagacacacaaucgaaaacacuagcgcuaaucucucccuggccgccauugcaaaccaggcugccguguugaugggccuggggaaaggauggccauuacaucguauggaucuaggcgucccucugcucgcgauggguuguuacucucaggugaaucccaccacacuuaccgcuagccugguuauguugcuggugcacuaugccaucauagggccaggacuccaggcaaaggccacuagggaggcucaaaaacggacggcagccggcauuaugaagaacccuacaguagacgguaucaccgugaucgaucuggaacccauuuccuacgacccgaaguuugagaaacagcuuggccaggucauguuacugguucucugcgcggggcaauugcugcuaaugcgcacuaccugggcuuucugugaggugcugacacucgccacuggaccaauccuuacccugugggaaggcaauccugggcgauucuggaacacaacgauagcagucucaaccgccaacauuuuuagaggaucuuauuuggcuggcgccggucuggcauucagucucaucaagaaugcucaggcccccaggcgggggacuggaacaaccggcgagacucugggugaaaaauggaagcgccaguuaaacucgcuugacagaaaagaguuugaagaguacaagaggagcggcauucuggagguggaucgaacagaagcgaaguccgcccucaaagacgggucuaagaucaaacaugcaguaucacggggaagcuccaagauacguuggaucguggagagaggcaugguuaaaccaaaggggaagguggucgaucuaggaugcggccgcgguggguggaguuacuauauggcuacccugaaaaaugugacggaagucaagggauacaccaaaggcggccccgggcacgaggaaccuauuccgauggccacauauggauggaacuuggugaagcugcauucugguguugacguauucuacaaacccacugaacagguggauacccuccuuugugacaucggcgagagcucauccaauccaacaauugaagaggggaggacucugcgggucuugaagaugguggaaccuuggcugaguagcaagcccgaguuuugcaucaaaguucucaacccuuauaugccaaccgugauugaagaguuagagaagcugcaaagaaaacacggaggcaaucuuguccgcuguccccugucuaggaacuccacacacgaaauguacugggugucaggugcaagcgggaauaucguaucgucugugaacaccacaaguaagaugcuacucaaucgauucacgacacggcauagaaaaccuaccuaugagaaggauguugaccugggagcuggcacuagguccgucagcaccgaaacagagaaaccagauaugacgauaauuggccgccguuugcagcggcugcaggaggaacacaaggagaccuggcauuacgaccaggaaaaccccuacagaacuugggccuaucacgggucauacgaggccccguccacaggaucugcgagcaguauggugaaugguguggucaagcuccuuaccaaaccuugggauguuaucccaauggugacucaacuggcuaugacagacaccacacccuuuggccagcagaggguauucaaggaaaaaguggacacucgcaccccucagccaaagcccgggacgcgaauggucaugaccacaacugcaaacugguuaugggcccuguugggcaaaaagaaguccccgcggcucugcaccagagaggaguuuaucagcaaagugaggucuaaugcugccauuggcgcaguuuuccaagaagaacaggguuggacaucagccagugaagcugugaacgauucccgcuuuugggagcuggucgacaaggaaagagcgcuacaccaggaggggaaaugugagagcugcguguauaauaugaugggaaagcgggagaagaaacuuggcgaguucggcagggccaaagggucucgugcaauaugguacauguggcugggagcucgauuucucgaguucgaggcccuggguuucuugaacgaagaucauugguuuggccgcgagaacucguggucagggguagagggagaaggccugcacagacucgguuauauccuugaggaaauugacaaaaaggauggggaccugauguacgcagaugacacugccggaugggauacccggaucacggaggacgauuuacaaaaugaggaacugauuacagagcagauggcuccucaucacaaaaucuuggccaaggcgauauucaaacucaccuaucagaacaagguugugaagguccugaggcccacuccacgcggcgcagugauggacaucauuagcagaaaagaucagcggggcuccgggcaagugggaacauacggucuaaauaccuuuacuaacauggaaguccagcuuaucaggcagauggaggccgaaggcguuauuacccaggacgacaugcaaaauccuaaggggcugaaagagcgaguggagaacuggcuccgugaaugcggaguagauagacugaagcgcauggcuaucaguggcgacgauuguguggucaaacccuuggacgagcgguucgguacaucuuuacuguuucucaaugauauggggaaggugaggaaagacauaccacagugggaacccagcaagggauggaagaacuggcaggagguuccuuucugcucccaucacuuucacaaaauuuucaugaaggauggcagaucacuuguggucccaugucgcaaucaggacgaacugaucggccgggccaggaucagucaaggggcaggauggucucuacgagagacggcuugccuggguaaagccuacgcucagauguggagccucauguauuuucauagacgggauuugaggcuggccuccauggcaauuuguucagcggugccgaccgagugguuccccacuagccgcacaaccuggucuauacacgcccaucaccaguggaugacuacagaagacaugcuuaagguauggaaccguguuuggaucgaggauaauccuaacaugauugacaaaaccccagugcacuccugggaagacauccccuaccugggcaagagagaggaucucuggugcgggaguuuaauuggacugagcucgcgagcuacgugggccaagaauauccauacagcaauaacccaggucaggaacuugaucggcaaagaagaguauguggacuacaugccuguuaugaagcgguauuccgcuccaucugagucagaaggugugcuguga

SEQ ID NO: 15694 - RNA, 9867 nt, Artificial Sequence
  derived and/or modified CDS sequence (opt3) from DENV-4__GQ868580__SS-prME
agcaccaucacacugcucugccuuauucccacuauaauggccuuccaccuguccacgagagacggcgagccuuugaugaucguggcuaagcaugaaagggggcggccauuacuguuuaaaaccacagagggaauuaacaaguguacucuaaucgcaauggaucucggugaaaugugcgaggacaccgucacauacaaauguccgcugcuuauuaauaccgaacccgaggauaucgacugcugguguaaccugacuucuacauggguuauguauggcaccugcacgcagucaggggagcgccgacgugaaaagagaaguguggccuugacuccucacagcggaaugggccucgagaccagggcggaaacauggauguccucugagggugcuuggaaacaugcccaacggguagagucguggauacugcgcaauccaggguucgcacugcucgccggauuuauggcuuacaugaucggccagacuggcauucagagaaccguguucuuugucuuaaugaugcugguggcacccucauaugggaugagguguguuggaguggguaaccgggauuucgucgaaggcgugagcgggggagccuggguagaccuuguuuuggagcacggcgguugcgugacaaccauggcucaggggaagccuacgcuggauuuugaacuaacuaagacaaccgccaaagaggucgcgcuccugcgcacuuacuguaucgaagcacuuauuaguaauaucacaaccgccacgcgaugcccaacccaaggagagcccuaucugaaggaggaacaggaccagcaguacauauguagaagggaugugguggaccggggcuggggcaacgggugcggauuguucgguaaaggcggggucguuacaugcgcuaaguuuuccuguucuggaaaaauuacuggcaaucucgugcaaaucgagaaccuggaauauaccguaguggucacagugcauaauggugauacucacgccguugggaacgacaccagcaaucacggcgugacagcaaccauuacuccucguuccccaucagucgaggugaaguuaccggauuacggagaacugacgcucgacugcgagccccgcaguggcaucgacuucaacgagaugauccuuaugaagaugaaaaagaaaacauggcugguacauaagcagugguuuuuggaucuaccucugccauggaccgcuggggccgacacuagcgaaguucacuggaauuacaaagagagaauggugaccuucaaggucccccaugcgaaaaggcaggaugugacaguccucggaucucaggaaggugccaugcacuccgcacuggcuggcgccaccgagguggacucaggggauggaaaccacauguuugcuggccaucuuaaguguaagguucggauggaaaaacugcgaauuaaggguaugagcuauacuaugugcagugggaaauucucuauagacaaggagauggccgagacacaacacggcacgaccgugguaaaagucaaguacgaaggagcaggcgccccuuguaaggugccaaucgagauucgcgauguuaauaaagaaaagguggucgggagaaucauauccagcacucccuuggcugagaacacaaacucggugaccaauauugagcucgaaccgccuuucggagacucuuauaucguaaucggugugggcaacuccgcgcugacauuacauugguuuaggaaagggucaaguauuggaaagauguucgagagcacuuaccggggcgcaaaacgcauggccauccugggugaaaccgcuugggauuuuggguccguuggcggacuauucacgucucucggcaaggccguccaccagguguuugggagcguguauaccacaauguucggaggcgucucauggaugauuagaauacugaucgguuuucuuguuuuguggauugggacuaauaguaggaacaccuccauggcaaugacaugcaucgccgugggaggcaucacucuguuccucgguuuuaccgugcaggcugacaugggcuguguagucagcuggucugggcgugagcugaagugcggaucaggcauuuucgugguugauaaugugcauacguggacagaacaauacaaauuucagcccgagaguccagcccggcuugcaagcgcgauacugaacgcucacaaggacggggucuguggaauccgauccaccacuagauuggagaaugugauguggaaacagauuacaaacgaacucaauuauguucugugggagggcggucacgacuuaaccgugguagccggggaugucaagggagugcugacuaaaggcaagagggcacuaaccccucccgugucugaccucaaguacucguggaaaacaugggguaaggccaaaaucuucacgccagaagcucgcaacagcaccuuucugauugauggccccgacacuuccgagugcccuaaugaacggagagccuggaacucacuugaggucgaggauuacggguucggaauguucacaaccaauaucuggaugaaguuuagggaaggcaguucugagguuugugaccaucgcuugaugagcgcagcuauaaaagaucagaaggccgugcacgcggacaugggguauuggaucgaauccucaaaaaaccaaacauggcagauugagcgagccagccugaucgaaguaaagacuugccucuggccaaagacccauacgcuguggucuaauggaguguuagagucccagaugcugauuccgaaaaguuacgcuggccccuucagccagcacaacuaucggcaagguuacgcaacacagaccgucgggccuuggcaccuuggaaaguuggagaucgauuuuggcgaaugcccagguacuaccgugacaauacaggaggacugugaucaucguggccccucucucagaacuaccacagccuccgggaaacugguuacgcaguggugcuguaggucaugcaccaugccuccacuacgcuuccugggagaagacggcuguugguaugggauggagauucggccccucaacgagaaggaagagaauauggugaaaagucaagucacugcuggacagagcacaucggaaaccuuuuccaugggccugcuuugcuugacucuguucguggaggaauguuuaagaaggcgaguuacacgcaagcacaugauccucgccguggucauuacccugugcgcaaucauacuuggugggcugacguggauggauuugcuccgggcgcugaucaugcuaggagacacuaugucuggcagaauuggcgggcagacccaucuggccaucauggcuguauuuaagaugagcccgggauacgugcucgguguuuuccugaggaaacuuacaucacgugagaccgccuugauggugauuggcauggcaaugacuacaaccuuuaguaucccucacgaccugauggaguuaauagaugggauuucccucggacugauccuucugaagaucgucacacaguucgacaacacucaagugggcacccuagcucucucucugacguuuauucgcagcacaauguccuugguaauggccuggcggaccaucauggcagugcuguucgucguuacuuuaauuccacucuguagaaccucaugccugcagaaacagagccauuggguggaaauaacagcccuuauccugggugcucaagcguugcccguguaucucaugacucugaugaagggggccaguaggcgaucuuggccucuaaaugagggaauuauggcagucggccuggugucccuucucggcagcgcucuguugaaaaacgauguuccccuggccgggccaaugguagccggagguuuacuccuggcugcauacgugaugucgggcucaucugccgaccuuagucuggaaaaggcggcuaauguccagugggaugagauggccgacaucaccggguccagcccuauuaucgaagugaagcaggaugaggacggaucuuuuagcauacgggauguugaggaaacgaacaugaucacauugcucgugaaacuggcacuaauuaccgucuccggccuguacccccuugccaucccagugacuaugacacucugguauauguggcagguaaagacccaacgcucaggugcucugugggacgucccgaguccugcagccacucagaaagcggcuuugagcgaggggguguacagaauuaugcagaggggauuacugggcaagacacagguuggcguggggauccacauggaaggagucuuccacaccauguggcaugugacgcgggguucuguuauaugucacgagacuggccgacucgaacccuccugggccgaugugagaaaugacaugauuucauaugggggaggcuggcgccugggugauaaaugggacagggaggaggacguccaagugcuugcaaucgaaccagggaagaaccccaagcauguacagaccaaaccuggacuguucaagacauugaccggcgagaucggcgccgugacacuagauuuuaaaccagggacuaguggaagccccauuauaaaucguaaggguaaaguuaucggccuguacgggaacggagucgugaccaaguccggcgacuaugugucugcuauuacgcaggccgaacggaucggugagccugauuacgaggucgacgaagauauuuucagaaaaaagaggcucacaaucauggaccugcacccgggggcaggaaagacuaaacgcauacuuccaucgaucguacgagaggcuuuaaagagacggcugaggacccucauuuuggcccccacacgcgugguugcggccgaaauggaggaagcacugcguggccucccuaucagauaucagaccccagcugugaaaagcgagcauacuggccgggagauugucgaucugaugugccacgccaccuuuacaacgaggcuucugucauccacucgcgugcccaauuacaacuugaucguuauggacgaagcucacuucaccgauccuaguucuguggcagcccgaggguacauaagcacaagagucgagaugggagaagccgcugcgauuuuuaugaccgcaacuccgcccggugccacagacccauucccucaauccaauucacccaucgaggauaucgaacgggagauuccagagaggucuuggaacaccggcuuugacuggaucacggacuaucaggggaagacugugugguucguaccuagcauaaaagcuggaaaugauauugccaacugccuacgcaagaguggcaagaaagugauccagcuguccagaaagacauuugacaccgaauaccccaaaaccaagcucacugauugggacuucguugucacaaccgauauuagcgagaugggugcaaacuuuagggccgggcgggugaucgacccacgucgcuguuuaaaaccggugauacugacagauggcccugaacgagucauucuugcuggacccaucccaguuacucccgcgucugccgcacaaagaaggggccggaucgggcgcaauccugcucaggaggacgaucaguauguguucucaggagacccacugaagaacgaugaagaccaugcccacuggacggaggcaaagaugcucuuggauaauauuuacacccccgaggguaucauuccuacacuguucggcccggaaagagagaaaacucaggccauagacggggaauuuaggcuccggggagagcaacgaaagaccuucguagagcugaugagacgcggcgaccuuccaguguggcuauccuauaaagucgcuagugccgguaucagcuacaaggauagggaauggugcuuuacaggggagcggaacaaucagauucuggaagagaacauggaaguggagaucuggacccgugagggcgaaaaaaagaaguugagacccaggugguuagacgcgcgcguuuaugcagauccuauggcccugaaagacuucaaggaguuugcuucgggacggaaaucuaucacucucgauauucugacggaaauagccucccuucccaccuaccugagcucacgagcuaagcucgcauuggacaauaucgugaugcugcauacaacugagagaggcgggagggccuaccagcacgcucuaaacgaacugccagagagucucgagacccuuaugcuggucgccuuauugggagcaaugacagcggguauuuuccuguuuuucaugcagggcaaagggaucggaaagcucucuaugggccugauuaccaucgccauggcuuccggucuucuguggauagccgaaauccaaccucaguggauugcagcuagcaucauucucgaguuuuucuugaugguacuguuaauccccgaaccagagaagcagcgcacuccucaggauaaucaacuaauauaugugauucugacaauccucacgauuaucgggcuuauagccgcaaacgaaaugggccugaucgagaaaaccaagacugacuuuggauucuaccagguuaaaacagagaccaccauuuuggauguggaccugcggccggccucagcuuggacacucuaugcggucgccacuacgauccugacccccaugcuuagacacacaauugaaaauacuagugcaaaccucagccuggcugccaucgccaaucaggcagcuguguugaugggccuggggaagggauggccauuacaucguauggaucuaggcgucccucugcucgccauggguuguuacucccaggugaaccccaccacacuuaccgcgucucugguuauguugcuggugcacuaugcuauaauugggccaggacuccaagccaaagcaacuagggaggcccagaagcggacggcugcaggcaucaugaaaaauccuacaguagacgguaucaccgugauugaucuggaacccaucagcuacgacccgaaguuugagaagcagcuuggccaagucauguuacugguucucugcgccgggcaguugcugcuaaugcgcacuaccugggcguucugugaggugcugacacucgcuacuggaccaauacuuacccugugggaaggcaacccugggcgauucuggaacacaacgauugccgucuccaccgcaaauaucuuuagaggaucauauuuggccggcgcuggucuggccuucucucucauuaaaaacgcacagacucccaggcgggggacaggaaccacuggcgagacacugggugaaaaguggaaacgccaguuaaauagucuugacagaaaggaguuugaagaguacaaaaggucgggcauccuggagguggaucgaaccgaagcuaagagcgcccucaaggacggguccaaaauaaagcaugcgguaucucggggaucaagcaaaauccguuggauuguggagagaggcaugguuaagccaaaagggaagguggucgaucuaggaugcggccgcggugggugguccuacuauauggccacgcugaagaacgugaccgaagucaaaggauacacaaagggcggccccgggcacgaggaaccuaucccgauggcaacuuauggauggaauuuggugaaacugcauagugguguugacguauucuacaagcccaccgagcaaguggauacacuccuuugugacauuggcgagucuagcucaaacccaacuaucgaagaggggaggacccugcgggucuugaaaaugguggaaccuuggcuguccaguaagcccgaguuuugcauuaagguucucaauccuuauaugccaacagugaucgaagaguuagagaaacugcagagaaagcacggaggcaaccuuguccgcuguccccugagcaggaauucuacccacgaaauguacuggguguccggugcuucagggaacauaguaagcucggugaauacuacgucuaaaaugcuacucaaccgauucacaacccggcauagaaagccuacuuaugagaaagauguugaccugggagccggcaccaggagugucuccacagaaacggagaagccagauaugaccauuaucggccgccguuugcagcggcugcaggaggaacacaaagagacuuggcauuacgaccaagaaaaucccuacagaacaugggcauaucacgggagcuacgaggcuccgucaaccggauccgccucuagcauggugaacgguguggucaagcuccuuacuaagccuugggauguuaucccaauggugacacagcuggccaugaccgacacaacucccuuuggccagcagaggguauucaaagaaaagguggacacccgcacgccucaaccaaaacccgggacccgaauggucaugacaacuaccgcgaauugguuaugggcucuguugggaaagaaaaagaguccgcggcucugcacaagagaggaguuuauuuccaaggugaggagcaacgcagccauaggcgcuguuuuccaggaagagcaggguuggacuucugccucagaagcagugagugauucccgcuuuugggagcuggucgacaaagaaagagcccuacaccaagaggggaagugugagagcugcguguauaauaugaugggaaaacgggaaaagaaacuuggcgaguucggcagggcuaaggggucucgugcgaucugguacauguggcugggagcccgauuucucgaauucgaggcacuggguuucuugaacgaagaucauugguuuggccgcgagaacucguggucagggguagagggagaaggccugcacagacucgguuauauucuugaggaaaucgacaagaaagauggggaccugauguacgcugaugacaccgccggaugggauacgcggauuacagaggacgauuuacagaaugaggaacugaucaccgagcagauggcaccucaucacaagauauuggccaaagcuaucuucaagcucacuuaucagaacaaaguugugaagguccugaggcccacaccacgcggcgccgugauggacauuaucagcagaaaggaucaacggggcuccgggcaggugggaaccuacagucuaaauacuuuuaccaacauggaaguccagcuuauuaggcagauggaggcggaagguguuaucacacaagacgacaugcagaauccuaaaggccugaaggagcgaguggagaacuggcuccgugaaugcgggguagauagacugaaacgcauggcaauaucuggagacgauuguguggucaagcccuuggacgagcgguucggcacgagcuuacuguuucucaaugauauggguaaagugaggaaggacauuccacagugggaacccuccaaaggguggaagaacuggcaggagguuccuuucugcucacaucacuuucacaagaucuucaugaaagauggaagaagucuuguggucccaugucgcaaucaagacgaacugaucggccgggccaggauuucucagggcgcuggguggagccuacgagagaccgccugccugggaaaggcauacgcucagauguggucccucauguauuuucauagacgggauuugaggcuggccucaauggcuauauguagcgccgugccgacugagugguuccccacaucucgcaccacuugguccauccacgcacaucaccaguggaugacaaccgaagacaugcuuaaaguauggaaccguguuuggauugaggauaauccuaacaugaucgacaagacgccagugcacaguugggaagacauucccuaccuggguaaaagagaggaucucuggugcggcagcuuaaucgggcugucgucccgagcgacaugggccaagaauauacauaccgcuaucacucaagucaggaacuugauuggaaaggaagaguauguggacuacaugccuguuaugaaacgguauucugccccaucagagagcgaaggcgugcuguga

SEQ ID NO: 15695 - RNA, 9867 nt, Artificial Sequence
  derived and/or modified CDS sequence (opt3) from DENV-4__GQ868583__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucaugauaggugucggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccgugcaccaggucuuugggucuguuuauacaacuauguucggaggcgugagcuggaugaucagaauucugaucgguuuucuuguguuguggauugggaccaauucaaggaacacaaguauggcaaugacuugcauagccguaggaggcaucacccuguuccucgguuuuacgguccaggcugacaugggcugugugguuuccuggagcgggcgugagcugaagugcggaucuggcauuuucguggucgauaaugugcauacauggaccgaacaauacaaauuucagcccgagucaccagcccggcuugcaagugcgauccugaacgcucacaaggacgggguuuguggaauccgaagcacuacaagauuggagaaugugauguggaaacagauuaccaacgaacucaauuauguacugugggagggcggucacgacuuaacugucguggccggggaugugaagggaguccugaccaaaggcaagagggcacuagccccucccgcuuccgaccucaaguacucuuggaaaacaugggguaaggccaaaauauucacgccagaagcacgcaacucgaccuuucugaucgauggccccgacacuagcgagugcccuaaugaacggagagcuuggaacuccuucgagguugaggauuacggguucggaauguuuacaaccaauauuuggaugaaguucagggaaggcucaagugaggugugugaccaucgccuuaugucugccgcgaucaaagaucagaaggccguacacgcugacaugggguauuggauugaaagcuccaaaaaccaaacauggcagaucgagcgagcaucauugauagaagugaagacuugccuguggccaaagacccauacgcucuggagcaauggaguccuggagucucagauguuaaucccgaaauccuacgccggccccuuuagucagcacaacuaucggcaagguuacgcuacacagaccguggggccuuggcaccugggaaagcuugagauugauuucggcgaaugcccagguacuaccguuacaauccaggaggacugugaucaucguggccccagcuugagaacuaccacagccucugggaaacucgugacgcaguggugcuguagguccugcaccaugccuccacugcgcuuucuaggagaagacggcuguugguaugggauggagauucggccccugucagagaaggaagagaacauggucaaaagucaagugacugcaggacagggcacaagcgaaaccuucucgaugggucuccugugccuuacuuuguuuguugaggaaugucugagaaggcgagugacacgcaagcacaugaucuuagcggucguaauaacccucugcgccauuauccuggggggacuuacguggauggaucuguugcgggcucucauuaugcugggcgacacuauguccggcagaaucgggggacagacccaucuagccauaauggcaguguucaagaugucuccggguuacguucugggcguguuucucaggaaacugacaagccgugagaccgcucuuauggucaucgggauggccaugacuacaaccuugucaauuccucacgaccugauggaguuaaucgauggaauuagucucggccugauccuucugaagauagugacacaguucgacaauacucaaguagguacccuagcacucucccugacguuuauucgcucuacaaugagcuuggugauggccuggcggaccaucauggcuguccuguucguugugacuuuaaucccacucuguagaaccuccugccugcagaaacagucacauuggguggaaauuacagcgcuuauccugggggcccaagcauugcccgucuaucucaugacucugaugaagggagcuagcaggcgaaguuggccucuaaacgagggcauuauggccgugggccugguuucucuucucggguccgcccuguugaaaaaugauguaccccuggcuggaccaaugguggcagguggcuuacuccuggccgcguacgucaugagcgggucgucagcugaccuuucucuggaaaaggccgcaaacgugcagugggaugagauggccgacauaaccggaaguuccccuaucauugaaguuaagcaggaugaggacggcagcuuuucuauccgggauguggaggaaacgaauaugauuacauugcucgucaaacuggcucuaaucaccgugagcggucuguacccccuugcaauaccaguaacuaugacacucugguauauguggcaggucaagacccaacgcuccggggcccugugggacgugccgucaccugcggcuacucagaaagccgcauugagugagggaguuuacagaaucaugcagaggggcuuauucggcaagacacaggugggggucggaauucacauggaagguguguuccacaccauguggcauguuacgcggggcagcgugaucugucacgagacugggcgacuggaacccucuugggccgaugucagaaacgacaugauuuccuauggaggcgguuggcgccucggggauaaaugggacaaggaggaggacgugcaaguacuggcuaucgaaccaggaaagaaucccaaacaugugcagaccaagccuggccuuuuuaaaacacugaccggcgagauaggggccguuacauuggauuucaagccaggaacuucagguagucccauuaucaacaggaaaggcaaggucaucgggcuauacggaaauggcguggugaccaaaagcggugacuaugucuccgcaauuacgcaggcugaacguauaggggagccugauuacgagguagacgaagauaucuuucggaagaagagacugacaauuauggaccuccacccgggagccggcaaaacuaagaggauccugccaucuauugugcgcgaggcgcuuaaacgaagauuacggacccugauccucgcccccacaaggguuguggcagcugaaauggaggaagccuugcgcggccugccuauacguuaucagaccccagcugucaagucggagcauacugggagagagaucguggaucucaugugccacgcaaccuucacaacgcggcugcuuagcucaacuaggguucccaacuacaaucugauugugauggacgaagcccacuuuaccgauccuuccagugucgccgcucgcggauacaucucuacacgaguggagaugggugaagcggcagccauuuucaugaccgcuacuccgcccggcgccacagacccauuuccucaaagcaacucccccaucgaggauauagaaagagagauuccagagcggucauggaauaccggguucgacuggaucacggacuaucagggaaaaacuguaugguuugugccuucuaucaaggcaggcaacgauauugccaauugcuugaggaagagcgguaaaaagguuauccagcuaagucgcaaaacauucgacaccgaauaccccaagaccaaacugacugauugggacuuugucgugacaaccgauauauccgagaugggggcuaacuucagagcgggcagggugauugacccacggcguugucucaagccggucaucuuaacagauggaccugaacgcguuauucuggccggccccaucccagugacucccgcaagcgcugcccaacgaagagggaggauaggacggaacccugcacaggaggacgaucaguauguauucucuggugacccacuuaagaaugaugaagaccaugcccacuggacggaggcuaaaaugcugcucgauaacauuuacacccccgagggcaucaucccuacauuguuugggccggaacgcgagaagacucaggccauugacggagaauucagacugaggggcgagcaacggaaaaccuuuguggagcucaugcgaagaggugaccugccagucuggcuuucauauaagguggcguccgcagggaucaguuacaaagaucgcgaauggugcuucacaggcgagaggaauaaccagauucuagaagagaauauggaaguugagauauggacccgggagggagaaaagaagaaacugcgucccaagugguuggacgccagaguguaugcugauccuauggccuuacaggacuuuaaagaguucgcuagcggcaggaagucgaucacucuggauauucucacggaaaucgcaucucugcccaccuaccuuuccagccgcgccaaacuggcucucgacaacaucgucauguugcauacaacugagcgggggggacgagccuaccagcacgcacugaaugaacuaccagagucacuggagacccucaugcuuguagcgcuguuaggugccaugacagcuggcauuuuuuuguucuuuaugcaagggaagggaauaggcaagcugaguaugggucucaucaccauugccguggcaucugggcugcuuuggguugcugaaauccagccucaguggauugccgcauccaucauacuggaguucuuucucaugguguugcugauccccgaaccagagaaacagagaacuccucaagauaaccaguuaauuuaugucauccuaacaauucugacgaucauaggccucauugccgcuaaugaaaugggacuuaucgagaagaccaaaacugacuucggcuuuuaccaggugaagacagagaccaccauucuggaugucgacuugaggccggcgagcgccuggacacuguaugcaguggcuacuacgauccucacccccaugcugcgccacacaauagaaaacacuucagccaaucuuagucucgccgcaaucgcuaaccaggccgcgguucugaugggguugggaaaaggcuggccacugcaucggauggauuuaggugugccucuacuggcuaugggguguuacagccaaguaaaucccaccacacucaccgccucccuugugaugcuguugguccacuaugcaauuaucggaccaggccugcaggccaaggcuacuagagaggcacagaaacguacggccgcggguauuaugaagaacccuacaguugacggcaucaccgugauagaucucgaacccauuucuuacgacccgaaguucgagaaacaacuggggcaggucaugcuuuuagugcugugcgcuggacagcucuugcugaugaggacuaccugggccuucugugagguacuaacacuggcaacuggcccaauccucacccuuugggaagggaauccuggacgguuuuggaacacaacgaucgccgugagcaccgcuaacauuuuccgcggcuccuaucuggccggugcaggguuggcuuuuucacugaucaagaaugcccagacuccccgaagaggaacaggcaccacuggugagacacucggcgaaaaauggaagaggcaacugaacucuuuagaccggaaagaguucgaagaguacaagcgcagugggauacuugagguugauagaaccgaagcgaagucggcccugaaagacggaagcaagauuaaacaugcaguguccaggggcucuucaaagauccgauggauugucgagcgggggauggugaaaccaaagggaaaggucguggaucucggcugcggucgugggggauggagcuacuauauggcuacgcuaaaaaauguuaccgaaguaaagggcuacacaaaaggcgggcccggacacgaggaaccuaucccgauggccacuuaugguuggaaccuggugaaguugcauuccggcgucgacguguuuuacaaacccaccgagcagguugauacacugcucugugacauaggggagaguucuagcaauccaacuaucgaagagggaagaacccuucgcgugcugaagauggucgaaccuugguugucauccaagcccgaguucugcauuaaagugcugaacccuuauaugccaacaguaaucgaagagcucgagaaguuacagaggaaacacggcgguaaucuggugcgguguccccuuaguagaaacagcacccacgaaauguacuggguuucuggggcauccggaaauauugucucaagcgugaacacuacgucgaagaugcugcuaaaucgcuuuacaaccaggcaucgaaaaccuacuuaugagaaggauguggaccucggcgcuggcacccggucugucaguacagaaacggagaaaccagauaugaccaucauugggagaaggcugcagcgcuugcaagaggaacacaaggagacuuggcauuacgaccaggaaaaccccuaccguacaugggccuaucacggauccuacgaggccccgagcaccgguucagcguccucuaugguuaauggcgugguaaagcugcucacuaaaccuugggaugugaucccaauggucacacagcuugcuaugaccgacacaacucccuucgggcagcaacggguguuuaaggaaaaaguugacaccagaacgccucagccaaagcccggaaccaggauggugaugacaacuaccgcaaacuggcugugggccuuacugggcaaaaagaagaauccgcgcuugugcacacgagaggaguucauaagcaaaguccggaguaacgcugccauuggugcaguguuucaggaagagcaaggguggacuuccgccagcgaagcuguaucugauucaagauucugggagcucguugacaaggaaagggcgcugcaccaggagggaaaaugugagaguugcguguauaauaugaugggcaagcgcgaaaaaaagcuaggcgaguuugggagagccaagggaucccgggcaaucugguacauguggcuuggugcuagguuccuggaauucgaggcccucggcuuucugaacgaagaucauugguucgggcgugagaacagcuggucuggagucgagggcgaagguuugcaccgacugggguauauccucgaggaaauugacaaaaaggauggagaccuuauguacgcagaugacaccgccggcugggauacgcgcauaacagaggacgaucugcagaaugaggaauuaaucaccgagcagauggcuccucaucacaaaauucuggccaaggcgaucuuuaaauugacuuaucaaaacaagguggugaagguccucagacccacaccacggggcgcaguuauggacauuaucucgaggaaagaucagcgcgggucaggacagguggguaccuacggccugaauacuuucaccaacauggaaguacagcuaauaagacaaauggaggccgaaggggugaucacacaggacgacaugcagaauccuaagggacuuaaagagcgggucgagaaguggcugagggaaugcggcguggaucgacucaaacguauggcuauuagcggugacgauuguguugugaagccccuggacgagagauuugggacguccuuguuauuccugaacgauaugggaaaaguccgcaaggacaucccacagugggaacccaguaagggcuggaaaaauuggcaagaggugccuuuuugcucucaucacuuccacaagauuuuuaugaaagauggccggagccucguaguuccauguaggaaccaggacgaacuuaucgggagagcccgcauaucccagggagcagguuggucacugcgggagaccgcuugccuaggcaaggccuacgcucagauguggagucugauguauuuccauaggcgagaucucagauuggccucuauggcaauuuguagcgcggugccgacugagugguuucccacaucccggaccacuuggucaauccacgcccaucaccaauggaugacaaccgaagacaugcugaaagucuggaauaggguguggaucgaggauaacccuaauaugauugacaagacgccaguucacagcugggaagacauacccuaccuugggaagcgcgaggaucuguggugcggaucucucaucggcuuauccagucgugcuacaugggccaaaaacauucauaccgcaaucacucaggugagaaaucugauugguaaggaagaguaugucgacuacaugccugugaugaaacgauauagcgcuccaucggaguccgaagggguauuguga

SEQ ID NO: 15696 - RNA, 9867 nt, Artificial Sequence
  derived and/or modified CDS sequence (opt3) from DENV-4__GQ868584__SS-prME
ucaaccaucacacugcucugccuuauucccacugugauggccuuccaccuguccacgagagacggcgagccuuugaugauagucgcuaagcaugaaagggggcggccauuacuguuuaagaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauucagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggacagacaguacauuuguaggcgggaugucguugaccguggcuggggcaacgggugcggauuguucgguaaaggcggggugguaacaugcgcuaaguuuuccuguucuggaaaaaucacuggcaaucucgugcagauagagaaccuggaauauaccgucgugguuacagugcauaauggugauacucacgccgucgggaacgacaccagcaaucacggcgugacagcaaccauuacuccucgcuccccaucaguagagguuaaguuaccggauuacggagaacugacgcucgacugcgagcccagaaguggcaucgacuucaacgagaugauucuuaugaagaugaaaaagaaaacauggcuggugcauaagcaaugguuuuuggaucuaccucugccauggaccacuggggcugacaccagcgaaguccacuggaauuacaaagagaggauggugacauucaaggucccccaugccaaacggcaggaugugaccguucucggaucucaggaaggugcgaugcacuccgcccuggcaggcgcuacugagguggacucaggggauggaaaccacauguuugccggccaucuuaaguguaagguacgaauggaaaaacugcgcaucaaggguaugagcuauacaaugugcagugggaaauucucuaucgacaaggagauggcugagacgcagcacggcaccacugucgugaaaguuaaguacgaaggagccggcgcaccuuguaaggugccaauugagauaagagaugucaauaaagaaaaggugguagggagggugaucuccgccacacccuuggcugagaacaccaacagcguuacaaauauugagcucgaaccgccuuucggagacucguauaucaugauaggugucggcaacucugcgcugacuuuacauugguuucggaaaggguccucaauuggaaagauguucgagaguaccuaccgcggcgcaaaaagaauggccauccugggugaaacggcuugggauuuugggagcgugggcggacuauucaccucccucggcaaggccgugcaccaagucuuugggucuguuuauacaacuauguucggaggcgugagcuggaugaucaggauucugaucgguuuucuuguguuguggauugggaccaauucacguaacacaaguauggcaaugacuugcauagccguaggaggcaucacccuguuccucgguuuuacgguccaggcugacaugggcugugugguuuccuggagcgggcgggagcugaagugcggaucuggcauuuucguggucgauaaugugcauacauggaccgaacaguacaaauuucaacccgagucaccagcccgacuugcaagugcgauccugaacgcucacaaggacgggguuuguggaaucagaagcacuacaagguuggagaaugugauguggaaacagauuaccaacgaacucaauuauguacugugggagggcggucacgacuuaacugucguggccggggaugugaagggaguccugaccaaaggcaagcgcgcacuagccccucccgcuuccgaccucaaguacucuuggaaaacaugggguaaggccaaaauauucacgccagaagcacggaacucgaccuuucugaucgauggccccgacacuagcgagugcccuaaugaaagaagggcuuggaacuccuucgagguugaggauuacggguucggaauguuuacaaccaauauuuggaugaaguuccgcgaaggcucaagugaggugugugaccaucgacuuaugucugccgcgaucaaagaucagaaggccguacacgcugacaugggguauuggauugaaagcuccaaaaaccagacauggcaaaucgagcgggcaucauugauagaagugaagacuugccuguggccaaagacccauacgcucuggagcaauggaguccuggagucucagauguuaaucccgaaauccuacgccggccccuuuagucagcacaacuaucgucaggguuacgcuacacaaaccguggggccuuggcaccugggaaaacuugagauugauuucggcgaaugcccagguacuaccguuacaauccaggaggacugugaucauagaggccccagcuugaggacuaccacagccucugggaaacucgugacgcaguggugcugucgcuccugcaccaugccuccacugcgguuucuaggagaagacggcuguugguaugggauggagauuagaccccugucagagaaggaagagaacauggucaaaagucaggugacugcaggacaaggcacaagcgaaaccuucucgaugggucuccugugccuuacuuuguuuguugaggaaugucugaggcgacgcgugacacggaagcacaugaucuuagcggucguaauaacccucugcgccauuauccuagggggccuuacguggauggaucuguugagagcucucauuaugcugggcgacacuauguccggcaggaucgggggacagacccaucuagccauaauggcaguguucaagaugucuccggguuacguucugggcguguuucuccguaaacugacaagccgcgagaccgcucuuauggucaucgggauggccaugacuacaaccuugucaauuccucacgaccugauggaguuaaucgauggaauuagucucggccugauccuucugaagauagugacacaguucgacaauacucagguagguacccuagcacucucccugacguuuauucggucuacaaugagcuuggugauggccuggagaaccaucauggcuguccuguucguugugacuuuaaucccacucuguaggaccuccugccugcaaaaacagucacauuggguggaaauuacagcgcuuauccugggggcccaggcauugcccgucuaucucaugacucugaugaagggagcuagccgacggaguuggccucuaaacgagggcauuauggccgugggccugguuucucuucucggguccgcccuguugaaaaaugauguaccccuggcuggaccaaugguggccgguggauuacuccuggcagcguacgucaugagcgggucgucagcugaccuuucucuggaaaaggccgcaaacgugcaaugggaugagauggccgacauaaccggaaguuccccuaucauugaaguuaagcaggaugaggacggcagcuuuucuauccgcgauguggaggaaacgaauaugauuacauugcucgucaaacuggcucuaaucaccgugagcggucuguacccccuugcaauaccaguaacuaugacacucugguauauguggcaggucaagacccagagauccggggcccugugggacgugccgagcccugcggcuacucaaaaagccgcauugagugagggaguuuacaggaucaugcagcggggcuuauucggcaagacacaggugggggucggcauucacauggaagguguguuccacaccauguggcauguuacgcgaggcagcgugaucugucacgagacugggagacuggaacccucuugggccgauguccgcaacgacaugauuuccuauggaggcgguuggaggcucggggauaaaugggacaaggaggaggacgugcagguacuggcuaucgaaccaggaaagaaucccaaacaugugcaaaccaagccuggccuuuuuaaaacacugaccggcgagauaggggccguuacauuggauuucaagccaggaacuucagguagucccauuaucaaccguaaaggcaaggucaucgggcuauacggaaauggcguggugaccaaaagcggugacuaugucuccgcaauuacgcaggcugaacggauaggggagccugauuacgagguagacgaagauaucuuuagaaagaagaggcugacaauuauggaccuccacccgggagccggcaaaacuaagcgcauccugccaucuauugugcgagaggcgcuuaaaagacgguuaaggacccugauccucgcccccacacgcguuguggcagcugaaauggaggaagccuugcguggccugccuauaagauaucagaccccagcugucaagucggagcauacugggcgggagaucguggaucucaugugccacgcaaccuucacaacgaggcugcuuagcucaacucgcguucccaacuacaaucugauugugauggacgaagcccacuuuaccgauccuuccagugucgccgcucgaggauacaucucuacaagaguggagaugggugaagcggcagccauuuucaugaccgcuacuccgcccggcgccacagacccauuuccucagagcaacucccccaucgaggauauagaacgggagauuccagagaggucauggaauaccggguucgacuggaucacggacuaucaaggaaaaacuguaugguuugugccuucuaucaaggcaggcaacgauauugccaauugcuugcgcaagagcgguaaaaagguuauccagcuaaguagaaaaacauucgacaccgaauaccccaagaccaaacugacugauugggacuuugucgugacaaccgauauauccgagaugggggcuaacuucagggcgggccgggugauugacccacgucgcugucucaagccggucaucuuaacagauggaccugaacgaguuauucuggccggccccaucccagugacucccgcaagcgcugcccagagaagggggcggauaggacgcaacccugcacaagaggacgaucaguauguauucucuggugacccacuuaagaaugaugaagaccaugcccacuggacggaggcuaaaaugcugcucgauaacauuuacacccccgagggcaucaucccuacauuguuugggccggaaagagagaagacucaggccauugacggagaguucaggcugcggggcgagcagcgaaaaaccuuuguggagcucaugagacgcggugaccugccagucuggcuuucauauaagguggcguccgcagggaucaguuacaaagauagggaauggugcuucacaggcgagcggaauaaccaaauucuagaagagaauauggaaguugagauauggacccgugagggagaaaagaagaaacugagacccaagugguuggacgccaggguguaugcugauccuauggccuuaaaagacuuuaaggaguucgcuagcggccgcaaaucgaucacucuggauauucucacggaaaucgcaucucugcccaccuaccuuuccagccgggccaagcuggcucucgacaacaucgucauguugcauacaacugagcgagggggcagagccuaccagcacgcacugaaugaacuaccagagucacuggagacccucaugcuuguagcgcuguuaggugccaugacagcuggcauauuuuuguucuuuaugcaggggaagggaauaggcaaacugaguaugggucucaucaccauugccguggcaucugggcugcuuuggguugcugaaauccagccucaauggauugccgcauccaucauacuggaguucuuucucaugguguugcugauccccgaaccagagaagcagaggacuccucaggauaaccaguuaauuuaugucauccuaacaauucugacgaucauaggccucauugccgcuaaugaaaugggacuuaucgagaaaaccaagacugacuucggcuuuuaccaagugaaaacagagaccaccauucuggaugucgacuugcgcccggcgagcgccuggacacuguaugcaguggcuacuacgauccucacccccaugcugcggcacacaauagaaaacacuucagccaaucuuagucucgccgcaaucgcuaaccaggccgcgguucugaugggguugggaaagggcuggccacugcauagaauggauuuaggugugccucuacuggcuaugggguguuacagccagguaaaucccaccacacucaccgccucccuugugaugcuguugguccacuaugcaauuaucggaccaggccugcaggccaaagcuacucgugaggcacaaaagaggacggccgcggguauuaugaagaacccuacaguugacggcaucaccgugauagaucucgaacccauuucuuacgacccgaaauucgagaagcagcuggggcaggucaugcuuuuagugcugugcgcuggacaacucuugcugaugcggacuaccugggccuucugugagguacuaacacuggcaacuggcccaauccucacccuuugggaagggaauccuggacgcuuuuggaacacaacgaucgccgugagcaccgcuaacauuuuccgaggcuccuaucuggccggugcaggguuggcuuuuucacugaucaaaaaugcccagacucccagaaggggaacaggcaccacuggugagacacucggcgaaaaguggaaacggcagcugaacucuuuagaccgcaaggaguucgaagaguacaagagaagugggauacuugagguugauaggaccgaagcgaaaucggcccugaaggacggaagcaaaauuaagcaugcagugucccgaggaucuucaaaaauccgguggauugucgagcgugggauggugaagccaaagggaaaagucguggaucucggcugcgguagagggggauggagcuacuauauggcuacgcuaaagaauguuaccgaaguaaaaggcuacacaaagggcgggcccggacacgaggaaccuaucccgauggccacuuaugguuggaaccuggugaaauugcauuccggcgucgacguguuuuacaagcccaccgagcagguugauacacugcucugugacauaggggagaguucuagcaauccaacuaucgaagagggacgcacccuuagggugcugaagauggucgaaccuugguugucauccaaacccgaguucugcauuaaggugcugaacccuuauaugccaacaguaaucgaagaacucgagaaauuacaacggaagcacggcgguaaucuggugagauguccccuuagucgcaacagcacccacgaaauguacuggguuucuggggcauccggaaauauugucucaagcgugaacacuacgucgaaaaugcugcuaaauagguuuacaacccgacaucggaagccuacuuaugagaaagauguggaccucggcgcuggcaccagaucugucaguacagaaacggagaagccagauaugaccaucauugggaggcgccugcagcguuugcaggaggaacacaaggagacuuggcauuacgaccaggaaaaccccuaccggacaugggccuaucacggauccuacgaggccccgagcaccgguucagcguccucuaugguuaauggcgugguaaaacugcucacuaagccuugggaugugaucccaauggucacacaacuugcuaugaccgacacaacucccuucgggcagcagagaguguuuaaagaaaagguugacaccaggacgccucagccaaaacccggaacccgcauggugaugacaacuaccgcaaacuggcugugggccuuacugggcaagaagaaaaauccgcgauugugcacacgggaggaguucauaagcaaggucagaaguaacgcugccauuggugcaguguuucaagaagaacagggguggacuuccgccagcgaagcuguaucugauucaagguucugggagcucguugacaaagaacgcgcgcugcaccaggagggaaagugugagaguugcguguauaauaugaugggcaaaagagaaaagaagcuaggcgaguuugggcgggccaaaggauccagggcaaucugguacauguggcuuggugcucguuuccuggaguucgaggcccucggcuuucugaacgaagaucauugguucgggcgagagaacagcuggucuggagucgagggcgaagguuugcaccgccugggguauauccucgaggaaauugacaagaaagauggagaccuuauguacgcagaugacaccgccggcugggauacgagaauaacagaggacgaucugcaaaaugaggaauuaaucaccgagcagauggcuccucaucacaagauucuggccaaagcgaucuuuaaguugacuuaucagaacaagguggugaaaguccuccggcccacaccaaggggcgcaguuauggacauuaucucgcgcaaggaucagagagggucaggacaaguggguaccuacggccugaauacuuucaccaacauggaaguacagcuaauacggcagauggaggccgaaggggugaucacacaggacgacaugcaaaauccuaaaggacuuaaggagagggucgagaaauggcugcgagaaugcggcguggaucgucucaagagaauggcuauuagcggugacgauuguguugugaaaccccuggacgagcgcuuugggacguccuuguuauuccugaacgauaugggaaagguccggaaggacaucccacagugggaacccaguaaaggcuggaagaauuggcaggaggugccuuuuugcucucaucacuuccacaaaauuuuuaugaaggauggcaggagccucguaguuccauguagaaaccaggacgaacuuaucgggcgcgcccggauaucccaaggagcagguuggucacugagggagaccgcuugccuaggcaaagccuacgcucagauguggagucugauguauuuccaucgaagagaucuccgguuggccucuauggcaauuuguagcgcggugccgacugagugguuucccacauccaggaccacuuggucaauccacgcccaucaccaguggaugacaaccgaagacaugcugaaggucuggaaucgcguguggaucgaggauaacccuaauaugauugacaagacgccaguucacagcugggaagacauacccuaccuugggaaacgugaggaucuguggugcggaucucucaucggcuuauccaguagagcuacaugggccaagaacauucauaccgcaaucacucaggugcgaaaucugauugguaaagaagaguaugucgacuacaugccugugaugaagagguauagcgcuccaucggaguccgaagggguauuguga

SEQ ID NO: 15697 - RNA, 9867 nt, Artificial Sequence
  derived and/or modified CDS sequence (opt3) from DENV-4__GQ868585__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggaugaaaaccacauguuugccggacaucuuaaguguaagguacggauggagaaacugcgaaucaagggcaugagcuauacaaugugcagugguaaauucucuaucgacaaggagauggcugaaacgcaacacgggaccacugucgugaaaguuaaguacgagggcgccggagcaccuuguaaggugccaauugaaauacgcgaugucaauaaagagaaggugguaggcagagugaucuccgccacacccuuggcugagaacaccaacagcguuacaaauauugaacucgagccgccuuucggggacucguauaucgucauaggaguggguaacucugcgcugacuuuacauugguuuaggaaaggcuccucaauugggaagauguucgaaaguaccuaccggggagcaaaacgcauggccauccugggcgagacggcuugggauuuugguagcguggggggccuauucaccucccucggaaaggccguccaccagguuuuuggcucuguguauacaacuauguucgggggagugagcuggaugaucagaauucugaucggcuuucuuguauuguggauugguaccaauucaaggaacacaaguauggcaaugacuugcauagccgucgggggaaucacccuguuccucggcuuuacggugcaggcugacauggguuguguuguguccuggagcggccgugaacugaagugcgggucuggaauuuucgucguggauaauguucauacauggaccgagcaauacaaauuucagcccgagucaccagcccggcuugcaagugcgauccugaacgcucacaaggacggcgugugugggauccgaagcacuacaagauuggaaaauguaauguggaaacagauuaccaacgagcucaauuauguccugugggaaggaggccacgacuuaacugugguggccggugaugucaaggggguucugaccaaaggaaagagggcacuaacaccucccgccuccgaccucaaguacucuuggaaaacguggggcaaggcuaaaauauucaccccagaggcccgcaacucgacuuuucugaucgauggucccgacacaagcgaaugcccuaaugagcggagagcauggaacuccuucgagguggaagauuacggcuucgggauguuuaccacaaauauuuggaugaaguucagggagggaucaagugaaguaugugaccaucgccuuaugucugcugccaucaaagaucagaaggcggugcacgccgacaugggcuauuggauugagagcuccaaaaaccaaacuuggcagaucgaacgagcuucauugauagaggucaagaccugccuguggccaaagacgcauacacucuggagcaauggggugcuggagucucagauguuaaucccgaaauccuacgcaggacccuuuagucagcacaacuaucggcaaggcuacgccacccagacuguugguccuuggcaccuggggaagcuugaaauugauuucggagagugcccaggcaccacagugacuauccaggaaaacugugaccaucguggucccagcuugagaaccacaacggcuucuggcaaacucgucacccaguggugcuguagguccugcacuaugccuccacugcgcuuucuaggggaggauggauguugguauggcauggagauucggccccugucagaaaaggaggaaaauauggugaaaagucaaguuacagccgggcagggaaccagcgagacuuucucgaugggccuccugugccuuacauuguuuguggaagagugucugagaaggcgagucacccgcaagcacaugaucuuagcaguagugauaacgcucugcgcgauuauccugggugggcuuacuuggauggaccuguugcgggcccucauuaugcugggagauaccauguccggcagaaucggcgggcagacacaucuagcuauaauggccguuuucaagaugucuccgggauacgugcugggugucuuucucaggaaacugaccagccgugagacugcacuuauggugaucggcauggcuaugacaaccacauugucaauuccucacgaccugauggaauuaaucgacgggauuagucucggacugauccuucugaagauaguaacucaguucgauaacacccaagugggcacgcuagcccucucccugacauuuauucgcucuaccaugagcuuggucauggcauggcggacuaucauggccguucuguucguggugaccuuaaucccacucuguagaacauccugccugcagaaacagucacauugggucgagauuacugcucuuauccugggugcgcaagccuugcccguguaucucaugacccugaugaagggggcaagcaggcgaaguuggccucuaaaugaaggaauuauggcuguuggccugguaucucuucucggcuccgcccuguugaaaaacgacgugccccuggccgggccaauggucgcuggagguuuacuccuggcagccuacgugaugagcggcucgucagcggaucuuucucuggagaaggcugccaauguucagugggacgaaauggcagauauaacggggaguuccccuaucauugaggugaagcaggacgaggauggaagcuuuucuauccgggacgucgaagagacaaacaugauuaccuugcucgugaaacuggcccuaaucacuguaagcggccuguacccccuugcuauaccaaucacaaugacccucugguauauguggcaggucaagacucaacgcuccggugcacugugggaugugccgucaccugccgcgacacagaaagcugccuugagugaagggguuuacagaauuaugcagaggggauuauucggcaagacccaggugggcgucgggauccacauggagggaguguuccacacgauguggcauguuacucgggguagcgugauuugucacgaaaccggccgacuggagcccucuugggcagacgucagaaaugauaugaucuccuaugggggaggcuggcgccucggugacaaaugggauaaggaggaagacgugcaaguacuggccauagagccagggaagaaccccaaacaugugcagacaaagccuggacuuuuuaaaacccugacaggcgaaauuggcgcuguuacuuuggacuucaagccagggaccucaggaagucccaucaucaauaggaaagguaaggucauuggccuauacgggaacggaguggugacgaaaagcggcgauuaugucuccgccauaacacaggcagagcguaucggugagccugacuacgaaguagaugaggacauuuuucggaagaagagacugacuaucauggaucuccacccgggggcuggaaaaaccaagaggauucugccaucuaucgugcgcgaagcccuuaaacgaagauuacggacacugauacucgcgcccaccaggguuguggccgcagagauggaagaggcuuugcgcggccugccuauccguuaucagacuccagccgucaagucggagcauaccggcagagaaauuguggaccucaugugccacgcuacauucacgacucggcugcuuagcucaaccaggguucccaauuacaaccugaucgugauggaugaggcacacuuuacagacccuuccagugucgccgcccgcggguacauuucuacccgaguggaaaugggagaggcugcggcaaucuucaugacugccacaccgcccggugcuaccgauccauuuccucaaagcaauucccccauagaagacauugagagagagaucccagaacggucauggaacacgggcuucgauuggaucacugacuaucaggggaaaacaguaugguuugugccuucuauuaaggccggaaaugacaucgcaaacugcuugaggaagagcggcaaaaagguuauacagcuaagucgcaaaaccuucgauaccgaguaccccaagacuaaacugacagacugggauuuugucgugaccacagacauuuccgaaaugggugccaacuucagagcugggagggugaucgauccacggcguugucucaagccggucauuuuaacugacggcccugagcgcguuauccuggcgggacccauaccagugacgcccgccagcgcagcucaacgaagaggcaggauugggcggaauccugcccaggaagaugaccaguauguauucucuggagauccacuuaagaacgacgaggaucaugcacacuggaccgaggccaaaaugcugcucgacaauaucuacacacccgaagguaucauuccuacuuuguuuggcccggagcgcgaaaagacccaggcuaucgauggggaguucagacugaggggagagcaacggaaaacauuuguggaacucaugcgaagaggcgaccugccagucuggcuuucauauaagguggccuccgcggguauuaguuacaaagaccgcgaguggugcuucaccggggaaaggaacaaucagauacuagaggaaaacauggagguugagaucuggacucgggaaggcgagaagaagaaacugcgucccaagugguuggaugcaagaguguaugccgacccuauggcuuuaaaagauuuuaaggaauucgccagcggaaggaaaucgauuacgcuggacauccucaccgagaucgcuucucugcccacauaccuuuccagccgcgcaaagcuggcccucgauaauauugucauguugcauacuaccgaacggggcgggcgagcuuaccagcacgcccugaacgagcuaccagagucacuggaaacacucaugcuuguagcacuguuaggagcgaugaccgccgguauauuuuuguucuuuaugcagggcaaggggaucggaaaacugaguaugggccucauuacuaucgcuguggccucuggucugcuuuggguugcagagauucaaccucaguggaucgcugccuccauaauccuggaauucuuucucaugguguugcugauucccgagccagaaaagcagagaacaccucaggacaaucaauuaaucuaugucauucuaacgauccugaccauaauugggcucaucgcagccaacgagaugggccuuauugagaaaacuaagacagauuucggauuuuaccaggugaaaaccgaaaccacaauccuggacgucgauuugaggccggcuagcgcguggacucuguaugccguggcaacgaccauacucacacccaugcugcgccacacuaucgagaauaccucagcuaaccuuagucucgccgccauugcaaaucaggcugccguucugaugggcuuggggaagggauggccacugcaucggauggacuuaggcgugccucuacuggcgauggguuguuacagccagguaaaccccacaacccucacugcuucccuugugaugcuguugguccacuaugccaucauugggccaggacugcaagcaaaagccacgagagaagcucagaagcguacagcagccggcaucaugaagaauccuaccguugaugguauaacugugauugaccucgagcccaucucuuacgauccgaaauucgagaagcagcugggccaagucaugcuuuuagugcugugcgcggggcagcucuugcugaugaggaccacaugggcuuucugugaaguacuaacucuggccaccggaccaauccucacacuuugggagggcaacccugggcgguuuuggaacacgaccauugcagugagcacugccaauaucuuccgcggauccuaucuggcuggcgccgguuuggcauuuucacugauaaaaaacgcucagacaccccgaagagggaccggaacuacaggcgaaacccucggugagaaguggaaaaggcagcugaauucuuuagaccggaaggaauucgaggaguacaagcgcaguggcauucuugaaguugacagaacggaggccaaaucggcgcugaaggaugggagcaaaaucaagcaugccguguccaggggaucuucaaaaauucgauggaucgucgaacggggcauggugaagccaaaggggaaagucauagaccucggaugcggccgugguggguggagcuacuauauggcaacccuaaagaacgugacagagguuaaaggauacacuaagggcggccccgggcacgaagagccuaucccgauggcuaccuauggauggaaucugguaaaauugcauuccgguguggaugucuuuuacaagcccacagagcaaguggacacucugcucugugauauuggcgaaaguucuagcaacccaaccaucgaggaagggagaacacuucgcguucugaagaugguggagccuugguugucauccaaacccgaauucugcauuaagguccugaauccuuauaugccaaccgugaucgaggagcucgaaaaauuacagaggaagcacggaggcaaccugguacgguguccccuuaguagaaauagcacucacgagauguacugggugucuggugccuccgggaacauuguuucaagcgucaauacgacaucgaaaaugcugcuaaaccgcuuuaccacuaggcaucgaaagccuaccuaugaaaaagacguggaucucggagcaggcacacggucugugaguacggagaccgagaagccagacaugacuaucauaggcagaaggcugcagcgcuugcaggaagagcacaaggaaacauggcauuacgaucaagagaaucccuaccguaccugggcuuaucacggguccuacgaagccccgagcacuggaucagccuccucuauggucaacgguguugugaaacugcucacaaagccuugggacguaauuccaauggugacccagcuugcgaugacagauacuacccccuucggccagcagcgggucuuuaaagagaagguggacacgagaaccccucaaccaaaacccgggacaaggaugguuaugacuaccacagcuaauuggcugugggcauuacugggaaagaagaaaaacccgcgcuugugcacucgagaggaauucaucagcaaggugcggaguaaugccgcuaucggcgccgucuuucaggaggaacaggguuggaccuccgcaagcgaggccgugaacgacucuagauucugggaacucguagauaaagagagggcucugcaccaagaggggaagugugaaucaugcguuuauaacaugaugggaaaacgcgagaagaagcuaggcgaauuuggcagagcgaaagggagucgggccauuugguacauguggcuuggagcaagguuccuggaguucgaagcucucgguuuucugaaugaggaccauugguucggccgugagaacuccuggagcgggguggaaggagagggcuugcaccgacuggguuauauacucgaagagaucgauaagaaagacggggaucuuauguacgccgacgauacggcaggaugggacacacgcauuaccgaggaugaccugcagaaugaagaguuaaucacugaacagauggccccucaucacaagauucuggcuaaagccaucuuuaaguugacauaucagaacaaggucgugaaagugcucagacccaccccacggggcgcggucauggauauaaucucuaggaaggaccaacgcggcucggggcagguuggaacuuacggucugaauaccuucacaaacauggaggugcagcuaauuagacagauggaagcagagggcguaaucacgcaagaugacaugcagaauccuaaagggcuuaaggagcggguggaaaaauggcugagggagugcggagucgaccgacucaagcguauggccauuucaggcgaugacugugugguuaaaccccuggaugaaagauuugguaccagcuuguuauuccugaacgacauggggaaggugcgcaaggauaucccacagugggagcccuccaaaggauggaagaauuggcaggaagucccuuuuugcagucaucacuuccacaaaauauuuaugaaggacggccggucucucgugguaccauguaggaaccaagaugagcuuauuggcagagcucgcaucagccagggggccggauggucccugcgggagacugcaugccuagguaaagcuuacgcccagauguggucacugauguauuuccauaggcgagaccucagauuggcuaguauggccaucuguucugcaguuccgacagaaugguuucccaccagccggacuacaugguccauucacgcgcaucaccaguggaugaccacggaggauaugcugaagguguggaauagggucuggauagaagacaacccuaauaugaucgauaagacaccagugcacucaugggaggacauucccuaccuuggcaaacgcgaagaccuguggugcgggagccucaucggauuaucuucccgugccaccugggcuaagaacauucauacugccaucacccaaguuagaaaucugauaggcaaagaggaguauguggauuacaugccugucaugaagcgauauagugcaccaagcgaaucggaggguguguuguga

SEQ ID NO: 15698 - RNA, 9867 nt, Artificial Sequence
  derived and/or modified CDS sequence (opt3) from DENV-4__JQ922560__SS-prME
agcaccaucacacugcucugccuuauucccacugugauggccuuccaccuguccacgagagacggcgagccuuugaugauagucgcuaagcaugaaagggggcggcgcuuacuguuuaaaaccacagagggaaucaacaaguguacucuaauugcaauggaucucggugaaaugugcgaggacaccguuacauacaaauguccacugcuugugaauaccgaaccggaggauaucgacugcugguguaaccugacuucugccuggguaauguauggcacaugcacccagucaggggagcgacguagagaaaagaggaguguggcguugacgccccacagcggaaugggccucgagacucgggcugaaaccuggauguccucugagggugccuggaaacaugcacaacgcgucgagucguggauucugagaaauccuggguucgcccugcucgcuggauuuauggcauacaugaucggccagacaggcauacagaggacuguguucuuuaucuuaaugaugcugguugccccaucauaugggaugcggugugugggagucgguaaccgcgauuucguggaaggcguaagcgggggagcuuggguugaccuuguguuggagcacggcgguugcgucaccacaauggcccaggggaagcccacccuggauuuugaacuaauuaagacgacugcgaaagagguggcacuccugcgaacauacuguaucgaagccaguauuuccaauaucaccacugcuacaagaugcccuacccaaggagagccauaucuuaaggaggaacaggaccagcaguacauauguaggcgggauguggucgaccguggcuggggcaacgggugcggacuguucgguaaaggcgggguugugacgugcgccaaguuuucuuguaccggaaaaauuacaggcaauuugauccaaauugagaaccucgaauauacuguaguggucaccgugcauaauggugauacacacgcaguugggaacgacacuagcaaucacggcgugaccgcuacaaucaccccccgcuccccuucagucgagguggaacugccagauuacggagaguuaacucuggacugcgagccgagaaguggcaucgacuucaacgaaaugauucucaugaagaugaauaagaaaacguggcuuguacauaagcagugguuucuggauuugccccuaccuugggccgcgggggccgacacaagcgagguucacuggaaccauaaagaaaggauggugaccuucaaggucccacacgcaaaacggcaggaugugacuguccugggaucucaggagggugcuaugcacuccgcccucaccggcgcuacagaaguguacucaggggacggaaaucugauguuugccggccaucuuaaguguaaaguucgaauggagaagcugcgcauaaaggguaugagcuauaccaugugcagugggaaauucucuaucgauaaggagauggcagaaacucaacacggcacaacggugguaaaagucaaguacgagggagccggcgcucccuguaaagugccuauugaaaucagagacguuaacaaggagaagguggucgggagggugauauccagcaccccauucgcggagaacacuaauucgguaacaaacauugaauuggagcccccguuuggagauucuuauaucgugaucgguguuggcgacuccgcacucacccugcauugguucacaaaagggucaaguauuggaaagauguuugaaagcacuuaccggggcgccaaacgcauggcuaucuuaggugagaccgccugggauuucggguccgucggcggacugcuaacgucucucggcaaggcagugcaccagguguuugggagcgucuauaccacaauguucggaggcguuucauggauggugagaauucugauagguuuucuuguguuguggaucgggacuaauaguaggaacaccuccauggccaugagcugcauugcuguaggaggcaucacacuguuccucgguuuuacuguccaugccgacaugggcugugcagugucuuggucagggaaagaacugaagugcggaaguggcaucuucauuauagauaauguucacaccuggacggagcaguacaaguuucaaccugagagccccgcgcgucuugcuuccgccauccugaacgcacacaaagacgggguguguggaauucggucuacaacccgauuggaaaaugucauguggaagcagaucacuaacgagcucaauuaugugcugugggaaggcggucaugacuuaacaguuguggccggggauguaaaaggaguccugucgaagggcaaaagagcucuagccccaccugugaacgaccucaaguacagcuggaagaccugggguaaagcaaagauuuucacucccgagaccaggaauuccacauuucugaucgauggcccagacacgucagaaugccccaacgagcgccgggcuuggaauuuccuugagguggaagauuacggguucggaauguuuaccacuaacauauggaugaaauucagagagggcaguucugaaaugugugaccacagguugaugagcgccgcgaucaaggaucagaaagccguccaugcugacaugggguauuggauugaguccucaaagaaucagacauggcaaaucgaaaaagcaagccugauugagguuaagaccugccucuggccuaagacacacacucuguggucuaacggaguguuagagucccagaugcugaucccaaaagccuacgcuggcccguuuagucagcacaacuaucgccaggguuacgccacccaaacgguagggcccuggcaucuuggaaaguuggaaauagauuucggcgagugcccugguacaaccgugacuauucaggaagacugugaucaccgaggcccaagccuccggaccacaacugcaucugggaaacuggucacccaguggugcugucguuccugcacaaugcccccucuaagauuucugggagaggacggcuguugguaugggauggagaucaggccacucucagaaaaggaggaaaauauggugaaaagucagguuagcgcgggacaaggcacgucggagaccuucuccaugggucugcuuugcuugacucuguuuguggaagaguguuuacgccggagagucacaaggaagcauaugauucucgugguugugaccacucugugcgccaucauacuugggggacugacauggauggauuugcuccgagcucugaucaugcuaggcaacaccaugucuagccgcaugggcgggcagauucaccuggccaucauggcagucuucaagaugucacccggauacguacucgguauuuuucugcggaaacuuacgaguagagagacugcuuugauggugaucggcauggccaugaccacaguucuguccauaccgcaugacuuaauggaauucguggacgggauuucucucggacugauccuucugaagauggucacccacuuugauaauacucaggugggcacacuagcacucagccugaccuucaucaaauccacaaugccuuugguaauggccuggaggacuauuauggcugugcuguuugucguuaccuuaaucccacucugucguacgucaugccugcagaagcaaagccacuggguggagauuacagcgcuuauacugggugcccaggcauugcccguguaucucaugacccugaugaaaggggcuaguaagcgcucuuggccucuaaacgaaggaaucauggccgucggccuggugucccuucucggcagcgcccuguugaagaaugacguuccccuggcugggccaaugguagcaggagguuuacuccuggccgcguacgugaugucgggcucaucugcugaucuuagucuggagaaagccgcaacuguccagugggacgaaauggccgauauuaccggguccagcccuaucauugaggugaagcaagacgaggauggaucuuucagcauccgggacguugaagagacaaacaugauaacuuugcucgugaaacuggcucuaaucaccgucuccggccuguacccccuugcaauuccagugacgaugacacucugguauauguggcagguaaagacccagagaucaggugcccugugggaugucccgaguccugcggcugcccagaaagcaacuuugacagaagggguguacaggaucaugcaacgaggauuauucggcaagacccagguuggcguggggauucauauggagggagucuuucacacuauguggcaugugacacgggguagcguuaucugucacgaaucuggccgccuggagcccuccugggccgacgugagaaaugauaugauaucauaugggggaggcuggaggcucggugacaagugggauaaagaggaagacguccaggugcuggcuguagagccagggaagaaccccaaacaugugcagaccaagccuggacuuuucaaaacgcugacuggcgaaauuggcgccguuaccuuggacuuuaagccagggacaaguggaagccccaucaucaaucggaaagguaaggucauuggccuauacgggaacggaguggugaccaaguccggcgauuaugucucugcaauaacacaagcugagcgaaucggugagccugacuacgaaguagaugaggacauuuucagaaaaaagcgccugacuaucauggaucuccacccgggggccggaaaaaccaagaggauucugccaucgaucgugcgugaagcgcuuaaacggagauuaaggacgcugauacucgcccccacacgcguuguggcagcugagauggaagaggccuugcgaggccugccuaucagauaucagacuccagcugucaagagcgagcacaccggccgggaaauuguggaccucaugugccaugcaacauuuaccacuaggcugcuuucauccacccgcguucccaauuacaaccugaucgugauggaugaggcccacuucacagacccuaguucugucgccgcucguggguacauuagcacgagaguggaaaugggagaggcggcagccaucuuuaugacugcuaccccgcccgguacaaccgauccauucccucaguccaauucacccauagaagacauugagcgggagaucccagaaaggucuuggaacacuggcuuugauuggaucacagacuaucaggggaagaccguaugguucgugccuagcauuaaagccggaaaugacaucgcaaacugcuugcgcaagaguggcaaaaagguuguccaacuaucccgaaaaacguuugauacugaguaccccaagacaaagcugaccgacugggauuucguggugaccacugacauaagcgaaaugggugccaacuucagagcugggcgggucauugauccaaggcgcugucucaaaccgguuaucauuacagacggcccugagagagugaucuuagcgggacccauaccaguaacccccgccucugcagcucagaggcggggccguauugggcgcaauccugcccaggaagaugaccaauauguguuuucaggagauccacugcgaaacgacgaggaucaugcacacuggacagaggccaagaugcuucuggacaauaucuacacucccgaagguaucauuccuacgcucuucggcccggagagagaaaaaacccaggcuaucgauggggaguuuagguugcggggagagcagcgcaagacauucgucgaacugaugagaaggggcgaccucccaguguggcuguccuauaaaguugccagugcggguauuagcuacaaggaccgggaguggugcuuuacuggggaacgaaacaaucagauacuugaggaaaacauggagguggagaucuggaccagagaaggcgagaagaaaaagcuacgccccaaauggcuggaugcaagggucuaugccgacccuguagcuuugaaggauuucaaagaauuugccucgggacggaagucuauuacauuagacauccugaccgagaucgcuucccuccccacuuaccugagcucacgugcaaagcuugcccuggauaauauugugaugcuccacacgaccgaaagaggcgggaaagcuuaccaacaugccuugaacgagcugccagagagucuagaaacacugaugcucauagcacuucugggagcgaugacugccgguaucuucuuauuuuucaugcagggcaaggggaugggaaaauugucuaugggccugauugcuaucgccguugcauccggucuccuguggguggcugagauucagccucaguggaucgccgcaagcauaauccuugaauuuuuccugauggcccucuugauucccgagccagaaaagcaaaggaccccucaggacaaucagcugaucuaugucauuuuaacaauccuaaccauaauugggcugguggcugcgaacgagaugggccucaucgagaaaacuaagacagauuuuggauucuaccaggaaaaaacggagaccacuauucuugacgucgaucugcgcccggccucagcauggacauuguaugcuguggccaccaccauccugacacccaugcuccggcacacuauagaaaauacgagugccaaccugagccuugcagcuaucgccaaucaagcggcuguucucaugggccuggggaagggauggccauugcaucgaauggaccugggcgugccuuuacuagccauggguuguuacucccagguaaaccccaccacacugacugcaucucucgugaugcuucugguccacuaugccauuaucgggccaggauugcaggcuaaggcaaccagagaggcccagaaaaggacagcggcuggcauuaugaagaauccuaccguugaugguaucacugugauagaccuggagcccauuagcuacgauccgaaauucgaaaagcaacucggccaggucaugcugcuuguguuaugcgccgggcagcugcucuugaugcgcacgacaugggcauuuugugagguacugacccuagccacuggaccaauccugacccucugggaaggcaacccugggcgguucuggaacacaacuaucgcuguguccaccgccaauauuuuuagaggaucauaucuugcaggcgcuggucuggccuucucuuugaucaaaaacacacaaacgccccguagggggaccggaacuacaggcgagacccugggugaaaaguggaagcggcagcucaauagucuggaccgcaaagaguuugaggaauacaagcgaucgggcauauuagagguugacagaacugaagcgaaaagcgcccuuaaggauggguccaaaauuaaguacgcagugucuaggggaacaucaaagauccgguggauugucgagcgcggcauggugaaaccaaaggggaaagucguggaccugggaugcggcagagguggguggagcuauuacauggcuacccucaagaacguuacggaaguaaaaggauauaccaagggcggccccgggcaugaggagccuaucccgauggccacauacggauggaaucuagugaagcugcacuccggugucgauguguucuauaaacccacugaacagguugacaccuugcugugugauauaggcgagaguucuagcaacccaacaaucgaagaggggaggacucuccgagugcuuaagauggucgaaccuuggcugucauccaaacccgaguuuugcauuaagguguugaauccuuacaugccaaccguaaucgaggaacuggagaaacuccagcggaagcacggaggcaguuuagugcguuguccccugagcagaaacucuacacaugaaauguauuggguuuccggugucucacgcaauauugugagcucggugaacaccacuucuaaaaugcuucugaauagguucacgacacgguacagaaagccuaccuacgagaaggacgcagaucuaggggcuggaacucgcagugucuccaccgagacagaaaaaccagacauggccaucauuggcaggcgacuccaacggcugcaggaggaacacaaggagacguggcauuaugaucaggaaaaccccuacagaaccugggccuaucacggcagcuacgaggcgccgucaacuggguccgcuucuagcaugguuaauggagugguaaaauugcugacaaagccuugggacguggucccaauggugacccagcucgcaaugacugauacaacccccuuuggucaacagaggguuuucaaagagaagguggacacacgcacuccucagccaaagcccggcacccguaugaucaugacgaccacagccaacuggcuuugggcucuguuagggaaaaagaaaaauccgcggcugugcacuagagaagaguuuauaaguaaggucagguccaacgccgcaauuggagccgugagccaggaagagcaaggcuggaccucugcuucagaagcgguaaaugacagucgcuucugggaguugguugauaaagagcgagcccuccaccaggaagguaagugugaguccugcguguauaacaugauggggaagcgggaaaaaaagcugggagaguuuggcagagcaaaaggcagcagggcuaucugguacauguggcuaggggcccgcuuccuugaauucgaggcacugggauuucucaacgaggaccauugguucgguagagaaaauucuuggucgggcgucgagggggaaggacugcaccgguugggcuauauccuggaggauauugacaagaaagauggugaccucauauacgccgaugacacagcugggugggauacuaggaucaccgaggacgaucuucugaacgaagaguuaauuacggaacagauggccccucaucacaagauccuggcgaaggcaauuuuuaaauugacauaccaaaauaagguggugaaaguccuccgucccaccccaaagggagccguuauggacaucauaucacgaaaagaucagcgcggcagcggccagguggggacuuauggacugaacacauucaccaauauggagguacagcuaaucagacaaauggaagcugagggugugauuacucgggacgacaugcauaacccuaagggccuuaaagagagggucgaaaaguggcugaaggagugcgggguggaucgccucaaaagaauggccaucuccggagacgauuguguugugaagccccuggacgaacgguuuaguaccucuuuguuauuccugaaugauaugggcaaagucaggaaggacauuccacagugggagcccagcaaagguuggaagaacuggcaggaagugccuuuuugcucccaccacuuccauaagaucuuuaugaaagaugggcgaucacucguaguuccaugucguaaucaggacgagcuuauaggaagagcacgcauuagucaaggcgcuggcuggucucugcgggagacagccugccuagggaaggcuuacgcccagauguggagccugauguauuuccacaggagagaucuccgcuuggcauccauggcgaucuguucagccgugccgacggaaugguuucccaccagccggacuacauggucuauccaugcucaccaccaguggaugaccacugaggacaugcugaaagucuggaacaggguguggauugaagauaauccuaacaugacagacaagaccccaguucauuccugggaggacauacccuaccuuggaaaacgagaagaucuguggugcgguagucucaucggcuuaagcucgagagccacgugggcaaagaauauucacacagcuaucacccaggugcggaaccugauugggaucgaggaguaugucgacuacaugccugugaugaagagguauuccgccccauucgaaucugagggaguauuguga

SEQ ID NO: 15699 - RNA, 9867 nt, Artificial Sequence
  derived and/or modified CDS sequence (opt3) from DENV-4__JQ922558__SS-prME
agcacccugacacuccuuugccugauccccacugugauggccuuccacuuguccacgagagacggcgaaccuuuaaugauugucgcuaagcaugaaagggggcggccacuguuauuuaaaaccacagaaggaauaaacaaguguacucucaucgcaauggaucugggugaaaugugcgaagacaccguuacauacaaauguccgcuucuggugaauaccgaacccgaagauauugacugcugguguaacuugacuucuacaugggugauguauggaaccugcacgcagucaggggagcgccgacgugaaaagagaaguguggcccucacuccucacagcggaaugggccuggagaccagggcggaaacauggauguccucugagggugcuuggaaacaugcccaacgggucgagucguggauccugcgcaauccaggguucgcacucuuagccggauuuauggcuuacaugauuggccagacuggcauccagagaaccguguucuuuguucugaugaugcuuguggcacccucauaugggaugaggugugucggaguggguaaccgggauuucguagaaggcguuagcgggggagccuggguggacuugguccuggagcacggcgguugcgugacaaccauggcucaggggaagccuacgcuagauuuugaacucauaaagacuacagccaaagagguggcgcugcuucgcaccuacuguaucgaagcaaguauuuccaauaucacuacagccacccgaugcccaacgcaaggagagcccuaucugaaggaggaacaggaccagcaguacauuuguagaagggaugucguugaccggggcuggggcaacgggugcggauuguucgguaaaggcggggugguaaccugcgcuaaguuucucugucugggaaaaaucacaggcaauuuagugcaaauagagaaccuggaauauacugucgugguuaccgugcauaauggugauacacacgccgucgggaacgacauuucuaaucacggcgugacugcaaccaucacaccucguagcccauccguagagguuaagcucccggauuacggagaacuuacccuggacugcgagccccgcucaggcauugacuucaacgagaugaucuugaugaagaugaaaaagaaaacuuggcuagugcauaagcaguggguccuggaucucccucugccaugggcugccggggcggacacgaguaaagugcaguggaauuacaaggaaagaauggucacauuuaaagugccccacgccaagaggcaggauguuaccgugcuuggaagccaagagggugcaaugcauucugcucugacuggcgccaccgaaguagacuccggggauggaaaccacauguucgcuggccacuugaaguguaaaguccggauggagaagcuccgaaucaaagguaugucauauacaaugugcagcgggaaguuuaguauugacaaagaaauggccgagacccagcauggcacuacagugguuaaggugaaguacgagggagcaggcgccccuuguaaagucccaauagaaauccgcgaugugaauaaggagaaaguaguggggagaauuaucucuuccacgcccuucgcugaacacaccaacagcguuacuaacauagagcuggagccgccuuucggagacucguauauugucaucggugugggcgauucugcguuaacacugcauugguuuaggaagggguccucaaucggaaaaauguucgaaaguaccuaccggggcgcaaagcgcauggccauucuaggugagacagcuugggacuuugggagcgugggcggacucuucacuucccugggcaaggccguccaccagguuuuugggucuguguauaccacgauguucggaggcgugagcuggaugguaagaauccuuauugguuugcugguccucuggauagggaccaauucaaggaacacaaguauggcaaugacuugcaucgccauuggaggcaucacccuguuucuugguuucacagugcaugcugauaugggcugugccguuuccuggagcgggaaagaacugaagugcggaucuggcaucuuuguggucgacaaugugcacacuuggaccgagcaauacaaauuccagcccgaaucaccagcacguuuggcgagugcuauucucaacgcccacaaggacgggguuuguggaauacggagcacgacacgacuggagaaugugauguggaaacagaucaccaacgaguuaaauuauguacugugggaaggcggucaugaucuaacugucguggcaggggacgugaagggaguccucacaaagggcaaaagagcccugaccccucccguuaacgaucuuaaguacuccuggaaaacuugggguaaggcuaaaauuuuuaccccagaggccagaaauucuacauucuugaucgacggccccgauacgucggaaugcccuaacgagcgccgggcauggaauuuucuggaaguggaggacuacggguucggaauguucaccacuaacauuuggaugaaguuuagagagggcagcuccgaaguaugugaucacaggcucaugucagcugccaucaaagaccagaaggcggugcaugccgauaugggguauuggauagagaguucuaagaaucaaccauggcagaucggaaacgcuagccugauugaagucaaaacaugcuuauggccgaagacccacacacugugguccaauggcgugcuugagucacagauguugauccccaaagcauacgccgguccuuucagccagcacaacuaucgccaaggguacgcuacucagaccauuggaccauggcaucucggcaagcuggaaaucgacuuuggugagugccccggcacgacaguuaccauacaggaggauuguaaccaccgagggccuucucuacggacuaccacagccuccggaaaacuggugacucaguggugcugucguaguugcaccaugccaccccucagauuccugggcgaagacggguguugguauggaauggagauuaggccgcuuagcgaaaaggaggagaauauggucaagucucaaguguccgcaggccaggguacaucagaaacguuuaguaugggguugcugugcuuaacccucuucguugaggaaugucugcgccggagagugacuaggaaacauaugauccuugucguagugacaacccugugcgcgauuaucuugggaggccucacuuggauggaucugcuacgagcccugauaaugcucggcgacacaaugagcgggcgcaugggaggucagauccaccugaccauuauggcuguuuuuaagaugucgccuggcuacgugcuuggggucuucuugcggaaacugacguccagagagacugccuuaaucgugauuggaauggcaaugaccacaguacucucuaucccacaugaccugauggaauuuauagauggcauuagccuuggucugauccuacucaagaugguggcucacuucgacaacacccaggucgggacucuggccuugucacugacauuuaucaggaguaccaugcccuuaguuauggcauggcguacaauuauggccguacucuucguggucacucugaucccucuuugucgcaccuccugccugcaaaaacagucucacuggguggagauuacggcuuugauacucggagcgcaggcccugcccguuuaucuaaugacacugaugaagggcgcaagcaagcgguccuggccacuuaaugagggcaucauggcuguagggcucgugucacuguugggaagcgcccugcucaaaaacgaugucccucuagccggucccaugguggcuggcgggcugcuucuggcagccuacguuaugaguggaucuuccgcggacuugagccucgaaaaggcugccaaugugcauugggaugagauggcagacauuaccggcucgucaccaaucauugaagucaaacaagaugaggacgguucuuuuaguaucagagauguggaagagacuaacaugauaacccugcuaguaaagcuggcccuuaucacagucuccgggcucuacccgcuggcuauuccugugacuaugaccuugugguauauguggcagguuaaaacgcagaggagcggagcauuaugggacgugcccucuccagccgcggcucagaaggccacacugaccgagggcgucuaccgaaucaugcaacggggccucuucgggaagacucaggugggaguugguauucacauggaaggcguguuccauacaauguggcacgucacccgcgggagcgugaucugucaugagacuggaagacuggaacccuccugggcagauguaaggaaugacaugauaucauauggcgguggguggcggcuuggagauaaaugggacaaggaggaagacgugcagguucuggccauugagccuggcaaaaacccaaagcacguccagacaaaacccggcuuguuuaagacccuaacgggggagaucggagcugugacucuggauuucaaaccugguaccaguggcagcccgaucauuaauaagaaggggaaagugauaggacucuacggcaacggugucguaacaaagucuggggacuauguguccgccaucacccaagcagaacgaauuggagauccagacuacgagguugaugaagacaucuuuaggaaaaagcgccugacaauuauggaucuucaccccggcgcuggcaaaacuaagaggaucuuaccuucaauagugcgugaggcccugaagcggagacucaggaccuugauccuggcgccaacgcgcgucguggccgcagagauggaagaggcucuccgagggcugcccauuagauaucagacuccugccguuaaaagugaacauacuggacgggagaucguggaccuuaugugccacgcuaccuucacagcaaauccgcugagcuccaccaggguccccaacuacaauuugauugugauggaugaagcccaucuacaggaccugucuaucguagccgcucgcgguuacauaucgacucguguggagaugggcgaggcggcagccauuuuuaugaccgcuacaccaccuggggccacggaucccuucccacagagcaacucaccuaucgaagacaucgagagagaaauucccgagcgguccuggaauacuggauuugacuggaucaccgauuaucaaggcaagacaguuugguucgucccaaguauaaaagcagguaacgacauugccaacugccucaggaagucugggaaaaaggugauccaguuaagccgcaagaccuuugauacugaauacccgaaaacaaagcugaccgacugggauuucguggucacgacugacauuuccgagaugggcgcuaauuuucgagcgagacggguuaucgauccuaggcgcugucuuaaacccgugauacugacagacggaccagagagaguaauucucgccggccccaucccugugaccccagcaucagcugcccagaggcgggggcguaucggacgcaaccccgcacaagaagaugaccaguaugucuucucuggugauccuuugaagaaugacgaggaucacgcccacuggaccgaagcuaaaaugcugcucgacaacauuuacacuccggagggcaucauuccaacacuguucgggcccgaacgagagaagauacaggccaucgacggagaguuuagacuuaggggcgaacagcggaagaccuucguggagcuaaugcgcagaggugaucugccuguuugguugagcuauaaaguggcgagugcagggauuuccuacaaggacagggaauggugcuuuacaggcgagcggaauaaccaaaucuuagaggaaaauauggaggucgaaaucuggacucgagagggagagaaaaagaaacugagacccaaguggcucgaugcccgcguauaugcugacccaauggcccugaaggauuucaaagaguuugcuagcggcaggaagucuauuacgcuugacauacugaccgagaucgcaucacucccuacauacuuguccagucgggccaaacuggcucuagauaacauugugaugcugcauacuaccgaacgugggggcagagccuaccagcacgcacucaaugagcuucccgaaagccuggagacauuaauguugguugcgcugcucggugccaugaccgcuggcaucuuccuguuuuucaugcaggggaagggaauuggcaaacuuucgaugggucugauggccaucgcaguggcuucugggcucuugugggucgccgaaauacagccacaauggaucgcagccuccauuauccuggaguuuuucagcauggcuuuacuaauuccugagccggaaaagcagaggacuccccaggacaaccagcugaucuaugugauacucacgauucuuaccaucauuggccugaucgcggccaaugagaugggauugauagagaaaacaaagacugauuuuggcuucuaccaagucaagaccgagacaaccauccuggacguggaucuccgcccagcaucagcuuggacucuguaugccguugccacaacgauucuuaccccuaugcuccggcauacuaucgaaaacacaagugcaaaucugucuuuggcugccauugcgaaccaggcugccgugcugaugggguuaggaaaaggcuggccccuacaccgaauggaccuggguguaccacuccuugcaaugggguguuacucccaggugaauccuaccacccugacagccagcuuggucaugcugucaguucauuaugcuaucauaggacccggccuccaggcaaaggccacuagagaggcgcagaaaagaagugcugccgguauuaugaagaacccgacgguggauggcaucaccgucaucgaccuggagccaauuagcuacgacccuaaauuugaaaagcagcuugggcaagugauguuacuggcacucugcgccggacaauugcugcuaaugcgcacaacuugggcuuucugugagguacugacccucgccacaggccccauccuuacccugugggaagggaacccaggacgguucuggaauacuacgauacccguguccacagcaaacauuuuuagaggcucuuauuuggcuggugccgggcuggcguucagccucaucaagaaugcccagaccccucguaggggaacuggcaccacaggugagacucugggcgagaaauggaagcggcaguuaaacucccuugaucgcaaagaauuugaggaauacaagcgaucagggauuuucgagguugacagacacgaaaucaaauacacccugaaggauggaucuaagauaaaucacgcaaugaguacaggcucgaucaaaauuagggggaucgacgagcggggaauggugaagccgaaaggcaaggucguggaucaggguugcgggcgcggaggcuggagccauuauacggcuaccgccaaaaaggucacugaggugaagggcuacacaaaagggggacccggucacgaagaaccaauuccuauggcaaccuauggcuggaaccucguuaagcuacauuccgggguagacguguuuuacaaacccacugaacaagucgauacacuguugugugacaucggagagucuucaagcaauccuaccauugaagagggcagaacgcugagggugcucaagaugguugagccauggcuuuccaguaaacccgaguucugcaucaaggugcugaacccuuauaugccaaccgucauagaggaauuggagaaacugcagcgaaagcacggugggucucucgugcggugucccuuaagccguaauucaacacacgaaauguacuggguauccggagugaguggcaacauuguuagcucugucaauacuaccuccaagaugcugcuuaacagauuuacaacucgccauaggaaaccgaccuaugagaaggauguggaccugggcgcugggacacggucagugagcaucgagaccgaaaaaccugauaugacuaucauuggaagacgccuacagaggcuccgagaggaacacaaggagacguggcauuacgaccaggagaauccauaccggacaugggccuaucacgguucguacgaagcccccucuaccggcagugcguccagcauggucaacgggguugugaaacuguugacuaagccuugggacguaauaccaauggugacccaacuggcuaugacagauacgacccccuucggacagcagagagaguuuaaggaaaaagucuauacuucaacaccgcauccuaagcccuggaccaggauggugaugacuacaaccgcaaauuggcucugggcccuuggcgguaaaaagaaauccccacgccugugcacaugggaggaguucaucucuaagguucguagcaacgcugccauuggggcaguguuucaggaggagcaaggauggacaagugccuccgaagcugucaaugacagccgguucugggaguuaguggauaaggaaagagcgcugcaccaggagggcaaaugugaaucuugcguauacaacaugaugggcaagagggagaaaaaguugggggaguuuggacgcgccaaagguucacgagcaaucugguauauguggcucggcgcucgguuccuggaguucgaggcccuaggguuucuuaacgaagaccacugguucggaagagagaauaguugguccggcguugaaggugaggggcugcauaggcucggauacauucuggaggauaucgacaagaaggauggcgacuugauauaugcagaugacaccgccggcugggauacgcgcaucaccgaagacgaucugcucaacgaggaacuuauuacagagcagauggcuccucaccauagaauccuggccaaagcgauuuuuaaguuaacuuaccacagcaaagugaugaagguccugcggcccaccccaaaaggggcagugauggacaucauaucuaggaaggaccaacguggaucgggucaggugggcacauacggguugaauacuuucaccaacauggagguccagcucauucgacagauggaagccgagggaguuaucacgcaagaugacaugcagaaucccaaaggccugaaggaacgcguggagaaguggcuaaaagaaugcgguguagauagacuuaagcggauggcuaucucaggggacgauuguguggucaaaccucuggacgagagguuuagcacaucccuccuguucuugaacgauaugggaaaggugcgcaaagacauuccacagugggagccgaguaagggcuggaagaauuggcaggaaguucccuuuugcucucaccauuuccacaaaauauuuaugaaggauggcaggagcuuaguggucccuugucggaaccaagacgagcugaucgggagggcccgaauuucccagggagcagguuggucacuccgugaaaccgcuugccuuggcaaagccuaugcucagauguggagucugauguacuuccauagacgcgaucuacggcuggccucuauggcaaucuguagcgcggugccaacugagugguuucccacauccaggaccacuuggucaauucacgcccaucaccaguggaugaccacagaagacaugcucaagguauggaauagaguuuggaucgaggacaacccuaauaugacggauaaaaccccagugcacagcugggaggacguccccuauuuggggaagcgcgaagaucuguggugcggaucucuuauaggccuguccagucgggcuacuugggccaagaacauccauacagcaauuacccaagugaggaaucucaucgguaaagaggaauacguugacuauaugccugugaugaagcgauacagcgcuccgauugagucggaaggggucuuauga

SEQ ID NO: 15700 - RNA, 9867 nt, Artificial Sequence
  derived and/or modified CDS sequence (opt3) from DENV-4__JQ922559__SS-prME
ucaaccaucacacugcucugccuuauucccacugugauggccuuccaccuguccacgagagacggagaaccuuugaugauagucgcuaagcaugaaagagggcggccauuacuguuuaaaaccacagaaggaaucaacaaguguacucuaauugcaauggaucucggugaaaugugcgaagacaccguuacauacaaauguccgcugcuugugaauaccgaacccgaagauaucgacugcugguguaaccugacuucugccuggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauguggucgaccggggcuggggcaacgggugcggacuguucgguaaaggcgggguugugacgugcgccaaguuuuuguguucuggaaaaauuaccggcaaucucguacaaaucgagaaccuggaauauacaguggucgugacuguucauaauggugauacccacgcaguggggaacgacauuagcauccacggcgucacagcuacuaucaccccucguuccccaucaguggagguaaaguuaccggauuacggagaacugacacucgacugcgagccccgcaguggcauugacuucaaugagaugauacuuaugaagaugaaaaagaaaaccuggcugguucauaagcagugguuuuuggaucuaccucugccauggacugccggggcggacacgagcgaagugcaguggaacuacaaagagagaauggucacauucaaggugccccacgccaaaaggcaggaugucaccgugcucggaucucaagaaggugcaaugcauuccgcucugacuggcgccaccgagguugacucaggggauggaaaucacauguuugcuggccaccuuaaguguaaggugcggauggaaaaacugcgaaucaaggguaugagcuauacaaugugcagugggaaauucucuauugacaaggagauggccgagacccagcauggcacuacaguagucaaagugaaguacgaaggagcaggcgccccuuguaagguuccaaucgagauacgcgaugugaacaaagaaaaggucguggggagaauuaucuccagcacgcccuucgcugagaauaccuauucgguaacuaacaucgaguuggaaccgccuuuuggagacucuuacauuaucauuggugugggcgauuccgcgcucacacugcacugguucaggaaagggucaaguauaggaaagauguuugagagcaccuaucggggcgcaaaacgcauggccaucuuaggugaaacagcuugggacuucggguccguuggcggacugcuaacuucucucggcaaggccguccaucagguguuugggagcguguacaccacgauguucggaggcgucucauggaugguuaggauucugaucggucuuuuggugcuguggaucgggaccaacaguaggaauacauccauggcaaugagcugcauugccgugggaggcauaacucucuuucuggguuucaccguacacgcugauaugggcugugccgucucuuggucagggaaggagcuuaaaugcggaaguggcaucuuugugauugacaacguucauacauggacugaacaauauaaguuccagcccgagagcccagcacgucuggcguccgcuaucuugaaugcccacaaagacgggguguguggcauucggucuaccacgcgacucgagaacgucauguggaagcagaucacaaaugaacugaacuacguguuaugggagggcggucacgaucugaccauaguugcaggggacgugaaaggaguacuaucgaagggcaagagagcccucgcuccucccgucaaugaucugaaauacagcuggaagacuugggguaaagccaagaucuuuacaccagaaaccaggaacuccacuuuccuuauugacggccccgauaccucagagugcccuaaugaacgccgggcauggaacuuuuuggagguggaggacuauggguucggaauguucacaacgaauaucuggaugaaauuuagagaaggcaguucugaggugugugaucauaggcugaugagcgcugccauuaaggaccagaaagcgguccacgccgauaugggguacuggaucgaauccucaaagaaccaaaccuggcagauagagaaggcuagccucauugaaguuaaaacuugccuguggccaaagacacauaccuuauggucuaauggagugcuggagucccagaugcuuaucccgaaagcauaugccggccccuucagucagcacaacuaccgccaagguuaugcuacacagacuguagggccuuggcacuugggaaagcucgagauugacuuuggcgaaugcccagguaccacggugacaauccaggaggauugugaccaucgaggccccagccugcggaccacuaccgccucugggaagcuggucacacaguggugcugucguuccugcacuaugccuccacugagauuccucggagaagauggcuguugguacgggauggagauaaggccccugucagagcgcgaagagaauauggugaagagucaaguuagcgcaggacagggcaccucggaaacauuuuccaugggucuuuugugccugacguuauucguggaggaaugucuccggagaagggucacccgaaagcacaugauccuggugguugugacuacacuuugcgcgauuauccuagggggauugaccuggauggaccuccugcgcgcccuaauuaugcugggcgacacuaugucuagccggaugggcgggcagauccaucucgcuauaauggccgucuuuaaaaugucaccgggauauguacuggguauuuuccuuagaaaguugacaaguagggagaccgcacugauggugaucggcauggcuaugacgacuguuuuauccaucccucacgaucucauggaguuuauugacgggaucucucugggacuuauucugcuaaaaauggugacccauuucgauaacacacagaugggcacccucgcccugagcuugacuuuuauaaaguccacaaugccacuggucauggcauggcguaccaucauggccguguuauucguagugacacucauuccccugugucgcacuucaugccuucaaaaacagagccacugggucgaaaucaccgcucugauuuugggugcgcaggcccucccuguuuaccugaugacgcuaaugaagggggcaaguaagcggucuuggccccugaacgagggaaucauggcugugggccuugugucccuccugggcagcgccuugcugaaaaaugacgucccauuagccgggccuaugguggcuggaggucuccugcuugcagccuacguuaugucgggcucaucugcggaucugaguuuggaaaaggcugccaacguacaaugggacgagauggcagauauaacaggguccagccccaucauugaagugaaacaggacgaggauggaucuuuuagcaucagagacgucgaggaaaccaauaugauuacucuccuggugaagcuagcccugaucaccguuuccggccuuuauccacucgcuauaccggugacaaugacucugugguacauguggcaggucaaaacccagaggucaggugcauugugggaugugccuagucccgccgcggcucaaaaggccacguuaacagaggggguauaucgaauuaugcagcggggacuguucggcaagacccaggucggcguggggauccacauggaaggaguuuuccauacuauguggcacgugacacgcgguagcgucaucugucaugagucuggcagacucgaaccauccugggcagacgugaggaacgauaugauuucauacgggggaggcuggcggcugggugacaaaugggacaaggaggaggauguucaggugcuugccauagaacccgggaaaaauccuaagcacguccaaaccaaaccaggacuguuuaagacuuugacaggcgagaucggcgcugugacccuagacuucaaacccgggacgaguggaagcccuauuaucaaccgaaaggguaagguaauuggccuguaugggaauggagugguuacuaaauccggcgauuacgucucugccaucacccaggcagaaagaauaggugagccggacuaugagguggaugaagacaucuuucgcaagaaaaggcucacaauuauggaucugcauccaggggcuggaaagaccaaacguauccuucccucgauugugcgggaggccuuaaagagaaggcugcgcacacucaucuuggcgccuacucgagucguagccgcagaaauggaggaagcucugagaggccucccaauacgguaccagacccccgccgugcugagcgagcacacgggcagggagauuguugaccuuaugugccacgcuacauucacuacccgccuguugucauccacacgugugccuaacuacaaucuaaucgucauggaugaagcacauuuuaccgacccgaguucuguggccgccagaggguauaucagcacucggguugagaugggagaagcugcggcaauuuucaugaccgccacacccccagguacgacugauccuuuuccccaguccaacucaccaaucgaggacauagaaagggagauuccugagcgcucuuggaauaccggcuucgacuggaucacagauuaccaagggaagaccgugugguuuguccccagcauuaaagcuggaaacgacaucgccaauugccugcgaaagaguggcaaaaaggugauacagcucuccagaaaaacuuucgauacagaauauccaaagaccaaguuaacggacugggauuuuguagugacuacagacauuagcguuaugggugcaaacuuccgggccgggagggucaucgauccgcgcagaugucugaaaccugugaucauuaccgacggccccgagagggugauccuugcuggaccaauucccgucaccccugcgucugccgcacagcggcguggccgcauagggcgaaauccagcucaagaagaugaccaguacguuuucucaggagauccccugagaaacgacgaggaucacgcccauuggacugaagcaaagaugcucuuggacaacaucuauacaccugaggguauuaucccgacccuguuuggcccagagagggaaaagacucaggccaucgacggggaguuccggcuccgcggagaacagagaaagacuuuuguggagcugaugaggcggggcgaucuucccguauggcuauccuacaaaguggcuagugccgguauuagcuauaaggaccgagaguggugcuucacgggggaaagaaauaaccaaauacuggaggaaaauauggaggucgaaaucuggacccgcgagggcgagaagaaaaaguugaggccuaaaugguuagaugcgcggguguacgcagaccccauggcccugaaggauuuuaaagaguucgcuucgggacguaagucuauuacacucgacauccugacugagauugccucccuuccaaccuaccugagcucaagagcuaagcucgcauuggauaacaucguuaugcugcacacaaccgaaaggggcgggaaagccuaucagcacgcucuaaaugagcugccugaaagucucgagacucuuaugcugguggccuuauugggagcaaugacggcggguauauuucuguucuuuaugcagggcaaggggaucggagagcucucuaugggccugauugccaucgcuggugccuccgggcuucuguggggcaccaaaacacccccaccuuggggagcagcuagcaacauucucgaguucuuuuugaugguccuguuaaucccggagcccgaaaagcagcgcacuccacaagacaaucagcuaauauacguaauucugaccauccucacaauuaucggccuuguggccgcaaacgagauggggcugauagagaaaaccaagacugauuucggauuuuaucagguuaaaacagagacgaccaucuuggacguggaucugcggccugccucagcuuggacucucuacgcggucgccacaaccauucugacccccaugcuucgacauacaaucgagaauacaagugcaaaccucagccuggcugccauugccaaucaggcagcuguguugaugggccuggguaagggguggccauuacacagaauggaccuaggagucccucugcucgccaugggcuguuauucccaagugaaccccacgacccuuaucgcgucucugguuauguugcuggugcauuacgcuauaauugguccgggccuccaggccaaggcaacaagggaagcccagaaacgcacugcugcagggaucaugaagaauccaaccguagauggaaucacagugauugaccuggagccuaucagcuaugaccccaaauucgaaaagcagcuuggccaagucauguuacugguucucugcgccgggcaguugcugcuaaugcggaccacuugggcguucugugaggugcugacgcucgcuacaggaccaauacuuacccugugggagggcaaccccgguagauuuuggaauacuaccauugccgucuccacagcaaacaucuuccgugggucauacuuggccggagcuggccuggccuuuucucucauuaaaaacgcacagacuccuaggcgggguaccggcgugacaggggaaacgcugggagagaaguggaagcgccaauuaaauagucuugaucgaaaagaguucgaggaauacaagagaucgggcauccuggagguagacaggaccgaggcuaaaagcgcccucaaggauggguccaaaauaaagcaggcggugucucggggaacuucaaagauccgcuggauuguugaaagaggcauggugaaaccgaaggguaaagucguggaccuagggugcggaaggggcggcuggagcuauuacauggccacacugaagaacgucaccgaggugaaaggguauacuaagggaggucccggccacgaagaaccaaucccuauggcaacauacggguggaauuugguuaagcugcauucccgaguagauguguuuuauaaacccaccgaacaggucgacacgcuccuuugugauauuggagagaguucuagcaacccuaccaucgaggaaggccggacacugcguguguugaagaugguugagccauggcugucauccaaacccgaguucugcauuaaggugcucaauccuuacaugccaacugucaucgaggaauuagagaaacugcagagaaagcacggugggagucuugugcgcuguccccugagcaggaacucuacccacgagauguauuggguauccggagugucaggcaauauaguuagcucggucaacacaacuucuaaaaugcuacucaaucgguuuaccacaaagcauagaaagccgaccuacgaaaaagacgcugaucugggcgccgggacucgcaguguguccacggagacagaaaagccugacaugaccauuaucggaaggcgauugcaacggcugcaggaggagcaccaggaaacuuggcauuacgaucaggagaacccauauagaaccugggcauaccacgguggcuaugaagcucccagcacagggucagccuccucuauggugaauggagucguuaaacuccuuacgaagccuugggacgugaucccaaugguaacccaacuggccaugacugacacaacccccuucggccagcagaggguguuuaaagagaaggucgauacucgcacaccgcagccuaagcccgguacccguauggugaugacaacuaccgcgaacugguuaugggcucuguuggggaaaaagaaaaauccacggcucugcacgagagaagaguucauuagcaagguuaggaguaacgcagccauaggagcugugucccaagaggaacagggcuggaccagcucuuuugaggccgucaaugacucacgcuucugggaacugguggauaaagagcgagcacuacaccaggaaggcaagugugagaguugcguauacaacaugauggggaagcgggagaagaaacuuggagaauuugguagagccaaaggcuccagggcuaucugguauauguggcugggggcgcgcuuccucgaguucgaagcccugggauuuuugaaugaggaccauugguucggcagagaaaacagcuggucugguguugagggggagggacugcaccggcucggcuacauucuugaagaucuggacaaaagggaucguucguuaguguuugcagacgauacagcuggcugggacacuaaaaucccugaggaugaccuguugaaggaaaagcccauuccagggcccauggccccucaucaacgaaucccagcacgcgccauauucaaacucaccuaucagaacaaggucgugaaagugcugagacuaaaacuuaaaggagcugucauggauaucauuucacggaaggagcagagggguagcggccagguugggacauacggacugaauacuuuuaccaacauggaggugcaacucauccgccagauggaagccgagggcguaauuacgagagacgacaugcacaauccgaaaggucugaaggaacggguggagaagugguugaaagaaugcggggucgauagguuagagcgaauggcgaucuccggagacgauugugugguuaagccccuggacgagcguuucaguacaucucuccuuuuucugaacgauaugggcaaagugagaaaggacauaccucagugggaaccaagcaaaggcuggaagaauuggcaggagguccccuucugcucccaucacuuucacaagauuuucaugaaagaugggcgcagccuagugguaccuugucggaaccaagacgaacugaucggaagggcaagaaucagucagggugccggcuggucucuccgcgagaccgcuugcuuggggaaggccuacgcacagauguggagccugauguauuuucaucggagggaucuucgacuggcuuccauggccauuuguucagcuguuccaacugaaugguuccccacaagcagaaccacuuggucuauacacgcccaucaccaguggaugaccacagaggacaugcucaaaguguggaaucgggucuggaucgaggauaacccuaauaugacggacaagaccccggugcacuccugggaagacauuccauacuuaggaaaaagggaggaucuguggugcggcaguuugaucggucugagcucgcgcgcaacuugggcgaagaacauucauacagccaucacccaaguucguaaucucauagggaucgaaggauauguggacuacuuucuucugauuaagugguauuccgcucccuucgagucugaaggcguccuauga

SEQ ID NO: 15701 - RNA, 9867 nt, Artificial Sequence
  derived and/or modified CDS sequence (opt3) from DENV-4__KF955510__SS-prME
agcaccaucacucugcucugccuuauucccacugugauggccuuccaccuguccacgagagacggagagccuuugaugauagucgcuaagcaugaaagggggcggccauuacuguuuaaaaccacggagggaaucaacaaguguacucugauugcuauggaucucggugaaaugugcgaggacaccguuaccuacaaauguccgcugcuugugaauaccgaacccgaggauaucgacugcugguguaaccugacuucugccugggugauguauggaacaugcacccagucaggggagcgccgacgugaaaagaggaguguggcguugacgccucacagcggaaugggccucgagacuaggaccgaaacauggauguccucugagggugcuuggaaacaugcccaacgggucgagucguggauucugcgcaagccaggguucgcgcugucagccggauuuauggcuuacaugaucggccagacuggcauacagaggaccguguucuuuauccucaugauguuaguugcacccagcuaugggaugaggugugugggagucgguaaucgggauuucguggaaggcguaagugggggagccuggguugaccuggugcuugagcacggcgguugcgucacaaccauggcucaggggaagccuacguuggauuuugaacugauuaaaacuacagccaaggagguggcgcuacuccgcaccuacuguaucgaagcauccauuucuaacaucacuacagccacccgaugcccaacgcaaggagagcccuaucugaaagaggaacaggaccagcaguacauauguagaagggauaugguggaccggggcuggggcaaugggugcggacuuuucgguaagggcggggucguuaccugcgcuaaauuuagcuguuccggaaagauuacaggcaaccuggugcaaaucgagaauuuggaauauacuguaguggucaccgugcauaacggugauacacacgccguugggaaugacacuucaaaccacggcgagaccgcaacaauuaccccucguaguccaagcguggaaguccgccucccggauuacggagagcugacuuuagacugcgagcccagaucuggcaucgacuucaaugaaaugauccugaugaagaugaaaacgaagacauggcucgugcauaaacagugguuucuugaucugccuuugccauggaccgcuggggccgacacuuccgagguacacuggaaccauaaggaaaggaugguuaccuucaaagugccccacgcgaagcggcaggaugucacagugcuaggaucacaggagggugccaugcacagcgcacuggcuggcgccaccgaagucgacaguggggauggaaaucauauguuugcuggccaccucaaauguaaggugcgaauggagaagcugcgcauuaaagguaugucuuacacuaugugcuccgggaaguucagcauagacaaagagauggccgaaacacaacauggcacgaccguugugaagguaaaauaugagggaacuggcgcaccuuguaaggucccaaucgaaauuagagaugugaacaaggagaaaguuguggggaggaucauaucgucuacacccuucgccgagaauaccaacuccgucacaaacauugaacuugagccgccuuuuggagacucauacaucgugaucggugcuggcgauagugcgcugacuuugcacugguuccggaaggggagcuccauuggaaaaauguuugaaucuaccuaucgcggcgcaaagagaauggccauccucggugagacggcuugggacuucgggagcguaggcggacuguuaaccucacugggcaaagccgugcaucagguuuuugggagugucuacacaacuauguucggaggcguguccuggauggugaggauucuaauaggucuccugguccuuuggaucgggaccaauagccguaacacaucuauggcaaugucaugcauuguugugggaggcaucacuuuguuucuggguuucaccgugcacgccgauaugggcuguguagucaguuggagcgggaaggaacucaagugcggauccggcaucuuugugauugacaauguucacacguggacagagcaguauaaauuccaacccgagucuccagcucggcuggccucggcaauacuuaacgcgcauaaggacgggguguguggaauccgaagcaccacuagacuggaaaaugucauguggaaacagauuacaaacgaguugaauuacgugcucugggaaggcggucacgaucugaccguuguggcuggggacguaaagggagucuuauccaaaggcaagagggcccuggcaccucccgugaacgaucuaaaguauucauggaaaacuugggguaaggccaaaaucuuuaccccagagacacgcaauaguacguuccucguggacggccccgauaccucugaaugcccuaacgagcggagagcuuggaauuuucuggaggucgaagacuacggguucggaauguucacuacaaacauuuggaugaaguuuagggagggcagcuccgaaguuugugaucaucgccuuaugucagccgcaaucaaagaccagaaggcugugcacgccgauaugggguacuggauagagagcucuaaaaaucagaccuggcaaaucgaaaaggcguccuugauugagguaaagacaugccuguggccaaaaacucacacccucuggaguaacggagugcuggagagccagauguuaaucccgaaggccuaugcuggccccauuucucagcauaauuaccgacaggguuaugcaacgcaaacagucgggccuuggcaccugggaaaacuugaaaucgacuucggcgagugcccagguaccacugugaccauacaggaagauugugaccaucggggccccuccuugcguacaacuaccgccucagggaagcucguuacacaguggugcuguagaaguugcacgaugccuccacugagguuucuaggagaggauggcuguugguacgggauggagauucgcccccugaacgaaaaagaggaaaacaugguaaagagccaggucucggcuggacaaggcaccuccgagacuuucucuaugggucuccugugccuuacauuguuuguggaagagugucugcggagaaggguuacccgaaagcacaugaucuuaguggucguaacuacacucugcgccauuauccuaggcgggcuuaccuggauggaccuguugcgcgcacucauaaugcugggggacacgaugagcggccggaugggaggacagauccaucuagcgauuauggccauguucaaaaugucaccggguuaugugcugggcaucuuucucagaaagcugacaaguagggagaccgcucuuaugguuauugggauggccaugacaaccguguuguccaucccucacgaucugauggaguucauagacggaauuucuuuaggccucauccugcuuaaaauggucacucacuuugauaauacacagguggguacccuggcacuaagccucacauucaucaaguccacuaugccacugguaauggcuuggcguaccauuauggccguguuguuugucguuacgcugauccccuuaugucgcacaucaugccuccagaaacaaagccauuggguggagauuaccgcacugauacuuggggcccaggcucugccuguguacuugaugacucucaugaagggagcgaguaagcggucuuggccccugaacgaaggcaucauggccgucggccuagugucccugcuugggagcgcacuccugaaaaaugacguuccauuggcuggaccuaugguagccgguggccuguuacucgccgcuuaugugaugucggggucaucugcagaucugagucuugagaaggccgcgaacguccagugggacgaaauggcugauauuaccggauccagccccaucauugaggugaaacaagacgaggauggcucuuucagcaucagagacguugaagagacaaauaugauaacucuguuggugaagcucgcccugaucaccgucuccggucuauacccacuggcaauuccggugacgaugacacuuugguacauguggcagguaaaaacccagaggucaggggcccucugggaugucccuagucccgcugcagcccagaaggcgacucugacagaaggagcuuaucgaaucaugcaacggggcuuguuuggcaagacccagguggggguuggcauucacauggaggguguguuccauacuauguggcacgucacacgcggcagcgugaucugucaugaaucugggagauuagagccauccugggccgacguuaggaacgauaugauaucauacggaggcgguuggcggcugggggacaaaugggacaaggaggaagaugugcagguccucgcaauugagcccggcaaaaauccuaagcacgugcagaccaaaccaggccuguucaagacgcuuacuggcgaaaucggggccguaacccuggacuuuaaacccggaacaagugguagcccuaucauuaaccgaaagggcaaggugauaggguuguauggaaauggcguugucaccaaauccggugauuacgugucugcuaucacacaagccgagagaauuggggagccggacuaugaaguggaugaggacaucuuccgcaagaaaaggcuaacuauuauggaucugcacccaggagcaggcaagaccaaacguauccuccccucgauaguccgggaagcucugaagagaaggcuucgcacguuaauccuggccccuacacgaguaguggcggccgagauggaagaggcacucagaggcuugccaauucgguaccagacucccgcuguuaagagcgagcauaccgggagggaaaucguggaccugaugugccacgccacauuuaccacucgccuccugucauccacccgugucccuaacuauaaucuuauugugauggaugaggcucauuucacagacccgaguucuguugcagccagaggauacaucagcacgcggguggaaaugggugaggccgcugcgauauuuaugacugcaacacccccaggcacaaccgauccuuucccccaguccaacucaccaauugaagacaucgagagggagaucccugaacgcucuuggaauacuggguuugacuggauuacagauuaccagggaaaaaccgucugguucgugcccagcaucaaggccggcaacgacauagcuaauugccugcgaaaaagugguaagaaaguaauucaauuguccagaaagacguuugauacugaguauccaaagacaaaacuaaccgacugggauuucgugguuaccacugacaucagcgaaaugggggccaacuuucgggcaggcagggucauugauccgcgcagaugucugaagccugugauccucacagacggacccgagagggugauauuagccggcccaauucccgucaccccugcuucugcggcccagcggcgugggcgcaucggacgaaacccagcacaggaagaugaccaauacguuuucucaggugauccccugagaaaugacgaggaucacgcucacuggacagaggccaaaaugcuucuggacaacaucuauacuccugaaggcauuaucccgacacucuucgggccagagagggaaaagacccaggcaauugacggagaguuucgguugcgcggcgagcagagaaaaacauucguggaacugaugaggcggggugaucuccccguauggcuguccuacaagguggccagugcugggauaagcuauaaggaccgagaguggugcuuuacuggcgaaagaaauaaccagauccuugaggaaaauauggaggucgagauuuggacccgcgaaggagagaaaaagaaacuaaggccuaaguggcuggaugcccggguguacgcggaccccauggcauugaaagauuucaaggaauuugccucgggccguaagucuaucacauuagacauccugaccgagauugcuucccucccaacuuaucugagcucaagagccaaacuugcucuggauaacauaguuaugcuccauacgaccgaaagagggggaaaggcauaccaacacgccuugaaugagcugccugagagucuagaaacacugaugcucguggcacuucugggugccaugacugcaggcaucuucuuauuuuucaugcaggggaaaggaaugggcaaguugucuaugggucugauugcgaucgccgucgcuuccgggcuccuguggguagccgagauucagccccaguggaucgcagcuagcauaauccuugaauuuuuccugauggugcucuugguuccagagccugaaaaacaacgcaccccgcaggacaaccagcugauuuacgugaucuuaacaauucuaaccaucauagcccuggucgcagccaaugagaugggccucauugagaagacuaaaacagauuuuggauucuaucaggcuaagacggaaaccacuauccuugacguggaucugcggcccgcgucagccuggacauuguacgcagucgcuaccaccauucugacaccaaugcuccgacauacuaucgagaacacgagugccaaucugagccuugccgcaauagcuaaccaagccgcggugcucaugggccuggggaagggauggccuuugcacagaauggaccugggcguucccuuacuagcuauggguuguuauucccaggugaauccaaccacacugacugccucucucguaaugcuucuggugcauuacgcaaucauugggccuggauugcaggccaaagcuaccagggaagcacagaagcgcacagccgcgggcaucaugaaaaaccccaccgucgaugguauuacuguuaucgaccuggagccgauaagcuaugacccaaaguuugagaaacaacucggccaggugaugcugcuugucuuaugcgcugggcagcugcucuugaugcggacgacaugggccuucugugaagugcugacccuagcaacuggaccuauucugacccucugggagggcaaucccgggagauucuggaacacaacuaucgccguauccaccgcuaacaucuuucguggaucauaccuugccggcgcaggucuggcuuucucuuugauuaagaaugcccaaacaccaaggcgggggacgggaaccacuggcgaaacacugggugagaaguggaaacgccagcucaacagucuggaucgaaagggcuuugaagaguauaaaagaucggggaucuuagagguggacaggaccgaagcaaagagcgcccuuaaagauggauccaagauaaaguacgcaguuucucggggcacuucaaaaauucgcuggaucguggagagagggauggucaagcccaaaggaaagguggucgaccugggcugcgguagagggggauggagcuacuauauggcuacacucaaaaaugugaccgaaguuaagggcuacacgaagggcgggccuggacacgaggaaccgauucccauggccaccuaugguuggaaccuaguaaaacugcacuccggcguggaugucuucuacaagccaacagaacagguggacacuuugcugugugauaucggggagaguucuagcaauccuaccauagaagagggacgaacacuccggguucuuaaaaugguggaacccuggcugucauccaagccugaguuuugcaucaaagucuugaacccauauaugcccacugugauugaagaacuggagaagcuccagcguaaacauggcgguaguuuaguaagauguccucugagccgcaauucuacccacgaaauguacuggguguccgggguuucaggaaacaucgucagcucggugaauacaaccucuaagaugcuucugaacagguucacuacgcggcauagaaagccaacauaugagaaagacgcagaucuaggcgcuggcacccgcaguguguccacugaaaccgagaagcccgacaugacaauuaucgggaggcgacuccaacggcugcaggaggaacacaaagagacguggcacuacgaucaugaaaauccguacagaaccugggccuaucacggaagcuacgaggccccuucaacugguuccgcgucuagcauggucaacggcguugugaaguugcugacaaaaccaugggacguagugcccauggucacccagcucgcuaugacugacacaaccccuuuugggcagcaaaggguguucaaggaaaagguugauacacgcacuccacagcccaaaccgggaacccguguggucaugacgaccacagcaaauuggcuuugggcccuguuaggccggaagaaaaacccuagacugugcacuagggaggaguuuauuaguaaggugcgcuccaaugcugccaucggugcaguauuccaggaagaacagggguggaccagcgccucugaagcuguuaacgacucacgauuuugggaguugguggauaaagaacgggcgcuccaucaagagggaaagugugagaguugcgucuauaauaugaugggcaagagagagaaaaagcugggcgaguucgggagggccaaaggaucccgcgcaauaugguacauguggcuaggugcuagauuucuugaguucgaggcccugggcuuccucaacgaagaccacugguuugggcgggagaacagcuggucuggaguggagggcgaaggucugcauagguugggguauauucuggaggauaucgacaagaaagauggagaccucaucuacgcagaugacacagccggcugggauacucguauuaccgaagacgaucuucugaaugaggaguuaauaacggaacagauggcuccccaccacaagauccuggccaaggcgauuuucaaauugacauaucagaacaagguggucaaaguucuccgaccaaccccuaagggcgcagugauggacaucauuucgcgcaaagaccaaagagggucaggacagguagguacuuacggccugaauacauuuaccaacauggaggugcagcuaauccggcagauggaagccgagggggucauaacuagggaugacaugcauaaucccaagggacuuaaagaacgcguggagaaguggcugaaggagugcggcguugauagacucaaacggauggcuaucagcggugacgauuguguggucaagccacuggacgaaagguucuccaccaguuuguuauuucugaacgauauggggaaagugcgaaaggacauuccccaaugggagccuucuaaaggauggaagaauuggcaggaaguaccauucugcagccaccauuuucacaagaucuucaugaaagauggccguucccucguugugccguguagaaaccaggacgagcuuauuggccgcgcccggaucucacagggggcaggauggagucugagggaaacagcuugccuagguaaggccuacgcucaaauguggucucugauguauuuucacagacgcgaucuccgguuggccagcauggcaauauguuccgcgguccccacggagugguucccuaccucaaggacuacauggagcauucaugcccaccaucaguggaugaccacugaggacaugcugaaaguguggaaucgaguuuggaucgaagacaacccaaauaugaucgauaagacacccgugcacucuugggaggacauuccuuaccuuggcaaaagagaagaucuguggugcgggucccucauaggauuaaguagccgggcuaccugggccaagaacauccauacggcaauuacacaggucaggaaucugaucggcaaggaggaauauguggacuacaugccaguaaugaaacgcuauucggcucacuuugaguccgaggguguguuguga

SEQ ID NO: 15702 - RNA, 9867 nt, Artificial Sequence
  derived and/or modified CDS sequence (opt3) from DENV-4__GQ868594__SS-prME
agcaccaugacacugcucugccuuauccccacugugauggccuuccaccuguccacgagagacggcgagccuuugaugauugucgcuaagcaugaaagggggcggccauuacuguuuaaaaccacagagggaauaaacaaguguacucuaaucgcaauggaucucggugaaaugugcgaggacaccguuacauacgaauguccgcugcuugugaauaccgagcccgaggauauugacugcugguguaaccugacuucugccuggguaauguauggcacaugcacccagucaggggaacgccgacgugagaaaagaaguguggcguugacgccucacagcggaaugggccucgaaacuagggcugagaccuggauguccucugagggugccuggaagcaugcacaacgggucgaaucguggauccugcgcaauccaggguucgcccugcucgcuggauuuauggcauacaugauuggccagacaggcauccagagaacuguguucuuuguuuuaaugaugcugguggcccccucauaugggaugaggugugucggaguggguaaccgggauuucguagagggcguuagcgggggagcuuggguggaccuugucuuggaacacggcgguugcgugaccacaauggcccaggggaaaccuacccuggauuuugagcuaauaaagacgacugcgaaggaaguggcacuccugcgcacauacuguaucgaggccaguauuuccaauaucaccacugcuacacgaugcccaacccaaggagagcccuaucuuaaagaagagcaggaccagcaguacauuuguagaagggaugucguugaccggggcuggggcaacgggugcggacuguucgguaagggcggggugguaacgugcgccaaauuuucuuguagcggaaagaucaccggcaauuuggugcaaauagaaaaccucgaguauacagucgugguuacugugcauaauggugauacccacgcagucgggaacgacauuccuaaucacggcgugacagcuacuaucaccccacguuccccgucaguagaaguuaaacugcccgauuacggagaguuaacacuggacugcgagccucgcaguggcauugacuucaacgaaaugauccucaugaagaugaagaaaaagaccuggcuugugcauaaacagugguuucuggauuugccacuacccugggccgcgggggccgacacuagcgagguccacuggaauuacaaggaaagaauggugacguucaaagucccucaugcaaagaggcaggaugugaucguucugggaucucaggagggugcuaugcacuccgcccucacaggcgcuaccgaaguggacucaggggauggaaaccacauguuugccggccaucugaaauguaagguacggauggagaagcuucgaauuaaagguaugagcuauacuaugugcagugggaaguucucuauagacaaagagauggcagaaacccaacacggcacaaccgucgugaagguuaaauacgagggagccggcgcuccauguaaggugcccaucgaaauucgcgaugucaauaaggagaaagugguagggagaaucauauccagcacuccguucgcggaguauacaaacucggugacgaacauugaacuggagccucccuuuggagacucuuacaucguuaucggugucggcgauuccgcauugacccuccauugguucaggaaggggucaaguauuggaaaaaugcuggaaagcacuuaucggggcgccaagcgcauggcuaucuuaggugagacagccugggacuuuggguccgugggcggacugcuaaccucucucggcaaagcagugcaccaggucuucgggagcguuuacacaacuauguuuggaggcgugucauggauggugagaauucugauagguuuccuuguauuguggaucgggaccaauaguaggaacacguccauggccaugaccugcauugcugucggaggcaucacacuguuucucgguuucacugugcaugccgauaccggcugugcaguuagcuggucugggaaggaacugaagugcggaucaggcaucuuugugauugacaauguccacacauggacugagcaguauaaauuccaaccagagaguccugcgcgucuugcuagcgccauacugaacgcacacaaggacgggguguguggaauccgguccaccacgcgauuggaaaauauuauguggaaacagaucacaaacgagcucaauuacguucugugggaaggcggucaugauuuaaccgugguagccggggacgucaagggagugcugucuaaaggcaagagagcucuagcccccccagugaacgaucucaaguacucguggaaaacuugggguaaggcaaaaauuuuuacacccgaggcuaagaauagcaccuuccugaucgacggcccugauacuuccgaaugcccaaacgagaggcgcgccuggaauuuucuugaggucgaagacuauggguucggaauguucaccacaaacauauggaugaaauuucgggagggcucaagugaaguuugugaucacagauugaugucugcggccaucaaggaccagaaagcugugcaugcagauaugggguacuggauugagagcuccaagaaucagacguggcaaaucgaaaaggccucacugauugagguaaaaaccugccucuggccgaagacucacacacuguggagcaacggaguguuagagucucagaugcugauccccaaagcuuaugccggcccuuucucccagcacaauuacaggcaggguuaugcaacccaaacagucgggccauggcaucuuggaaaguuggaaauagacuuuggcgagugccccgguacuaccgugacgauucaggaagauugugaccaccgcggcccuagucuccgaacaaccacugcgagcgggaaacugguuacccaguggugcugucggucuugcacaaugccaccccuacguuuccugggagaggauggcuguugguacgggauggagaucagaccgcucuccgaaaaggaggaaaacauggugaagucacaggucagugccggacaaggcacuagcgagaccuuuucgaugggucugcuuugcuugacacuguucguggaagaguguuuaaggcgccggguuacgagaaaacauaugauucucguggucguaaccacucugugcgcuaucauacuugggggacugacauggauggacuugcucagggcccugaucaugcuaggcgacaccauguccggccgaauggggggacagauucaccuggcaaucauggcuguguuuaagaugucuccugguuauguucucggcauuuuccugcgcaaacuuacuagccgggagacagccuugauggugaucgggauggcaaugaccacgguccugucaauaccacaugauuuaauggaauuuauugacggaaucagucucggccugauccuucugaagauggugacucacuucgauaacacccagguagguacacuagcccucucccugaccuuuauuagaucuacuaugcccuuggugauggcuuggaggacaaucauggcgguccuguucguugugaccuuaauuccucucugucguacaagcugccugcagaaacaaucccacuggguggagauaacugcccuuauccugggggcacaggcuuugcccgucuaccucaugacccugaugaagggagccucaaagcgcagcuggccacuaaaugaaggcauuauggccgugggccugguuagucuucucgggucugcucuguugaaaaacgacguaccucuggcaggacccaugguggccgguggcuuacuccuggcggcuuacgucauguccgggagcucggccgaucuuucacuggagaaggcagccaaugugcagugggacgaaauggcugauaucacgggaucuaguccaauuaucgagguuaaacaagacgaggauggcuccuuuagcauacgggacaucgaagagacaaacaugauuaccuugcucgugaagcuggcacuaaucacugucucuggucuguauccgcuugccauuccugugaccaugacacucugguacauguggcagguaaaaacucagagaagcggggcgcugugggauguccccuccccagcugccgcacagaaggccaccuugacggaaggaguguauaggaucaugcaacgaggcuuauucggcaagacacagguuggggugggaauacauauggagggugucuuccacaccauguggcaugugacucggggcucaguuauuugucacgaaacagggcgccuggagcccaguugggcugacgugagaaaugauaugaucagcuacggaggcgguuggaggcucggggacaaaugggacaaggaggaagauguccaggugcuggccaucgagccuggaaaaaacccaaagcauguacagaccaaacccggccuuuuuaagacucugacaggcgaaauuggggcagugaccuuggacuucaaaccuggaacgucugguuccccgauaaucaaucggaagggcaagguuauugggcuauauggaaacggcgucgugacuaaaucaggugauuacgugagugcuaucacccaagccgagcgaacaggggagccagacuaugaagucgaugaggacauuuuuagaaagaaacgccugaccaucauggaucuccaccccggagcgggcaagacaaaaaggauacugccuagcaucguacgugaagcccuuaagcggagauuaaggacucugauucucgcaccaacccgcgugguugcugccgagauggaagaggcuuugcgaggccugcccaucagauaccagacgccugcagugaaguccgagcacacagggcgggaaauugucgaccucaugugccaugccacuuucaccacaaggcugcuuucuucgacccgcgugccgaauuacaaccugaucguuauggaugaggcccacuuuacugaccccagcucaguggcugcgcguggauauauauccaccagagucgaaaugggugaggcagccgcuauuuucaugacagccacgccaccuggcgcaacugaucccuuuccacagaguaauucuccuaucgaagacaucgagcgggagauucccgaaaggagcuggaacaccggguucgacuggaucacagauuaccagggaaaaaccgugugguuuguaccauccauaaaggccggcaaugacauugcuaacugcuugcgcaaaucagguaagaaagugauccaacuaucucgaaagacuuucgauacagaguauccgaagaccaaacugacggacugggauuuuguugucacuacagacauuagcgaaaugggggcgaauuucagagccggccgggugaucgauccuaggcgcugucucaagcccgugauaaguaccgacggaccagagagagucauuuuagcaggccccaucccuguuaccccagcuuccgccgcacagaggcgggggcguaucggacgcaaccccgcccaggaagaugaccaauacguguucagcggugauccucugaaaaacgacgaggaucaugcucacuggacugaggccaagaugcuucuggacaauauuuauacaccggaaggcaucauuccaacccucuuugggcccgagcgagaaaaaaaccaggcgauagacggagaguucagauugaggggcgagcagcggaagacauuuguagaacugaugcgcagaggugaucucccuguguggcugucuuacaaggucgcaucagccgggaucuccuauaaagacagggaguggugcuucacuggcgaacggaauaaccagauucuugaggaaaauauggagguggagaucuggacgcgagaaggagagaagaaaaagcuaagacccaaauggcuggaugcucgcguuuacgccgacccaauggcuuugaaggauuuuaaggaauucgcaaguggcaggaaaagcaucaccuuagacauucugacagagauagccucgcucccuacuuaccugucuucccgggcuaagcuugcccuggauaacaucgugaugcuccacaccacagaacgugggggaaaagcauaucaacaugcguugaaugagcugcccgagagccuagaaacccugaugcucgucgcccuucugggugcuaugacugccggcauuuuuuuauucuuuaugcaggggaagggaaucggcaaauugucaaugggucugauugcaaucgcuguagccagugggcuccuguggguggcagagauacagccacaguggaucgccgcuucuauuauccuugaauucuuucugaugguucucuugauuccugagccggaaaagcaaagaacgccccaggacaaccagcugaucuacgugauauuaaccauucuaacaaucauuggccugaucgcggccaaugagaugggacucauagagaaaacuaagaccgauuucggcuuuuaucaggucaagacagaaaccacuauccuugacguggaucugaggccagcauccgcuuggacauuguacgccgucgccacgaccauucugacuccuaugcuccgccacacaaucgagaacaccagcgcaaaucugucacuugcugccauugcgaaccaagcugccgugcucauggggcugggaaaaggcuggcccuugcaucggauggaccuggguguuccauuacuagcaaugggguguuauagucaggugaauccuaccacacugaucgccagccucguaaugcuucuggugcacuacgcuauaauuggacccggcuugcaggcaaaggccacucgagaagcgcagaaaagaacggcugccgguaucaugaagaacccgaccgucgauggcaucacaguuauugaccuggagccaaucuccuaugacccuaaauucgagaagcaacucgggcaggugaugcugcuugucuuaugcgcaggacagcugcucuugaugaggacuaccugggccuucugugaagugcugacacuagcuaccggccccguacugacucucugggaggggaauccaggacgcuuuuggaacacgacaauagccgugucuaccgcaaacauuuuccggggcagcuaccuugcuggugccgggcuggcguuuuccuugaucaagaaugcccaaacucccagacguggaaccggcacaacuggugaaacccugggcgagaaauggaagaggcagcucaacucacuggaucggaaagaauucgaggaguacaagcgcucugggauuuuagaaguugaccgaacagaggcaaaaagugcucuuaaggauggaucgaagaucaaacaugccgugagcagaggcuccucuaagauaagguggaucgucgaacgggggauggugaaaccuaagggaaaagucguggaccugggcugcggucgcgggggauggucauauuacauggcaacgcucaagaauguuaccgagguaaagggcuauacuaaaggcgggccgggacacgaagagcccauuccaauggcuacauacgguuggaaccuagugaagcugcacagcggcgucgauguguuuuauaaaccuaccgagcagguugacacuuugcugugugauaucggggaauccaguucuaaucccacaauugaggaaggaagaacccucagggugcuuaagauggucgagccuuggcugagcucaaaaccagaauucugcaucaagguguugaaccccuacaugccuacgguaauugaggagcuggaaaaacuccagcgaaagcauggcgguuccuuagugcgguguccacugagucguaauagcacccacgagauguauuggguuucuggggucuccggaaacaucgugucaagcgugaauacaacuucgaagaugcuucugaacagauuuaccacacgccauaggaaacccacuuacgaaaaggacgucgaucuaggcgccggcacccggucuguuaguacagagaccgagaaaccggacaugacuauaauugggagacgccuccaaaggcugcaggaagagcacaaggaaacguggcacuacgaucaggagaauccuuaucgaacaugggccuaccauggauccuaugaagcgccaagcaccgguucagcuuccucuauggugaacggcguagugaaauugcugacuaagcccugggacgucaucccuauggugacccagcucgcaaugacagacacgaccccauucgggcaacagcggguuuuuaaggagaaaguggauacuagaacaccccagccgaagccuggaaccaggauggucaugacuacaaccgccaauuggcuuugggcucuguuaggcaaaaagaaaaacccccgccugugcacacgugaggaauucaucagcaaggugcggaguaaugccgcaauuggugccguauuucaggaggaacaaggguggacuuccgcuagcgaggcgguuaacgacucuagauucugggaauugguggauaaggagagggcccuccaccaggagggaaaaugugaaucaugcgucuacaauaugaugggcaagcgcgagaaaaagcugggcgaauuugggcgagcaaaaggaagucgggcuauaugguauauguggcuaggugccagauuccuugaguucgaagcacugggcuuucucaacgaggaccauugguucgggagggagaacuccuggagcggaguggaaggcgagggucugcaccgcuugggguacauccuggaagauauugacaagaaggauggagaccucaucuaugccgaugacaccgcuggcugggauacgagaauuaccgaggacgaucuucugaaugaggaauuaaucacagagcagauggccccacaucacaaaauacuggcgaaggcaaucuuuaaauugacuuaccaaaacaagguggucaaaguucuccggccuacccccaagggcgccgugauggacauuaucucuaggaaagaccagcgugggucgggacagguagguacauacggccugaauacuuucaccaacauggaagugcagcuaauucgacaaauggaggcugaaggggucaucacgcaggaugacaugcacaauccaaagggacuuaaggagcgcguggagaaauggcugaaggaaugcggcguugauagacucaaacggauggccauaucaggugacgauuguguggucaagccccuggacgagagguuuagcacauccuuguuauuccugaacgauauggggaaagugcgcaaggacauuccucagugggaaccaaguaagggauggaaaaauuggcaggagguaccguuuugcucucaucacuuccauaagaucuuuaugaaagauggcagaagccucguugugcccugucggaaccaagacgaacuuaucggcagggcacgaauuucccagggggcuggauggucacugcgugagaccgccugccuagguaaggcuuaugcccagauguggagucugauguacuuccacagacgcgaucuccgguuggcaucuauggcgauauguagcgccgucccuacugagugguuuccaacauccaggaccacuuggucaauccacgcucaucaccaguggaugaccacagaagacaugcugaaaguguggaauagaguuuggauugaggacaaccccaauaugacggauaagaccccugugcauagcugggaagacaucccauaucuuggcaagcgcgaggaucuguggugcgggucucucauuggauuauccagucgggccacuugggcaaaaaacauccacacagcuauaacccaagucaggaaucugaucggcaaggaagaguacguggacuauaugcccguaaugaaacgauacagcgccccuuucgagucggaagguguguuguga

SEQ ID NO: 15703 - RNA, 9867 nt, Artificial Sequence
  derived and/or modified CDS sequence (opt3) from DENV-4__FJ024424__SS-prME
agcaccaucacacugcucugccuuauucccacugugauggccuuccaccuguccacgcgggacggcgagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacaaccacuauuacgccucguucaccaaguguagagguuaagcugccggauuacggagaauuaacacuggacugcgagccccgcagcggcaucgacuucaacgagaugauucucaugaagaugaaaaagaaaaccuggcuugugcauaagcagugguuucuggauuugccucuaccauggacugcaggggcugacaccucugaaguccacuggaauuacaaagagagaauggugacauucaaggucccccaugccaaaaggcaggaugugaccguucugggaucccaggaaggugcgaugcacucagcccucgcaggcgcuacugagguggacagcggggauggaaaccacauguuugccggccaucugaaguguaagguacggauggaaaaacuucgaaucaaggguaugaguuauacaaugugcucugggaaauucuccaucgacaaggagauggcugagacgcaacacggcaccacugucgugaaaguuaaguacgaaggagccggcgcaccuuguaaggugccaauugagauacgcgaugucaauaaagaaaaggugguagggagagugaucagcucgacaccccuggccgagaacaccaacucuguuacaaauauugaguuggaaccgccuuucggagacuccuauaucgucauaggugugggcaacucagcucucacucugcauugguuuaggaaagggaguagcauuggaaagauguucgaguccaccuaccggggcgcgaaacgcauggcaaucuuaggugaaacggccugggauuuugggucugugggcggacuguucaccagccuaggcaaggcuguccaccagguuuuugggucaguguauacaacuauguucggaggcgugaguuggaugaucaggauucuaaucgguuuucugguacuuuggauugggaccaauuccagaaacacaagcauggccaugacuugcauagcagucggaggcaucaccuuguuccuggguuuuacggugcaggccgacaugggcuguguugugucuuggucagggaaggagcucaaaugcggaaguggcauuuucgucguggauaauguucauacauggaccgaacaauacaaguuucagcccgagagcccagcucgucuggccuccgcaauccuuaacgcgcacaaagacgggguguguggaauccggucuacuacacgacuggagaauguaauguggaagcagauuaccaacgaauugaauuauguccucugggagggcggucacgaccugacugugguggcuggggaugucaaaggaguuuuaaccaagggcaagagagcccugacaccucccgugucggaccuaaaauacagcuggaagacgugggguaaagcaaagauauucaccccagaagccaggaacuccacuuuucucaucgauggccccgacacaucagagugcccuaaugaacgccgggcuuggaacagucuggagguagaggauuacggguucggaauguucaccacaaauauuuggaugaaauuuagagaaggcucuagcgaggugugugaccauaggcuuauguccgccgcaaucaaggaucagaaagcuguccacgccgacaugggguauuggauugaaucaagcaagaaccaaacuuggcagaucgagaaggcgucuuugauagaagugaaaaccugccuguggccaaagacgcauacacucugguccaauggaguucuggagagucagauguuaaucccgaaaagcuacgccggccccuucucucagcacaacuaucgccaagguuacgcuacccagacuguggggccuuggcaccugggaaaacuugagauugauuuuggcgaaugcccagguaccacagucacuauccaggaggacugugaucaucgaggccccuccuugcggaccacaacggcaucagggaaacucgugacccaguggugcugucguaguugcacuaugccuccacugagauuccuaggagaagacggcuguugguaugggauggagauuaggccccugagcgagaaggaagagaacaugguuaagucgcaaguggccgcuggacagggcacauccgaaaccuuuucuaugggucuccugugccuuacuuuguucgucgaggaaugucugcgccggagaguaacaaggaaacacaugaucuuagccgugguuauaacccucugcgcaauuauccuagggggacuuacguggauggaucuguugcgagcgcucauuaugcugggcgacacuaugagcggccgcaucgggggacagacccaucuagccauaauggcuguguuuaagaugucaccggguuacguccugggcguguuccuccggaaacugacaaguagagagaccgcccuuaugguaaucgggauggcaaugacuacaaccuuguccauuccucacgaccugauggaguuaaucgauggaauuucucucggccugauccuucugaagauagugacacaguuugacaauacucaagucgguacccuagcucucagccugacguucauuagguccacaaugucauugguuauggccuggcguaccaucauggcagugcuguuuguggucacuuuaaucccacucugucgcaccagcugccugcagaaacagagucauuggguggaaauuacagcccuuauccugggggcucaagcguugcccguuuaucucaugacucugaugaagggagccucucggagauccuggccucuaaacgagggcauuauggcaguaggccuggugagccuucucgggucggcucuguugaagaaugaugucccccuggccggaccaaugguggccgguggcuuacuccuggcugcauacguuaugucagggucuagugccgaccuuucccuggaaaaagcggcuaacgugcagugggaugagauggccgacauaaccggaagcucuccuaucauugaagucaagcaggaugaggacggcagcuucuccaucagggauguggaggaaacgaauaugauuacauugcucguaaaacuggcacuaaucaccgucucaggucuguacccccuugccauaccagugacuaugacacucugguauauguggcagguuaagacccaacgaaguggggcucugugggacgugccgagcccugcagccacucagaaagcggcuuugucugagggagucuaccggaucaugcagcgcggcuuauuuggcaagacacagguggggguuggcauucacauggaagguguguuccacaccauguggcaugucacgagaggcuccgugaucugucacgagacugggaggcuggaacccucaugggccgauguacggaacgacaugauuaguuauggaggcgguuggcgacucggggauaagugggacaaagaggaggacgugcaaguucuggcaaucgaaccaggaaagaaucccaaacauguccagaccaagccuggccuuuucaaaacacugaccggcgagauaggggccgugacauuggauuuuaagccaggaacuagcgguucccccauuaucaacagaaaaggcaaggugaucgggcuauacggaaauggcgucguaaccaagucuggugacuaugugucggcuauuacgcaggccgaacgcauaggggagccugauuacgagguugacgaagauaucuucaggaaaaagcgucugacaauuauggaccuccacccgggagcaggcaaaacuaagcggauccugccaagcauugugagagaggcucuuaaaaggcgcuuacgaacccugauccucgcccccacaagagucguggcggccgaaauggaggaagcauugcggggccugccuauaagguaucagaccccagcuguuaagucagagcauacugggcgcgagaucguggaucucaugugccacgccaccuuuacaacgcgucugcuuuccaguacuagaguccccaacuacaaucugauugugauggacgaagcucacuucaccgauccuucuagcguagcagcccggggauacaucuccacaaggguggagaugggugaagccgcugcgauuuuuaugaccgcaacuccgcccggcgccacagacccauucccucaaucaaacucucccaucgaggauauagaacgcgagauuccagagcgaagcuggaauaccggguuugacuggaucacggacuaucagggaaagacuguuugguucgucccuaguaucaaagcuggcaacgauauugccaauugcuugagaaaguccgguaaaaaggugauccagcuaagccggaaaacauuugacaccgaauaccccaagaccaagcugacugauugggacuucguggucacaaccgauauaucugagaugggggcaaacuuuagggccggccgcguuauugacccaagaaggugucucaaaccggugaucuuaacagauggaccugaacggguaauucuggcuggccccaucccagugacucccgcgucagccgcacaacgucgcgggcgaauaggaagaaacccuacgcaggaggacgaucaguaugucuucuccggugacccacuuaagaaugaugaagaccaugcucacuggaccgaggccaaaaugcugcucgauaacauuuacacacccgagggcaucaucccuacuuuguucgggccggaaagggagaagacccaggcaauugacggagaauuucggcugcgcggcgagcaaagaaaaacauucguggagcucaugaggcggggugaccugccaguuuggcuuaguuauaagguggccagcgcugggaucucguacaaggaucgagaauggugcuuuaccggcgagagaaauaaccagauucuagaagagaauauggaagucgagauauggacucgcgagggagagaagaagaaacugaggccccggugguuggacgcccguguauaugcggauccuauggcauuaaaggacuucaaagaguuugccucuggcagaaaguccaucacgcuggauauucucaccgaaaucgcuagccugcccacauaccuuucaaguagggccaagcuggcucucgacaacaucgugauguugcauacuaccgagcgcgggggacgggcauaccagcacgcccugaaugaacuaccagagucucuggagacacucaugcuuguugcucuguuaggugccaugaccgcaggcauuuucuuguuuuucaugcaggggaaaggaauaggcaagcuguccaugggucucaucacuauugcgguggccagcgggcugcuuugggucgcugaaauccaaccucaguggauugccgcaucaaucauacuggaguuuuuccucaugguguugcugauccccgaaccagagaaacagcgaacaccucaggauaaccaauuaauuuaugucauccuaacgauucugaccaucauaggccucauugcugccaaugaaaugggacuuaucgagaagacuaaaacagacuuuggcuucuaccaggugaagaccgagaccacaauucuggauguugacuugagaccggcaagugccuggacucuguaugcuguggcgacgaccauccucacacccaugcugaggcacacuauagaaaacaccagcgccaaucuuucccucgcagcuaucgccaaccaggccgcaguacugaugggguugggaaaaggcuggccacugcaucgcauggauuuaggugugccucuacuggcuaugggguguuacucucaggucaaucccacaacccucacugccagccuuguuaugcuguuggugcacuaugcgauuaucggaccaggccugcaagcuaaggccacgcgggaggcacagaagagaacagccgcugguauuaugaaaaacccuaccgucgacggcaucacugugauagaucucgaacccauuuccuacgacccgaaguuugagaaacagcuggggcaaguaaugcuuuuagugcugugcgcaggacagcucuugcugaugcguaccacaugggccuucugugagguucuaacucuggcgaccggcccaauccucacacuuugggaagggaauccuggaagguucuggaacacgaccaucgcugugucaacugccaacauuuuucggggcucuuaucuggccggugcaggguuggcuuucagucugaucaagaaugcccagacaccccgccgaggaaccggcacuacaggugagacccucggcgaaaaauggaagagacagcugaacucguuagacaggaaggaguuugaagaguacaaacggagcgggauacuugaggucgaucgcacggaagcaaaguccgcucugaaagacggaucuaagauuaaacaugccgugucaagaggcagcuccaagaucagguggauugucgagcgagggauggugaagccaaaaggaaagguuguagaucucggcugcgguagagggggauggaguuacuauauggcgacccucaaaaaugugacagaagucaagggcuacacuaaaggcgggcccggacacgaggaaccuaucccgauggccaccuaugguuggaaccuggugaaguugcauucuggcguugacguguucuacaagcccacagagcaagucgauacucugcucugugacauaggggagagcucauccaauccaaccaucgaagagggacguacacuuagagugcugaaaaugguagaaccuugguugaguagcaagcccgaguuuugcauuaaagugcugaacccuuauaugccaaccguuaucgaggaacucgagaaguuacagcgcaaacacggcgguaaucuggucagguguccccuuucucggaacuccacucacgaaauguacugggugucaggggcaagcggaaauauugugucgucugucaacacgacaaguaagaugcugcuaaauagauucaccacucgccauaggaaaccuaccuaugagaaggauguugaccucggcgcuggcacacgauccgugagcacggaaaccgagaagccagauaugacuaucauugggcggagacugcagagguugcaggaggaacacaaagagacauggcauuacgaccaagaaaaccccuaccgcaccugggccuaucacggaucauacgaggcaccguccacugguucugcuagcaguaugguaaauggcguggucaagcugcucacaaaaccuugggauaugaucccaauggugacccagcuugccaugacagacacuacccccuuugggcagcagcguguuuucaaggaaaaaguggacacgcggaccccucaaccaaagcccggaacaagaauggucaugacuaccacagccaacuggcugugggcguuacugggcaagaaaaagaauccgagguugugcacucgcgaggaguuuauauccaaagugcgaagcaacgcugcaauuggugccguauuccaggaagaacagggguggaccucugcuucagaagccguuaaugauagucgguuuugggagcucguggacaaggaaagagcacugcaccaagagggaaaaugugaguccugcgucuauaacaugaugggcaagagggaaaagaaacuaggcgaguucgggcgcgccaagggaagcagagcuaucugguacauguggcuuggugcgcgguuucuggaguucgaggcccucggcuuccugaacgaagaucauugguuugggagggaaaauucuuggucgggaguggagggcgaagguuugcaccgucugggguauauccucgaggaaauugacaaaaaggauggagaccuuauguacgcagaugacacggcuggcugggauacacgaauaaccgaggacgaucugcagaacgaggaauuaaucacugagcagauggccccucaucacaaaauucuggcaaaggccaucuucaaguugacauaucagaauaaaguggucaagguucuccgccccaccccaagaggcgcugugauggacauuaucucacggaaagaucaaagggggagcggacagguagguacuuacggccugaacaccuuuacaaauauggaagugcagcuaauacgccagauggaggccgaaggggucaucacgcaagacgacaugcagaacccuaagggacuuaaagagagaguggagaaguggcugcgggaaugcggcguugauaggcucaaacgaauggcgauuuccggugacgauuguguggucaagccccuggacgagcguuucgggaccaguuuguuauuucugaaugauaugggaaaggugagaaaagacaucccacagugggaacccucuaagggcuggaaaaacuggcaggagguaccuuucugcagccaucacuuucacaagauuuucaugaaagauggccgcucccucguugugccaugucggaaucaagacgaacuuaucgggagggcaagaauaucacagggagccgguuggagucugcgcgagacugcuugccuaggcaaggccuacgcacagauguggucucugauguauuuucaucggagggaucuccgauuggcuagcauggccauuuguuccgcugucccgacagagugguuccccaccucaagaacuacauggagcauccacgcccaucaccaguggaugaccacggaagacaugcugaagguguggaaccggguuuggaucgaggauaauccuaacaugauugacaaaacaccagugcacucuugggaagacauacccuaccuugggaagagggaggaucuguggugcggaucccucaucggcuuaaguagccgcgcaaccugggcgaaaaauauucauacugccaucacccaaguccguaaccugauugguaaggaagaguauguggacuacaugccuguaaugaaaagauauucggcuccauccgagucugaagggguguuguga

SEQ ID NO: 15704 - RNA, 9867 nt, Artificial Sequence
  derived and/or modified CDS sequence (opt3) from DENV-4__EU854295__SS-prME
agcaccaucacacugcucugccuuauucccacugugauggccuuccaccuguccacgcgggacggagagccuuugaugauagucgcuaagcaugaaagggggcggccauuacuguuuaaaaccaccgagggaaucaacaaguguacucugauugccauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccgaaaagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaaguggcugccggaccgggcacuuccgaaacauuuucuaugggucuccugugccuuaccuuguucgucgaggaaugucugcggagaaggguaacucgaaagcacaugaucuuagcagugguuauaacacucugcgcgauuauccuagggggacuuaccuggauggaucuguugcgcgcccucauuaugcugggcgacacgaugagcggccggaucgggggacagacucaucuagcuauaauggccguguuuaaaaugucaccugguuacguccugggcguguuccucagaaagcugaccaguagggagacagcacuuaugguaaucgggauggcuaugaccacuacauuguccauuccacacgaccugauggaguuaaucgauggaauuucucucggccugauccuucugaaaauagugacccaguuugacaauacacaggucgguacucuagcccucagccugaccuucauucguuccacgaugucauugguuauggcauggcgcacaaucauggccgugcuguuuguggucaccuuaaucccccucugucggacuagcugccugcaaaagcagagucauuggguggaaauuaccgcucuuauccugggggcgcaggccuugccuguuuaucucaugacacugaugaaaggagcaucuagaagguccuggccccuaaacgagggcauuauggcuguaggccuggugagccuucucgggucggcccuguugaagaaugaugucccacuggccggaccuaugguggcugguggcuuacuccuggcagccuacguuaugucagggucuagugcggaccuuucccuggaaaaggcugccaacgugcaaugggaugagauggcagacauaacuggaagcucucccaucauugaagucaaacaggaugaggacggcagcuucuccauccgagauguggaggaaaccaauaugauuacguugcucguaaagcuggcccuaaucacagucucaggucuguacccacuugcuauaccggugaccaugacucucugguauauguggcagguuaaaacacagcggaguggggcacugugggacgugccuagccccgccgcgacccaaaaggcugccuugucugagggagucuaccgcaucaugcagagaggcuuauuuggcaaaacucagguggggguuggcauucacauggaagguguguuccacacaauguggcaugucaccaggggcuccgugaucugucacgagacggggcggcuggaaccaucaugggcagauguacgaaacgacaugauuaguuauggaggcgguuggagacucggggauaagugggacaaggaggaggacgugcagguucuggccaucgaacccggcaaaaauccuaagcauguccaaacuaaaccaggccuuuucaagacccugacaggcgagauaggggcugugaccuuggauuuuaaacccggaacaagcgguuccccuauuaucaaccgcaagggcaaagugaucgggcuauacggaaauggcgucguaacuaagucuggugacuaugugucggccauuacccaggcagaaaggauaggggagccggauuacgagguugacgaagauaucuuccguaagaaacggcugacgauuauggaccuccacccaggagcuggcaagacaaaaagaauccugcccagcauugugagggaggcccuuaagcgccgauuaagaacucugauccucgcgccuacccgggucguggccgcagaaauggaggaggcuuugaggggccugccaauacgcuaucagacacccgccguuaaaucagagcauaccgggcgugagaucguggaucucaugugccacgcuacuuuuaccacaagacugcuuuccaguacgcgggucccuaacuacaaucugauugugauggacgaagcacacuucacugauccgucuagcguagccgccaggggauacaucuccacccgcguggagaugggugaagcugcggcaauuuuuaugacagccacacccccaggcgcuacugacccuuucccccagucaaacucuccaaucgaggauauagaacgagagauuccugagagaagcuggaauacaggguuugacuggaucaccgacuaucaaggaaagacgguuugguucguccccaguaucaaggccggcaacgauauugcaaauugcuugcggaaauccgguaagaaagugauccagcuaagcaggaagacuuuugacacagaauacccaaaaaccaagcugaccgauugggacuucguggucacuacagauauaucugagaugggggccaacuuucgcgcuggcagaguuauugacccgaggcggugucucaagccugugaucuuaaccgauggacccgaacguguaauucuggcgggcccaauccccgugacuccugccucagcagcucagcgccgagggagaauaggaaggaacccagcccaagaggacgaucaguaugucuucuccggugacccccuuaaaaaugaugaagaccaugcacacuggacugaggccaagaugcugcucgauaacauuuacacgccugagggcaucaucccgaccuuguucgggccagaacgggagaaaacacaggcuauugacggagaauuucgccugagaggcgagcagaggaagacuuucguggagcucaugcggcgaggugaccugcccguuuggcuuaguuauaaaguggccagcgcggggaucucguacaaggauagagaauggugcuuuaccggcgagcgcaauaaccaaauucuagaagagaauauggaagucgagauauggacaagggagggagaaaagaaaaagcugcggccucguugguuggacgcaagaguauaugccgaucccauggcuuuaaaagacuucaaggaguuugccucuggcaggaaauccaucacccuggauauucucacugaaaucgcuagccugccaacguaccuuucaagucgcgcaaagcuggcccucgacaacaucgugauguugcauaccacagagagagggggacgagcuuaccagcacgcccugaaugaacuaccugagucucuggagacucucaugcuuguugcacuguuaggugcgaugaccgccggcauuuucuuguuuuucaugcaggggaagggaauaggcaaacuguccaugggucucaucacaauugcuguggccagcgggcugcuuugggucgcagaaauccagccccaauggauugcugccucaaucauacuggaguuuuuccucaugguguugcugaucccagaaccugagaagcagagaaccccgcaggauaaccaguuaauuuaugucauccuaacuauucugacaaucauaggccucauugcagccaaugaaaugggacuuaucgagaaaacgaagaccgacuuuggcuucuaccaagugaaaacugagacaaccauucuggauguugacuugaggcccgcuagugcguggacccuguaugccguggcaacaacuauccucacgccaaugcugcgccacaccauagaaaacacaagcgcuaaucuuucccucgccgccaucgcaaaccaggcugccguacugaugggguugggaaagggcuggccucugcaucggauggauuuaggugugccccuacuggcgaugggguguuacucucaggucaauccaacuacccucacagcuagccuuguuaugcuguuggugcacuaugccauuaucggaccuggccugcaggcaaaagccaccagagaggcucaaaagcguacugcagccgguauuaugaagaaccccacggucgacggcaucacagugauagaucucgaaccgauuuccuacgacccaaaauuugagaagcagcuggggcagguaaugcuuuuagugcugugcgcgggacaacucuugcugaugaggaccacuugggcuuucugugagguucuaacccuggccacaggcccuauccucacucuuugggaagggaaucccggacgguucuggaacaccacaaucgcagugucaacggccaacauuuuucgcggcucuuaucuggcuggugccggguuggcauucagucugaucaaaaaugcucagaccccacgaagaggaacuggcacaaccggugagacucucggcgaaaaguggaaaaggcagcugaacucguuagaccggaaggaguuugaagaguacaagcgcagcgggauacuugaggucgauagaacagaagccaaauccgcgcugaaggacggaucuaaaauuaagcaugccgugucaaggggcagcuccaaaauccgauggauugucgagcgggggauggugaagcccaagggaaaaguuguagaucucggcugcggucgugggggauggaguuacuauauggcaacccuaaagaaugugacggaagucaaaggcuacaccaagggcgggccuggacacgaggaaccgauccccauggcuacauaugguuggaaccuggugaaauugcauucuggcguugacguguucuacaagccaacugagcaggucgauacccugcucugugacauaggggagagcucauccaauccuacaaucgaagagggaagaacucuucgcgugcugaagaugguagaacccugguugaguagcaaaccugaguuuugcauuaaggugcugaacccauauaugcccaccguuaucgaggaacucgagaaauuacaaaggaagcacggcgguaaucugguccgguguccucuuucuagaaacuccacacacgaaauguacugggugucaggggccagcggaaauauugugucgucugucaacaccacaaguaaaaugcugcuaaaucgcuucacgacaaggcaucgaaagccaaccuaugagaaagauguugaccucggcgcaggcacucgguccgugagcaccgaaacagagaagcccgauaugacgaucauugggagaaggcugcagcgcuugcaggaggaacacaaggagaccuggcauuacgaccaggaaaacccguaccguacuugggcuuaucacggaucauacgaggccccuuccacagguucugccagcaguaugguaaauggcguggucaaacugcucaccaagccaugggaugugauccccaugguuacucaacuugcgaugacagacaccacaccuuuugggcagcagcggguguucaaagaaaaggucgacacuagaaccccacagcccaaaccgggaacgagggugguaaugaccacaacugcuaacuggcugugggcauuacugggcaagaagaaaaauccucgcuugugcacccgagaggaguuuauauccaagguucggagcaacgccgcuauuggugccguguuccaagaagaacagggguggacaucugcaucagaagccgucaaugauaguagauuuugggagcucguggacaaagaaagggcucugcaccaggagggaaagugugaguccugcguguauaacaugaugggcaaacgcgaaaagaagcuaggcgaguucgggagagcgaaaggaagccgggccaucugguacauguggcuuggugcaagguuucuggaguucgaggcucucggcuuccugaacgaagaucauugguuugggcgugaaaauucuuggucgggagucgagggcgaagguuugcaccgacugggguauauccucgaggaaauugacaagaaagauggagaccuuauguacgccgaugacacugcaggcugggauacccgcauaacggaggacgaucugcaaaacgaggaauuaaucacagagcagauggcaccccaucacaagauucuggcuaaagccaucuucaaguugaccuaucagaauaagguugugaaaguacucagaccaacuccucggggcgcggugauggacauuaucucaaggaaggaucagcgcgggagcggacaagucgguacauacggccugaacaccuuuacuaauauggaagugcagcuaauaagacagauggaggcagaagggguuaucacccaggacgacaugcaaaaccccaaaggacuuaaggagcggguggagaaauggcugagggaaugcggcgucgaucgacucaagcguauggccauuuccggugacgauugugugguaaaaccacuggacgagagauucgggacaaguuuguuauuucugaaugauaugggaaagguucgcaaggacaucccccagugggaaccuucuaaaggcuggaagaacuggcaggaggugccauucugcagccaucacuuucacaaaauuuucaugaaggauggccggucccucgucgugccguguaggaaucaggacgaacuuaucgggagagcucgcauaucacaaggagccgguuggagucugcgggagacggcaugccuaggcaaggcuuacgcccagauguggucucugauguauuuucauaggcgagaucucagauuggcuagcauggccauuuguuccgcaguucccaccgagugguucccuacuucacggacaaccuggagcauccacgcgcaucaccaguggaugacuacagaagacaugcugaagguguggaacagggucuggaucgaggauaauccaaacaugauugacaagacccccgugcacucuugggaagacauaccuuaccuugggaaacgcgaggaucuguggugcggaucccucaucggcuuaaguagccgugccacgugggcuaagaauauucauacagccaucacccagguaagaaaccugauugguaaagaagaguauguggacuacaugccagucaugaagcgauauucggcacccuccgagucugaagggguuuuguga

SEQ ID NO: 15705 - RNA, 9867 nt, Artificial Sequence
  derived and/or modified CDS sequence (opt3) from DENV-4__EU854296__SS-prME
agcaccaucacucugcucugccuuauucccacugugauggccuuccaccuguccacgcgggacggagagccuuugaugauagucgcuaagcaugaaagggggcggccguuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccagcgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugcaaagggagucuuaacuaaaggcaagagggcccugaccccucccguuucggaccuaaaguacagcuggaaaacaugggguaaggcuaaaauauucacgccagaagcccgcaacuccaccuuucucaucgauggccccgacacuucagagugcccuaaugaacggagagcauggaacagucuggagguggaggauuacggguucggaauguucacaaccaauauuuggaugaaguuuagggaaggcucuagcgagguaugugaccaucgccuuauguccgcugccaucaaagaucagaaggcggugcacgccgacaugggguauuggauugaaucaagcaaaaaccaaacauggcagaucgagaaggcuucuuugauagaagucaagacuugccuguggccaaaaacccauacgcucugguccaauggagugcuggagagucagauguuaaucccaaagagcuacgcaggccccuucucucagcacaacuaucgacaagguuacgccacacagaccguugggccuuggcaccugggaaaacuugagauugauuuuggcgaaugcccagguacuaccgugacaauccaggaggacugugaucaucggggccccuccuugcguacuaccacagcuucagggaagcucgucacgcaguggugcuguagaaguugcaccaugccuccacugagguuccuaggagaagacggcuguugguaugggauggagauucgcccccugagcgagaaagaagagaacauggugaagucgcaaguuacugccggacagggcacauccgaaaccuuuucuaugggucuccugugccuuacuuuguucguggaggaaugucugcggagaagggucacacgaaagcacaugaucuuagcaguagugauaacccucugcgcgauuauccuagggggacuuacguggauggaucuguugcgcgcccucauuaugcugggcgacacuaugagcggccggaucgggggacagacccaucuagcuauaauggccguuuuuaaaaugucaccggguuacgugcugggcgucuuccucagaaagcugacaaguagggagaccgcacuuauggugaucgggauggcuaugacuacaaccuuguccauuccucacgaccugauggaguuaaucgauggaauuucucucggccugauccuucugaaaauaguaacacaguuugacaauacucaaguggguacccuagcccucagccugacguucauucguuccacaaugucauuggucauggcauggcgcaccaucauggccguucuguuuguggugacuuuaaucccacucugucggaccagcugccugcagaagcagagucauugggucgaaauuacagcucuuauccugggggcgcaagccuugcccguguaucucaugacucugaugaaaggagcaucuagaagguccuggccucuaaacgagggcauuauggcuguuggccugguaagccuucucgggucggcccuguugaagaaugaugugccccuggccggaccaauggucgcugguggcuuacuccuggcagccuacgugaugucagggucuagugcggaccuuucccuggaaaaggcugccaacguucagugggaugagauggcagacauaaccggaagcucuccuaucauugaagugaaacaggaugaggacggcagcuucuccauccgagaugucgaggaaacgaauaugauuacauugcucgugaagcuggcccuaaucaccguaucaggucuguacccccuugcuauaccagucacuaugacacucugguauauguggcaagugaaaacccaacggaguggggcacugugggacguuccgagcccugccgcgacucagaaggcugccuugucugagggaguguaccgcaucaugcagagaggcuuauuuggcaaaacacaggucggggugggcauucacauggaagguguuuuccacaccauguggcaugugacgaggggcuccgucaucugucacgagacugggcggcuggaacccucaugggcagaugugcgaaacgacaugauuaguuauggaggcgguuggagacucggggauaagugggacaaggaggaggacguacaagugcuggccaucgaaccaggcaaaaaucccaagcauguucagaccaaaccuggccuuuucaagacacugaccggcgagauaggggcugucacauuggauuuuaaaccaggaacuagcgguucccccauuaucaaccgcaagggcaaagugaucgggcuauacggaaauggcguggucaccaagucuggugacuauguaucggccauuacgcaggcagaaaggauaggggagccugauuacgagguggacgaagauaucuuccguaagaaacggcugacaauuauggaccuccacccgggagcuggcaagacuaaaagaauccugccaagcauuguuagggaggcccuuaagcgccgauuaagaacccugauccucgcgcccacacggguggucgccgcagaaauggaggaggcuuugaggggccugccuauacgcuaucagaccccagccgugaaaucagagcauacugggcgugagaucguugaucucaugugccacgcuaccuuuacaacgagacugcuuuccaguacucgggugcccaacuacaaucugauugucauggacgaagcacacuucaccgauccuucuagcguggccgccaggggauacaucuccacacgcguagagaugggugaagcugcggcaauuuuuaugaccgccacuccgcccggcgcuacagacccauucccucaaucaaacucucccaucgaggauauagaacgagagauuccagagagaagcuggaauaccggguuugacuggaucacggacuaucagggaaagacugugugguucguuccuaguaucaaggccggcaacgauauugcaaauugcuugcggaaauccgguaagaaagucauccagcuaagcaggaagacauuugacaccgaauaccccaaaaccaagcugacugauugggacuucguggugacaaccgauauaucugagaugggggccaacuuucgcgcuggcagagucauugacccaaggcggugucucaagccgguuaucuuaacagauggaccugaacgugugauucuggcgggccccaucccaguaacucccgccucagcagcucaacgccgagggagaauaggaaggaacccugcccaggaggacgaucaguauguguucuccggugacccacuuaaaaaugaugaagaccaugcacacuggacggaggccaagaugcugcucgauaacauuuacacccccgagggcaucaucccuacauuguucgggccggaacgggagaaaacucaggcuauugacggagaauuucgccugagaggcgagcaaaggaagaccuucgucgagcucaugcggcgaggugaccugccaguguggcuuaguuauaaaguugccagcgcggggaucucguacaaggauagagaauggugcuuuacaggcgagcgcaauaaccagauucuagaagagaauauggaaguggagauauggaccagggagggagaaaagaaaaagcugcggccccguugguuggacgcaagagucuaugccgauccuauggcuuuaaaagacuucaaggaguuugccucuggcaggaaauccaucacucuggauauucucacggaaaucgcuagccugcccaccuaccuuucaagucgcgcaaagcuggcccucgacaacaucguaauguugcauacaacugagagagggggacgagcuuaccagcacgcccugaaugaacuaccagagucucuggagacccucaugcuuguggcacuguuaggugcgaugacagccggcauuuucuuguuuuucaugcaggggaagggaauaggcaaacuguccaugggucucaucaccauugcuguugccagcgggcugcuuuggguggcagaaauccaaccucaguggauugcugccucaaucauacuggaguuuuuccucauggucuugcugauccccgaaccagagaagcagagaacuccucaggauaaccaauuaauuuaugugauccuaacaauucugacgaucauaggccucauugcagccaaugaaaugggacuuaucgagaaaaccaagacugacuuuggcuucuaccaggcuaaaacagagaccaccauucuggaugucgacuugaggccggcgagugccuggacacuguaugcaguggcuacuacgauccucacccccaugcugcgccacacaauagaaaacacuagcgccaaucuuucccucgccgcaaucgcuaaccaggccgcgguucugaugggguugggaaagggcuggccacugcaucggauggauuuaggugugccucuacuggcuaugggguguuacucucagguaaaucccaccacacucaccgccagccuugugaugcuguugguccacuaugcaauuaucggaccaggccugcaagccaaagcuacuagagaggcacagaagcguacggccgcggguauuaugaagaacccuacaguugacggcaucaccgugauagaucucgaacccauuuccuacgacccgaaauuugagaagcagcuggggcaagucaugcuuuuagugcugugcgcuggacagcucuugcugaugaggacuaccugggccuucugugagguacuaacacuggcaacuggcccaauccucacccuuugggaagggaauccuggacgguucuggaacacaacgaucgccgugucaaccgcuaacauuuuucgcggcucuuaucuggccggugcaggguuggcuuucagucugaucaaaaaugcccagacuccccgaagaggaacaggcaccauaggugagacucucggcgaaaaguggaaaaggcagcugaacucguuagaccggaaggaguuugaagaguacaagcgcagcgggauucuugagguugauagaacagaagcgaaauccgcccugaaggacggaucuaaaaucaagcaugcagugucaaggggcagcuccaaaauucgauggaucgucgagcgggggauggugaagccaaagggaaaagucguggaucucggcugcggucgugggggauggaguuacuauauggcuacccuaaagaauguuacggaaguaaaaggcuacaccaagggcgggcccggacacgaggaaccuauaccgauggccacauaugguuggaaccuggugaaauugcauucuggcgucgacguguucuacagacccacugagcaaguugauacccugcucugugacaucggggagagcucauccaauccaacaauugaagagggacgcacucuuagggugcugaagauggucgaaccuugguugaguagcaagcccgaguuuugcaucaaagugcugaacccuuauaugccaaccguaauugaagaacucgagaaguuacagcggaaacacggcgguaaucuggugagauguccccuuucucgcaacuccacacacgaaauguacuggguuucaggggcaagcggaaauaucgucucgucugugaacaccacaaguaagaugcugcuaaauagguucacgacacgacaucggaaaccuaccuaugagaaggauguggaccucggcgcuggcacuagauccgucagcaccgaaacagagaaaccagauaugacgauuaucgggaggcgccugcagcguuugcaggaggaacacaaggagaccuggcauuacgaccaagaaaaccccuaccggacuugggccuaucacggaucauacgaggccccguccacagguucugcgagcaguaugguuaauggcgugguaaagcugcucaccaaaccuugggaugugauaccaauggucacucagcuugcuaugacagacaccacacccuuugggcagcagagaguguucaaggaaaaaguugacacuaggaccccucaaccaaagcccggaacgcgcauggugaugaccacaacugcaaacuggcugugggccuuacugggcaaaaagaagaauccgcgauugugcacccgggaggaguuuauuuccaaagucagaagcaacgcugccaucggugcaguguuccaggaagaacagggguggacaucugccucagaagcuguaaaugauaguagguuuugggagcucguugacaaggaacgcgcgcugcaccaagagggaaaaugugaguccugcguguauaacaugaugggcaagagagagaaaaagcuaggcgaguucgggcgggccaagggaagcagggcaaucugguacauguggcuuggugcucguuuucuggaguucgaggcccucggcuuccugaacgaagaucauugguuugggcgagaaaauucuuggucgggagucgagggcgaagguuugcaccgccugggguauauucucgaggaaauagacaaaaaggauggagaccuuauguacgcagaugacacugccggcugggauaccagaaucacggaggacgaucugcagaacgaggaauuaauuacagagcagauggcuccucaucacaaaauccuggccaaggcgauuuucaaauugaccuaucagaauaagguggugaagguccuccggcccacuccaaggggcgcaguuauggacaucauaucacgcaaagaucaaagagggagcggacagguggguacauacggccugaacaccuuuacuaauauggaaguacagcuaauccggcagauggaggccgaaggggugauuacccaagacgacaugcagaacccuaagggacuuaaagagagggucgagaaguggcugcgagaaugcggcguggaucgucucaaaagaauggcuaucuccggugacgauuguguugugaagccccuggacgagcgcuucgggacaaguuuguuauuucugaaugauaugggaaaaguccggaaggacauuccacagugggaacccucuaagggcuggaaaaacuggcaggaggugccuuucugcagccaucacuuucacaagaucuucaugaaagauggcaggucccucguaguuccauguagaaaucaagacgaacuuauagggcgcgcccggauuucacagggagcagguuggagucugagggagacggcuugccuaggcaaggccuacgcucagauguggucucugauguauuuucaucgaagagaucuccgguuggccagcauggcaaucuguuccgcggugccgaccgagugguuccccacuucaaggacaaccuggagcauccacgcccaucaccaguggaugacuacagaagacaugcugaaagucuggaaccgcguguggauugaggauaauccuaacaugauagacaagaccccaguucacucuugggaagacauccccuaccuugggaagcgugaggaucuguggugcggaucccucauuggcuuaaguagcagagcuacgugggccaaaaauauccauacagcaauuacccaagugcgaaaccugaucgguaaggaagaguaugucgacuacaugccugugaugaaaagguauucggcuccauccgagucugaagggguauuguga

SEQ ID NO: 15706 - RNA, 9867 nt, Artificial Sequence
  derived and/or modified CDS sequence (opt3) from DENV-4__GQ199878__SS-prME
agcaccaucacucugcucugccuuauucccacugugauggccuuccaccuguccacgcgggacggagagccuuugaugauagucgcuaagcaugaaagggggcggccauuacuguuuaaaaccaccgagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccgaaaagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaaguggcugccggacagggcacuuccgaaacauuuucuaugggucuccugugccuuaccuuguucgucgaggaaugucugcggagaaggguaacucgaaagcacaugaucuuagcagugguuauaacacucugcgcgauuauccuagggggacuuaccuggauggaucuguugcgcgcccucauuaugcugggcgacacgaugagcggccggaucgggggacagacucaucuagcuauaauggccguguuuaaaaugucaccggguuacguccugggcguguuccucagaaagcugaccaguagggagacagcacuuaugguaaucgggauggcuaugaccacuacauuguccauuccucacgaccugauggaguuaaucgauggaauuucucucggccugauccuucugaaaauagugacccaguuugacaauacacaagucgguacucuagcccucagccugaccuucauucguuccacgaugucauugguuauggcauggcgcacaaucauggccgugcuguuuguggucaccuuaaucccacucugucggacuagcugccugcagaagcagagucauuggguggaaauuaccgcucuuauccugggggcgcaagccuugcccguuuaucucaugacacugaugaaaggagcaucuagaagguccuggccucuaaacgagggcauuauggcuguaggccuggugagccuucucgggucggcccuguugaagaaugaugucccccuggccggaccaaugguggcugguggcuuacuccuggcagccuacguuaugucagggucuagugcggaccuuucccuggaaaaggcugccaacgugcagugggaugagauggcagacauaacuggaagcucuccuaucauugaagucaaacaggaugaggacggcagcuucuccauccgagauguggaggaaaccaauaugauuacguugcucguaaagcuggcccuaaucacagucucaggucuguacccccuugcuauaccagugaccaugacucucugguauauguggcagguuaaaacacaacggaguggggcacugugggacgugccgagcccugccgcgacccagaaggcugccuugucugagggagucuaccgcaucaugcagagaggcuuauuuggcaaaacucagguggggguuggcauucacauggaagguguguuccacacaauguggcaugucaccaggggcuccgugaucugucacgagacggggcggcuggaacccucaugggcagauguacgaaacgacaugauuaguuauggaggcgguuggagacucggggauaagugggacaaggaggaggacgugcaaguucuggccaucgaaccaggcaaaaaucccaagcauguccagacuaaaccuggccuuuucaagacccugacaggcgagauaggggcugugaccuuggauuuuaaaccaggaacaagcgguucccccauuaucaaccgcaagggcaaagugaucgggcuauacggaaauggcgucguaacuaagucuggugacuaugugucggccauuacccaggcagaaaggauaggggagccugauuacgagguugacgaagauaucuuccguaagaaacggcugacgauuauggaccuccacccgggagcuggcaagacaaaaagaauccugccaagcauugugagggaggcccuuaagcgccgauuaagaacucugauccucgcgcccacccgggucguggccgcagaaauggaggaggcuuugaggggccugccuauacgcuaucagacaccagccguuaaaucagagcauaccgggcgugagaucguggaucucaugugccacgcuacuuuuaccacaagacugcuuuccaguacgcggguccccaacuacaaucugauugugauggacgaagcacacuucacugauccuucuagcguagccgccaggggauacaucuccacccgcguggagaugggugaagcugcggcaauuuuuaugacagccaccccgcccggcgcuacugacccauucccucaaucaaacucucccaucgaggauauagaacgagagauuccagagagaagcuggaauacaggguuugacuggaucaccgacuaucagggaaagacgguuugguucgucccuaguaucaaggccggcaacgauauugcaaauugcuugcggaaauccgguaagaaagugauccagcuaagcaggaagacuuuugacacagaauaccccaaaaccaagcugaccgauugggacuucguggucacuacagauauaucugagaugggggccaacuuucgcgcuggcagaguuauugacccaaggcggugucucaagccggugaucuuaaccgauggaccugaacguguaauucuggcgggccccaucccagugacacccgccucagcagcucaacgccgagggagaauaggaaggaacccugcccaggaggacgaucaguaugucuucuccggugacccacuuaaaaaugaugaagaccaugcacacuggacugaggccaagaugcugcucgauaacauuuacacgcccgagggcaucaucccuaccuuguucgggccggaacgggagaaaacacaggcuauugacggagaauuucgccugagaggcgagcaaaggaagacuuucguggagcucaugcggcgaggugaccugccaguuuggcuuaguuauaaaguggccagcgcggggaucucguacaaggauagagaauggugcuuuaccggcgagcgcaauaaccagauucuagaagagaauauggaagucgagauauggacaagggagggagaaaagaaaaagcugcggccccguugguuggacgcaagaguauaugccgauccuauggcuuuaaaagacuucaaggaguuugccucuggcaggaaauccaucacccuggauauucucacugaaaucgcuagccugcccacguaccuuucaagucgcgcaaagcuggcccucgacaacaucgugauguugcauaccacagagagagggggacgagcuuaccagcacgcccugaaugaacuaccagagucucuggagacucucaugcuuguugcacuguuaggugcgaugaccgccggcauuuucuuguuuuucaugcaggggaagggaauaggcaaacuguccaugggucucaucacaauugcuguggccagcgggcugcuuugggucgcagaaauccaaccucaguggauugcugccucaaucauacuggaguuuuuccucaugguguugcugauccccgaaccagagaagcagagaaccccucaggauaaccaauuaauuuaugucauccuaacuauucugacaaucauaggccucauugcagccaaugaaaugggacuuaucgagaaaacgaagaccgacuuuggcuucuaccaggugaaaacugagacaaccauucuggauguugacuugaggccggcuagugcguggacccuguaugccguggcaacaacuauccucacgcccaugcugcgccacaccauagaaaacacaagcgcuaaucuuucccucgccgccaucgcaaaccaggcugccguacugaugggguugggaaagggcuggccacugcaucggauggauuuaggugugccucuacuggcgaugggguguuacucucaggucaaucccacuacccucacagcuagccuuguuaugcuguuggugcacuaugccauuaucggaccaggccugcaagcaaaagccaccagagaggcucagaagcguacugcagccgguauuaugaagaacccuacggucgacggcaucacagugauagaucucgaacccauuuccuacgacccgaaauuugagaagcagcuggggcaaguaaugcuuuuagugcugugcgcgggacagcucuugcugaugaggaccacuugggcuuucugugagguucuaacccuggccacaggcccaauccucacucuuugggaagggaauccuggacgguucuggaacaccacaaucgcagugucaacggccaacauuuuucgcggcucuuaucuggcuggugccggguuggcauucagucugaucaaaaaugcucagacaccccgaagaggaacuggcacaaccggugagacucucggcgaaaaguggaaaaggcagcugaacucguuagaccggaaggaguuugaagaguacaagcgcagcgggauacuugaggucgauagaacagaagccaaauccgcgcugaaggacggaucuaaaauuaagcaugccgugucaaggggcagcuccaaaauccgauggauugucgagcgggggauggugaagccaaagggaaaaguuguagaucucggcugcggucgugggggauggaguuacuauauggcaacccuaaagaaugugacggaagucaaaggcuacaccaagggcgggcccggacacgaggaaccuaucccgauggcuacauaugguuggaaccuggugaaauugcauucuggcguugacguguucuacaagcccacugagcaagucgauacccugcucugugacauaggggagagcucauccaauccaacaaucgaagagggaagaacucuucgcgugcugaagaugguagaaccuugguugaguagcaaacccgaguuuugcauuaaggugcugaacccuuauaugccaaccguuaucgaggaacucgagaaauuacagaggaagcacggcgguaaucugguccgguguccccuuucuagaaacuccacacacgaaauguacugggugucaggggccagcggaaauauugugucgucugucaacaccacaaguaaaaugcugcuaaaucgcuucacgacaaggcaucgaaagccuaccuaugagaaagauguugaccucggcgcaggcacucgguccgugagcaccgaaacagagaagccagauaugacgaucauugggagaaggcugcagcgcuugcaggaggaacacaaggagaccuggcauuacgaccaagaaaaccccuaccguacuugggcuuaucacggaucauacgaggccccguccacagguucugccagcaguaugguaaauggcguggucaaacugcucaccaagccuugggaugugaucccaaugguuacucagcuugcgaugacagacaccacacccuuugggcagcagcggguguucaaagaaaaggucgacacuagaaccccucaaccaaaacccggaacgaggauggugaugaccacaacugcuaacuggcugugggcauuacugggcaagaagaaaaauccgcgcuugugcacccgagaggaguuuauauccaagguacggagcaacgccgcuauuggugccguuuuccaggaagaacagggguggacaucugcaucagaagccgugaaugauaguagauuuugggagcucgucgacaaagaaagggcucugcaccaagagggaaagugugaguccugcguguauaacaugaugggcaaacgcgaaaagaagcuaggcgaguucgggagagcgaaaggaagccgggccaucugguacauguggcuuggugcaagguuucuggaguucgaggcucucggcuuccugaacgaagaucauugguuugggcgugaaaauucuuggucgggaguggagggcgaagguuugcaccgacugggguauauccucgaggaaauugacaagaaagauggagaccuuauguacgccgaugacacugcaggcugggauacccgcauaacggaggacgaucugcagaacgaggaauuaaucacagagcagauggccccucaucacaagauucuggcuaaagccaucuucaaguugaccuaucagaauaaggucguuaaagugcucagacccacuccacggggcgcgguaauggacauuaucucaaggaaggaucaacgcgggagcggacagguggguacauacggccugaacaccuuuacuaauauggaaguccagcuaauaagacagauggaggcagaaggggugaucacccaagacgacaugcagaacccuaaaggacuuaaggagcggguugagaaauggcugagggaaugcggcguggaucgacucaagcguauggccauuuccggugacgauugugucgugaaaccccuggacgagagauucgggacaaguuuguuauuucugaaugauaugggaaagguacgcaaggacaucccacagugggaacccucuaaaggcuggaagaacuggcaggagguuccuuucugcagccaucacuuucacaaaauuuucaugaaggauggccggucccucguggucccauguaggaaucaagacgaacuuaucgggagagcucgcauaucacagggagccgguuggagucugcgggagacggcaugccuaggcaaggcuuacgcccagauguggucucugauguauuuucauaggcgagaucucagauuggcuagcauggccauuuguuccgcagugccgaccgagugguuccccacuucacggacaaccuggagcauccacgcgcaucaccaguggaugacuacagaagacaugcugaagguuuggaacaggguguggaucgaggauaauccuaacaugauugacaagaccccaguccacucuugggaagacauacccuaccuugggaaacgcgaggaucuguggugcggaucccucaucggcuuaaguagccgugccacgugggcuaagaauauucauacagccaucacccaagugagaaaccugauugguaaagaagaguauguagacuacaugccugugaugaagcgauauucggcaccauccgagucugaaggggucuuguga

SEQ ID NO: 15707 - RNA, 9867 nt, Artificial Sequence
  derived and/or modified CDS sequence (opt3) from DENV-4__GQ199879__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugguaagaauccucauugguuuucugguccuuuggaucgggacuaauuccaggaacaccagcauggcaaugacaugcauugccgugggaggcauaacuuuguuccuggguuuuaccguucaggcugacaugggcuguguggucucuuggucagggcgugagcucaagugcggaaguggcaucuucgugguugauaaugugcauacguggacagaacaauacaaauuucagcccgagagcccagcccggcuggcauccgcgauucuuaacgcucacaaggacgggguauguggaauccgaucuaccacuagacuggagaaugucauguggaaacagaucacaaacgaauugaauuaugugcucugggagggcggucacgaccugaccguggucgccggggauguuaagggaguguuaacuaaaggcaagagggcacugaccccucccguaucggaccuaaaguacagcuggaaaacaugggguaaggccaaaauuuucacgccagaagcucgcaacuccaccuuucucauagauggccccgacacuucagagugcccuaaugaacggagagccuggaacagucuggagguggaggauuacggguucggaauguucacaaccaauaucuggaugaaguuuagggaaggcucuagcgaggucugugaccaucgccuuauguccgcagcuauuaaagaucagaaggccgugcacgcggacaugggguauuggaucgaaucaagcaaaaaccaaacauggcagauugagaaggccucuuugaucgaaguuaagacuugccuguggccaaaaacccauacgcucugguccaauggagugcuggagagucagauguuaauaccgaagagcuacgcuggccccuucucucagcacaacuaucgacaagguuacgcaacacagaccgucgggccuuggcaccugggaaaacuugagaucgauuuuggcgaaugcccagguacuaccgugacaauucaggaggacugugaucaucggggccccuccuugcguacuaccacagccucagggaagcucguuacgcaguggugcuguagaaguugcaccaugccuccacugagguuccuaggagaagacggcuguugguaugggauggagauccgcccccugaacgagaaagaagagaauauggugaagagccaagucacugcuggacagggcacaucggaaaccuuuuccaugggucuccugugccuuacuuuguucguagaggaaugucugcggagaagggugacacgaaagcacaugauuuuaguuguggucaucacccucugcgccauaauucuggggggacuuacguggauggaucuguugcgcgcacucaucaugcugggcgacacuaugucuggccggauugggggacagauccaucuagcgauaauggccguguuuaaaaugagcccggguuacguacugggcguguuccucagaaagcugaccucaagggagacagcucuuauggucaucgggauggccaugaccacuguuuugaguauuccucacgaccugauggaguuaaucgauggaauuucccucggccugauccuucugaaaauagugacacaguuugacaacacccaaguggguacacuagcacucucucugacuuucauucguagcaccaugccauuggucauggcuuggcgcacgaucauggccgugcuguuuguuguaacauuaaucccccucugucggaccuccugccugcagaagcagucacauuggguggaaauuacugcacuuauccugggggcccaagcuuugccugucuaucucaugacccugaugaaaggagcgagcagaaggaguuggccccuaaaugagggcauuauggccgugggccugguuucucuucucggguccgcacuguugaagaacgaugugccacuggcuggaccuauggucgccgguggcuuacuccuggccgcuuacgugaugagcgggucgucagcagaccuuucucuggaaaaggccgcgaauguacagugggaugagauggcugacauaacaggaaguucccccaucauugaagucaaacaggaugaggacggcagcuucucuauccgagauguggaggaaacuaacaugauuaccuugcucguuaagcuggcccuaaucacggugagcggucuguacccacuugcaauaccggucacaaugacccucugguauauguggcaggugaaaacucaacgguccggggcccugugggacguuccuucacccgcugcaacacagaaggccgcguugagugagggaguguaccgcaucaugcagagaggcuuauuuggcaaaacccaggucggggugggaauucacauggaagguguauuccacacuauguggcaugugacaaggggcagcguuaucugucacgagaccgggcggcuggaaccaucuugggcugauguccgaaaugacaugauuuccuauggaggcgguuggagacucggggauaagugggacaaggaggaggacgugcaagugcuggccaucgaacccggaaaaaacccuaagcauguccagacgaaaccaggccuuuucaagacucugaccggcgagauaggggcaguaacauuggauuuuaaacccggaaccucagguaguccuauuaucaaucgcaagggcaaagugaucgggcuauacggaaacggcguugugacaaagagcggugacuaugucuccgccauuacucaggcugaaaggauaggggagccggauuacgagguggacgaagauaucuuccguaagaaacggcugaccauuauggaccuccacccaggagccggcaagacgaaaagaauccugcccucuauuguuagggaggcacuuaagcgccgauuaagaacacugauccucgcuccuacucggguggucgccgcggaaauggaggaagccuugaggggccugccaauacgcuaucagacccccgcagugaaaucggagcauacagggcgugagaucguagaucucaugugccacgcuaccuuuacuaccagacugcuuagcucaacacgggugccuaauuacaaccugauuguuauggacgaagcccacuucacggauccguccagugucgcugcaaggggauacaucucuacucgcguggagaugggugaagccgccgcuauuuuuaugaccgcgacacccccaggcgcaaccgacccuuucccccaaagcaauuccccaaucgaggauauagaacgagagauuccugagagaucauggaacacuggguuugacuggaucacagacuaucagggaaagaccgugugguucguccccucuaucaaggccggcaaugauauugcuaacugcuugcggaaaagcgguaagaaaguuauccagcuaaguaggaagacguuugacacugaauacccaaaaacaaagcugaccgauugggacuucgugguaaccacugauauauccgagaugggggccaacuuucgcgcaggcagagugauugacccgaggcggugucucaagccugucaucuuaacagauggacccgaacgugugauucuggccggcccaauccccguuaccccugcuagcgcggcccaacgccgagggagaauaggaaggaauccagcacaggaggacgaucaguauguguucucuggugacccccuuaaaaacgaugaagaccaugcucacuggacagaggccaagaugcugcucgauaauauuuacacuccugagggcaucaucccgacguuguucgggccagaacgggagaaaacccaggcaauugacggagaauuucgccugagaggcgagcaaaggaagacauucgucgagcucaugcggcgaggugaccugcccguauggcuuucauauaaaguggccuccgcugggaucaguuacaaggauagagaauggugcuuuacuggcgagcgcaacaaucagauucuagaagagaacauggaaguugagauauggaccagggagggagaaaagaaaaagcugcggccucguugguuggacgccagaguguaugcggaucccauggcauuaaaagacuucaaggaguuugccagcggcaggaaaucgaucacacuggauauucucaccgaaaucgcuucucugccaacuuaccuuuccagccgcgccaagcuggcucucgacaauaucgucauguugcauacgaccgagcgggggggacgagcauaccagcacgcccugaacgaacuaccugagucacuggagacacucaugcuuguggcucuguuaggugccaugacugcaggcauuuucuuguuuuucaugcaggggaagggaauaggcaaacugaguaugggucucaucgcgauugccgucgcuucugggcugcuuuggguggccgaaauccaaccccaguggauugcagcuuccaucauacuggaguuuuuccucaugguuuugcugaucccagaaccugagaagcagagaaccccgcaggauaaucaauuaauuuaugugauccuaacaauucugaccaucauaggccucauugccgcaaacgaaaugggacuuaucgagaaaacuaagacagacuuuggcuucuaccagguaaaaacggagaccacuauucuggauguggacuugaggcccgccagcgcuuggacacuguaugcggucgccaccaccauccucacaccaaugcugcgccacacuauagaaaauacgucagcaaaccuuagucucgcugccaucgccaaucaggcagcuguucugaugggguugggaaagggcuggccucugcaucggauggauuuaggugugccccuacuggccaugggguguuacagccaggucaacccaaccacacucacugcgucccuugugaugcuguugguacacuaugcuauuaucggaccuggccugcaagccaaagcaaccagagaggcccagaagcguacagcugcagguauuaugaagaaucccaccguggacggcaucacuguuauagaucucgaaccgauuucuuacgacccaaaauuugagaagcagcuggggcaagugaugcuuuuaguccugugcgccggacagcucuugcugaugaggacgacaugggcguucugugaggugcuaacccuggcuacuggcccuauccucacccuuugggaagggaaccccggacgguucuggaacacaacuaucgccgucagcaccgcaaauauuuuucgcggcuccuaucuggccggugcuggguuggccuucucacugaucaaaaacgcacagacaccacgaagaggaacgggcaccacuggugagacacucggcgaaaaguggaaaaggcagcugaauucuuuagaccggaaggaguuugaagaguacaagcgcagugggauacuugagguggauagaaccgaagcuaaaucggcccugaaggacggaagcaaaacuaagcaugcgguuuccaggggcucuucaaaaauucgauggaucguagagcgggggauggugaagcccaagggaaaagucguggaucucggcugcggucgugggggauggagcuacuauauggccacacuaaagaacguuaccgaagugaaaggcuacacgaagggcgggccuggacacgaggaaccgauucccauggcaaccuaugguuggaaucuggucaaauugcauuccggcguggacguauucuacaagccaacagagcaaguggauacucugcucugugacaucggggagaguucuagcaacccuaccauagaagagggaagaacacuucgcguucugaagauggucgaacccugguugucauccaaaccugaguuuugcaucaaggugcugaauccauauaugcccacugugauugaagagcucgagaaauuacagaggaagcacggcgguaaccugguccgguguccucuuaguagaaauagcacccacgaaauguacuggguuucuggggcuuccggaaacaucgugucaagcguaaauacaaccucgaaaaugcugcuaaaccgcuucacuacgaggcaucgaaagccaacauaugagaaagauguggaccucggcgccggcacccggucugucaguacugaaaccgagaagcccgauaugacaauuaucgggagaaggcugcagcgcuugcaggaggaacacaaggagacguggcauuacgaccaagaaaauccguaccguaccugggcauaucacggauccuacgaggcuccuagcacugguucagccuccucuauggugaacggcguugugaaacugcucacaaagccaugggaugucauucccauggugacccagcuugccaugacugacacaaccccuuuugggcagcagcggguauucaaagaaaagguugacacaagaacuccacaacccaaaccgggaaccaggaugaucaugacgaccacagcgaauuggcugugggcuuuacugggcaagaagaaaaacccucgcuugugcacucgagaggaguuuauaagcaaggugcggaguaaugcagccauuggugcugucuuccaggaagagcagggguggaccuccgccagcgaagcagugaacgauucuagauuuugggagcucguggacaaagaaagggcccugcaccaagagggaaagugugagucaugcgucuauaacaugaugggcaaacgcgaaaagaagcuaggcgaguucgggagagcuaaaggaagucgggcgaucugguacauguggcuuggugccagguuucuggaauucgaggcacucggcuuccugaaugaagaucauugguuugggcgugagaacuccuggagcggaguugagggcgaagguuugcaccgacugggguauauccucgaggaaauugacaagaaagauggagaccuuauguacgcugaugacacagccggcugggauacucgcauaaccgaggacgaucugcagaaugaggaauuaaucacggagcagauggcaccccaucacaagauucuggccaaagcuaucuucaaguugacauaucagaacaaggugguaaaagugcucagaccaaccccucggggcgccgucauggacauuaucucuaggaaggaucaacgcgggucgggacagguggguacuuacggccugaauacauuuaccaacauggaaguucagcuaauaagacagauggaggcggaaggggugaucacucaagacgacaugcagaaucccaaaggacuuaaggagcgggucgagaaauggcugagggaaugcggcguggaucgacucaagcguauggcaauuucaggugacgauuguguaguuaaaccacuggacgagagauucgggaccagcuuguuauuucugaacgauaugggaaaggugcgcaaggacaucccccagugggaaccuuccaaaggcuggaagaauuggcaggaggucccauucugcagucaucacuuucacaaaauuuucaugaaggauggccggucucucgugguuccguguaggaaccaagacgaacuuaucgggagagcccgcauaagccagggagcugguuggucccugcgggagacagccugccuaggcaaagcauacgcucagauguggucacugauguauuuucauaggcgagaucucagauuggccaguauggcuauuuguucugccgugcccacggagugguucccuaccagccggacuacaugguccauccacgcacaucaccaguggaugaccacugaagacaugcugaaggucuggaauaggguguggaucgaggauaacccaaauaugacagacaagacccccauucacucaugggaagacauaccuuaccuugggaaacgcgaggaucuguggugcggaagccucaucggcuuaucuucccgugcgacgugggccaagaacauucauacagcuaucacccaaguaagaaaucugauugguaaagaagaguauguggacuacaugccagucaugaagcgauauagugcccccagcgagucggaagggguuuuguga

SEQ ID NO: 15708 - RNA, 9867 nt, Artificial Sequence
  derived and/or modified CDS sequence (opt3) from DENV-4__GQ199880__SS-prME
agcaccauaacacugcucugccuuauucccacugugauggccuuccaccuguccacgagagacggcgagccuuugaugauagucgcuaagcaugaaagggggcggccguuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccaaagagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugaacgagaaagaagagaauaugguuaagagccaagugacugcuggacagggcacaucggaaaccuuuuccaugggucuccugugccuuacuuuguucgucgaggaaugucugcggagaaggguaacacgaaagcacaugaucuuagugguugugauaacccucugcgccauuauccuagggggccuuacguggauggaucuguugcgcgcacucauuaugcugggcgacacuaugucuggccggaucgggggacagauacaucuagcgaucauggccgucuuuaaaaugagcccggguuacgugcugggcguauuccucagaaagcugaccucaagggagacagcucuuauggugauugggauggccaugaccacugucuugaguaucccucacgaccugauggaguuaauugauggaaucucccucggccugauacuucugaaaauuguuacacaguuugacaacacccaaguggguacacuagcacucucucugacuuucauccguagcaccaugccauuggugauggcuuggcgcacgaucauggccguccuguuugugguuacauuaauuccccucugucggaccuccugccugcagaagcagucacauuggguagaaaucacugcacuuauucugggggcccaggcuuugccuguguaucucaugacccugaugaaaggagcgagcagaaggaguuggccccuaaaugagggcauaauggccgucggccuggugucucuucucggguccgcacuguugaagaacgauguuccacuggcuggaccuaugguggccgguggcuuacuccuggccgcuuacgucaugagcgggucgucagcagaccuuucucuggaaaaggccgcgaaugugcagugggaugagauggcugacaucacaggaaguucccccauuaucgaaguaaaacaggaugaggacggcagcuucucuauucgagaugucgaggaaacuaacaugaucaccuugcucgugaagcuggcccuaauaacgguuagcggucuguacccacuugcaaucccggugacaaugacccucugguauauguggcaggucaaaacucaacgguccggggcccugugggacgugccuucacccgcugcaacacagaaggccgcguugagugagggaguuuaccgcauuaugcagagaggcuuauuuggcaaaacccaggugggggucggaauccacauggaagguguguuccacacuauguggcauguaacaaggggcagcgugauuugucacgagaccgggcggcuggaaccaucuugggcugauguucgaaaugacaugaucuccuauggaggcgguuggagacucggggauaagugggacaaggaggaggacguccaagugcuggccauagaacccggcaaaaacccuaagcaugugcagacgaaaccaggccuuuucaagacucugaccggcgagauuggggcagucacauuggauuuuaaacccggaaccucagguaguccuaucaucaaucgcaagggcaaaguaauugggcuauacggaaacggcgugguuacaaagagcggugacuauguguccgccauaacucaggcugaaaggaucggggagccggauuacgaggucgacgaagauauuuuccguaagaaacggcugaccaucauggaccuccacccaggagccggcaagacgaaacggauucugcccucuaucgugagggaggcacuuaagcgccgauuaagaacacugauacucgcuccuacucggguuguggccgcggaaauggaggaagccuugaggggccugccaauccgcuaucagacccccgcagucaaaucggagcauacagggcgugagauuguggaucucaugugccacgcuaccuuuacuaccagacugcuuagcucaacacggguaccuaauuacaaccugaucgugauggacgaagcccacuucacggauccguccaguguugcugcaaggggauacauuucuacucgcgucgagaugggugaagccgccgcuaucuuuaugaccgcgacacccccaggcgcaaccgacccuuucccccaaagcaauuccccaauagaggauauugaacgagagaucccugagagaucauggaacacuggguuugacuggaucacagacuaucagggaaagaccgugugguucgugcccucuauuaaggccggcaaugauaucgcuaacugcuugcggaaaagcgguaagaaagucauacagcuaaguaggaagacguuugacacugaauacccaaaaacaaagcugaccgauugggacuucguugugaccacugauauuuccgagaugggggccaacuuucgcgcaggcagaguaaucgacccgaggcggugucucaagccugugauuuuaacagauggacccgaacgugucauccuggccggcccaauacccgugaccccugcuagcgcggcccaacgccgagggagaauuggaaggaauccagcacaggaggacgaucaguauguuuucucuggugacccccuuaaaaacgaugaagaccaugcucacuggacagaggccaagaugcugcucgauaauaucuacacuccugagggcaucauuccgacguuguucgggccagaacgggagaaaacccaggcaaucgacggagaauuucgccugagaggcgagcaaaggaagacauucguggagcucaugcggcgaggugaccugcccgucuggcuuucauauaaaguagccuccgcugggauuaguuacaaggauagagaauggugcuuuacuggcgagcgcaacaaucagauacuagaagagaacauggaaguggagaucuggaccagggagggagaaaagaaaaagcugcggccucguugguuggacgccagaguuuaugcggaucccauggcauuaaaagacuucaaggaguuugccagcggcaggaaaucgauuacacuggauauccucaccgaaaucgcuucucugccaacuuaccuuuccagccgcgccaagcuggcucucgacaauauugugauguugcauacgaccgagagagggggacgagcauaccagcacgcccugaacgaacuaccugagucacuggagacacucaugcuugucgcucuguuaggugccaugacugcaggcauauucuuguuuuucaugcaggggaagggaaucggcaaacugaguaugggucucauugcgaucgccguggcuucugggcugcuuugggucgccgaaauucaaccccaguggaucgcagcuuccauaauccuggaguuuuuccucaugguguugcugauuccagaaccugagaagcagagaaccccgcaggauaaucaauuaaucuauguuauucuaacaauccugaccauaauuggccucaucgccgcaaacgaaaugggacuuauugagaaaacuaagacagacuuuggcuucuaccaggugaaaacggagaccacuauccuggauguagacuugaggcccgccagcgcuuggacacuguaugcgguggccaccaccauacucacaccaaugcugcgccacacuaucgaaaauacgucagcaaaccuuagucucgcugccauugccaaucaggcagcuguccugaugggguugggaaagggcuggccucugcaucggauggauuuagguguuccccuacuggccaugggguguuacagccaggugaacccaaccacacucacugcgucccuugucaugcuguuggugcacuaugcuaucauuggaccuggccugcaagccaaagcaaccagagaggcccagaagcguacagcugcagguaucaugaagaaucccaccguagacggcauaacugugauugaucucgaaccgaucucuuacgacccaaaauuugagaagcagcuggggcaaguuaugcuuuuagugcugugcgccggacagcucuugcugaugaggacgacaugggcguucugugagguccuaacccuggcuacuggcccuauccucacccuuugggaagggaaccccggacgguucuggaacacaacuauugccgugagcaccgcaaauaucuuucgcggcuccuaucuggccggugcuggguuggccuucucacugaucaaaaacgcacagacaccacgaagaggaacgggcaccacuggugagacacucggcgaaaaguggaaaaggcagcuaaauucuuuagaccggaaggaguuugaagaguacaagcgcagugggauucuugaggucgauagaaccgaagcuaaaucggcccugaaggacggaagcaaaacuaagcaugcgguguccaggggaucuucaaaaauccgauggauuguugagcgggggaugguaaagcccaagggaaaaguggucgaucucggcugcggucgugggggauggagcuacuauauggccacacuaaagaacgugaccgaaguuaaaggcuacacgaagggcgggccuggacacgaggaaccgauccccauggcaaccuaugguuggaaucuggugaaauugcauuccggcgucgacguguucuacaagccaacagagcaaguagauacucugcucugugacauaggggagaguucuagcaacccuaccaucgaagagggaagaacacuucgcgugcugaagaugguugaacccugguugucauccaaaccugaguuuugcauuaagguccugaauccauauaugcccacugugaucgaagaacucgagaaauuacagaggaagcacggcgguaaccuggugcgguguccucuuaguagaaauagcacccacgaaauguacugggucucuggggcuuccggaaacauuguuucaagcgugaauacaaccucgaaaaugcugcuaaaccgcuucacuacgaggcaucgaaagccaacauaugagaaagauguagaccucggcgccggcacccggucugugaguacugaaaccgagaagcccgauaugacaaucauugggagaaggcugcagcgcuugcaggaggaacacaaggagacguggcauuacgaccaagaaaauccguaccguaccugggcauaucacggauccuacgaggcuccuagcacugguucagccuccucuauggucaacggcgugguuaaacugcucacaaagccaugggaugugauccccauggucacccagcuugccaugacugacacaaccccuuuugggcagcagcggguguucaaagaaaagguagacacaagaacuccacaacccaaaccgggaaccaggaugauaaugacgaccacagcgaauuggcugugggcuuuacugggcaagaagaaaaacccucgcuugugcacucgagaggaguuuauuagcaagguucggaguaaugcagccaucggugcuguguuccaggaggaacaaggguggaccuccgccagcgaagcagucaacgauucuagauuuugggagcucguggacaaagaaagggcccugcaccaagagggaaagugugagucaugcguguauaacaugaugggcaaacgcgaaaagaagcuaggcgaguucgggagagcuaaaggaagucgggcgaucugguacauguggcuuggugccagguuucuggaguucgaggcacucggcuuccugaaugaagaucauugguuugggcgugagaacuccuggagcggagucgagggcgaagguuugcaccgacugggguauauucucgaggaaauagacaagaaagauggagaccuuauguacgcugaugacacagccggcugggauacucgcaucaccgaggacgaucugcagaaugaggaauuaauuacggagcagauggcaccccaucacaagauccuggccaaagcuauuuucaaguugacauaucagaacaagguugugaaaguacucagaccaaccccucggggcgccgugauggacaucauaucuaggaaggaucaacgcgggucgggacaggucgguacuuacggccugaauacauuuaccaacauggaagugcagcuaaucagacagauggaggcggaagggguuauuacucaagacgacaugcagaaucccaaaggacuuaaggagcggguggagaaauggcugagggaaugcggcgucgaucgacucaagcguauggcaaucucaggugacgauugugugguaaaaccacuggacgagagauucgggaccagcuuguuauuucugaacgauaugggaaagguucgcaaggacauuccccagugggaaccuuccaaaggcuggaagaauuggcaggaggugccauucugcagucaucacuuucacaaaaucuucaugaaggauggccggucucucgucgugccguguaggaaccaagacgaacuuauagggagagcccgcauuagccagggagcugguuggucccugcgggagacagccugccuaggcaaagcauacgcucagauguggucacugauguauuuucauaggcgagaucucagauuggccaguauggcuaucuguucugccguucccacggagugguucccuaccagccggacuacaugguccauccacgcacaucaccaguggaugaccacugaagacaugcugaagguguggaauagggucuggauugaggauaacccaaauaugacagacaagacccccauacacucaugggaagacaucccuuaccuugggaaacgcgaggaucuguggugcggaagccucauuggcuuaucuucccgugcgacgugggccaagaacauccauacagcuauuacccaagugagaaaucugaucgguaaagaagaguauguagacuacaugccagugaugaagcgauauagugcccccagcgagucggaaggggucuuguga

SEQ ID NO: 15709 - RNA, 9867 nt, Artificial Sequence
  derived and/or modified CDS sequence (opt3) from DENV-4__GQ252675__SS-prME
agcaccaucacccugcucugccuuauucccacugugauggccuuccaccuguccacgagagacggagagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacaugggugauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagauccggauggaaaaacuucgaaucaaggguaugaguuauacuaugugcucugggaaauucuccauugacaaggagauggccgagacacaacacggcacgaccguagucaaagugaaguacgaaggagcaggcgccccuuguaagguuccaauagagauccgcgaugugaauaaagaaaaggucguggggagaguaauuagcucgacuccccuggcugagaacacaaacucugugaccaauaucgaguuggaaccgccuuucggagacuccuauauaguuauuggugucggcaacucagcgcucacacugcauugguuuaggaaagggaguagcaucggaaagauguucgaguccacuuaccggggcgcaaaacgcauggccaucuuaggugaaaccgcuugggauuuugggucugugggcggacuguucacgagccuaggcaaggccgugcaccaggucuuugggucaguuuauaccacaauguucggaggcgugaguuggaugauuagaauccucauugguuuucuggugcuuuggauagggacuaauuccaggaacaccagcauggcaaugacaugcaucgccguaggaggcauuacuuuguuccuggguuuuaccguccaggcugacaugggcugugugguuucuuggucagggcgugagcucaagugcggaaguggcaucuucguggucgauaaugugcauacguggacagaacaauacaaauuucagcccgagagcccagcccggcuggcauccgcgauccuuaacgcucacaaggacgggguuuguggcauucgaucuaccacuagacuggagaaugugauguggaaacagauaacaaacgaauugaauuauguacucugggagggcggucacgaccugaccgucguggccggggaugugaagggagucuuaacuaaaggcaagagggcacugaccccucccguuucggaccuaaaguacagcuggaaaacaugggguaaggccaaaaucuucacgccagaagcucgcaacuccaccuuucucauugauggccccgacacuucagagugcccuaaugaacggagagccuggaacagucuggagguggaggauuacggguucggaauguucacaaccaauaucuggaugaaguuuagggaaggcucuagcgagguaugugaccaucgccuuauguccgcagcuauuaaagaucagaaggccgugcacgcggacaugggguauuggaucgaaucaagcaaaaaccaaacauggcagauagagaaggccucuuugaucgaagucaagacuugccuguggccaaaaacccauacgcucugguccaauggagugcuggagagucagauguuaauuccaaagagcuacgcuggccccuucucucagcacaacuaucgacaagguuacgcaacacagaccguugggccuuggcaccugggaaaacuugagaucgauuuuggcgaaugcccagguacuaccgugacaauucaggaggacugugaucaucggggccccuccuugcguacuaccacagccucagggaagcucgucacgcaguggugcuguagaaguugcaccaugccuccacugagguuccuaggagaagacggcuguugguaugggauggagauccgcccccugaacgagaaagaagagaauaugguaaagagccaaguuacugcuggacagggcacaucggaaaccuuuuccaugggucuccugugccuuacuuuguucguggaggaaugucugcggagaagggucacacgaaagcacaugauguuaguagugguuauaacccucugcgccauuauccuagggggacuuacguggauggaucuguugcgcgcacucauuaugcugggcgacacuaugucuggccggaucgggggacagauacaucuagcgaucauggccguguuuaaaaugagcccggguuacguccugggcguguuccucagaaagcugaccucaagggagacagcucuuaugguaauugggauggccaugaccacuguguugaguaucccucacgaccugauggaguuaauugauggaaucucccucggccugauacuucugaaaacagucacccaguuugacaacacacaaguugguacucuagcacucucucugaccuucauucguagcacgaugccauuggugauggcuuggcgcacaaucauggccgugcuguuugucgugaccuuaaucccccucugucggacuuccugccugcagaagcagucacauuggguugaaauuaccgcacuuauccugggggcccaggcuuugccuguauaucucaugacacugaugaaaggagcgagcagaaggaguuggccccuaaaugagggcauuauggccgugggccuggucucucuucucggguccgcacuguugaagaacgaugugccacuggcuggaccuaugguugccgguggcuuacuccuggccgcuuacgugaugagcgggucgucagcagaccuuucucuggaaaaggccgcgaauguccagugggaugagauggcugacauaacuggaaguucccccaucauugaagugaaacaggaugaggacggcagcuucucuauccgagauguagaggaaaccaacaugauuacguugcucgucaagcuggcccuaaucacagugagcggucuguacccacuugcaauaccgguuaccaugacucucugguauauguggcaagugaaaacacaacgguccggggcccugugggacgucccuucacccgcugcaacccagaaggccgcguugagugagggaguguaccgcaucaugcagagaggcuuauuuggcaaaacucagguuggggugggcauucacauggaaggugucuuccacacaauguggcaugugaccaggggcagcguaaucugucacgagacggggcggcuggaaccaucuugggcugaugugcgaaaugacaugauuuccuauggaggcgguuggagacucggggauaagugggacaaggaggaggacguucaaguccuggccaucgaacccggcaaaaacccuaagcaugugcagacuaaaccaggccuuuucaagacccugacaggcgagauaggggcagugaccuuggauuuuaaacccggaacaucagguaguccuauuaucaauaagaaaggcaaggucaucgggcuauacggaaacggcguagugacuaagagcggugacuauguuuccgccauuacccaggcugaacgcauaggggagccggauuacgagguggacgaagauaucuucaggaaaaagcgucugacgauuauggaccuccacccaggagccggcaaaacaaagcggauccugcccucuauugucagagaggcacuuaaaaggcgcuuacgaacucugauccucgcuccuaccagagugguugccgcggaaauggaggaagccuugcggggccugccaauaagguaucagacacccgcagugaagucggagcauaccgggcgcgagaucgucgaucucaugugccacgcuacuuuuaccacacgucugcuuagcucaacgagagugccuaauuacaaccugauuguaauggacgaagcccacuucacugauccguccaguguggcugcacggggauacaucucuaccaggguugagaugggugaagccgccgcuauuuuuaugacagcgacacccccgggcgcaacugacccuuucccccaaagcaauuccccaaucgaggauauagaacgcgagauuccugagcgaucauggaacacaggguuugacuggaucaccgacuaucagggaaagacggucugguucgugcccucuaucaaagccggcaaugauauugcuaacugcuugagaaagagcgguaaaaaggugauccagcuaagucggaaaacuuuugacacagaauacccaaagaccaagcugaccgauugggacuucgucguuacuacagauauauccgagaugggggccaacuuuagggcaggccgcgugauugacccgagaaggugucucaaaccuguaaucuuaaccgauggacccgaacgggugauucuggccggcccaauccccgucacuccugcuagcgcggcccaacgucgcgggcgaauaggaagaaauccagcacaggaggacgaucaguauguguucucuggugacccccuuaagaacgaugaagaccaugcucacuggacagaggccaaaaugcugcucgauaauauuuacacgccugagggcaucaucccgaccuuguucgggccagaaagggagaagacacaggcaauugacggagaauuucggcugcgcggcgagcaaagaaaaacuuucguugagcucaugaggcggggugaccugcccguguggcuuucauauaaggucgccuccgcugggaucaguuacaaggaucgagaauggugcuuuaccggcgagagaaacaaucagauucuagaagagaacauggaaguagagauauggacacgcgagggagagaaaaagaaacugaggccucggugguuggacgcccguguguaugcggaucccauggcauuaaaggacuucaaagaguuugccagcggcagaaagucgaucacccuggauauucucacugaaaucgcuucucugccaacguaccuuuccagcagggccaagcuggcucucgacaauaucguuauguugcauaccacagagcgcgggggacgggcauaccagcacgcccugaacgaacuaccugagucacuggagacucucaugcuuguggcucuguuaggugccaugaccgcaggcauuuucuuguuuuucaugcaggggaaaggaauaggcaagcugaguaugggucucaucgcgauugccgucgcuucugggcugcuuuggguggccgaaauccaaccccaguggauugcagcuuccaucauacuggaguuuuuccucauggucuugcugaucccagaaccugagaaacagcgaacaccgcaggauaaucaauuaauuuaugugauccuaaccauucugacuaucauaggccucauugccgcaaacgaaaugggacuuaucgagaagacaaaaacggacuuuggcuucuaccagguuaagaccgagacuacaauucuggauguggacuugagacccgccagcgcuuggacccuguaugcgguagccaccacaauccucacuccaaugcugaggcacacgauagaaaauaccucagcaaaccuuagucucgcugccaucgccaaucaggcagcugugcugaugggguugggaaaaggcuggccucugcaucgcauggauuuaggugucccccuacuggccaugggguguuacagccagguuaacccaacaacucucaccgcgucccuugugaugcuguugguccacuaugcuauuaucggaccuggccugcaagccaaggcaacacgggaggcccagaagagaaccgcugcagguauuaugaaaaaucccacuguggacggcaucacgguaauagaucucgaaccgauuucuuacgacccaaaguuugagaaacagcuggggcaagugaugcuuuuaguucugugcgccggacagcucuugcugaugcguacaaccugggcguucugugaggugcuaacucuggcuaccggcccuauccucacacuuugggaagggaaccccggaagguucuggaacacuaccaucgccgucagcacagcaaauauuuuucggggcuccuaucuggccggugcuggguuggccuucucacugaucaagaacgcacagacgccacgccgaggaaccggcacuacaggugagacccucggcgaaaaauggaagagacagcuaaauucuuuagacaggaaggaguuugaagaguacaaacggagugggauacuugagguggaucgcacugaagcuaagucggcccugaaagacggaagcaagacaaaacaugcggucuccagaggaucuucaaagauuagguggaucguggagcgagggaugguuaagcccaaaggaaagguaguggaucucggcugcgguagagggggauggagcuacuauauggccacccucaaaaacgucacggaagugaagggcuacaccaaaggcgggccuggacacgaggaaccgauucccauggcaacauaugguuggaaucugguuaaguugcauuccggcguggacgucuucuacaagccaacugagcaaguggauacccugcucugugacaucggggagaguucuagcaacccuacaauagaagagggacguacucuuagaguacugaaaaugguggaacccugguugucauccaagccugaguuuugcaucaaaguucugaauccauauaugcccaccgucauugaagaacuagagaaguuacagcgcaaacacggcgguaaccuggugagguguccucuuagucggaauagcacacacgaaauguacugggugucuggggcuuccggaaacaucgucucaagcguuaauaccacuucgaagaugcugcuaaacagauucacgacacgccauaggaaaccaaccuaugagaaggauguggaccucggcgccggcacucgaucuguaaguaccgaaacagagaagcccgauaugacgauuaucgggcggagacugcagagguugcaggaggaacacaaagagaccuggcauuacgaccaagaaaauccguaccgcacuugggcauaucacggauccuacgaggcuccuagcacagguucagccuccucuauggugaacggcgucgugaagcugcucaccaaaccaugggauguuauucccauggugacucagcuugccaugacagacaccacaccuuuugggcagcagcgugucuucaaggaaaaaguggacacucggaccccacaacccaagccgggaacgagaaugaucaugaccacaacugcgaauuggcugugggcuuuacugggcaagaaaaagaacccuagguugugcacccgcgaggaguuuauaagcaaaguacgaaguaaugcagccauuggugcuguuuuccaggaagaacagggguggacauccgccagcgaagcagugaacgauucucgguuuugggagcucgucgacaaggaaagagcccugcaccaagagggaaaaugugagucaugcguguauaacaugaugggcaagagggaaaagaaacuaggcgaguucgggcgcgcuaagggaaguagagcgaucugguacauguggcuuggugcccgguuucuggaguucgaggcacucggcuuccugaaugaagaucauugguuugggagggagaacuccuggagcggaguggagggcgaagguuugcaccgucugggguauauccucgaggaaauugacaaaaaggauggagaccuuauguacgcugaugacacugccggcugggauacccgaauaacggaggacgaucugcagaaugaggaauuaaucacagagcagauggcaccccaucacaaaauucuggccaaggcuaucuucaaguugaccuaucagaacaaagucguuaaggugcuccgcccaacuccuagaggcgccguaauggacauuaucucucggaaagaucaaagggggucgggacagguggguacauacggccugaauaccuuuacuaacauggaaguccagcuaauacgccagauggaggcggaaggggugaucacccaagacgacaugcagaaucccaagggacuuaaagagagaguugagaaguggcugcgggaaugcggcguggauaggcucaaacgaauggcaauuucaggugacgauugugucgugaagccacuggacgagcguuucgggacgagcuuguuauuucugaacgauaugggaaagguaagaaaagacaucccccagugggaaccuuccaagggcuggaaaaauuggcaggagguuccauucugcagucaucacuuucacaagauuuucaugaaagauggccgcucucucguggucccgugucggaaccaagacgaacuuaucgggagggccagaauaagccagggagcugguuggucccugcgcgagacagccugccuaggcaaggcauacgcucagauguggucacugauguauuuucaucggagggaucuccgauuggccaguauggcuauuuguucugccgugcccaccgagugguucccuacuagcagaacaaccugguccauccacgcacaucaccaguggaugacuacagaagacaugcugaagguuuggaaucggguguggaucgaggauaacccaaauaugaccgacaaaacgcccauucacucaugggaagacauaccuuaccuugggaagagggaggaucuguggugcggaagccucaucggcuuaucuucccgcgcgacaugggccaaaaacauucauaccgcuaucacucaaguccguaaucugauugguaaggaagaguauguggacuacaugccaguaaugaaaagauauagugcccccagcgagucggaagggguguuguga

SEQ ID NO: 15710 - RNA, 9867 nt, Artificial Sequence
  derived and/or modified CDS sequence (opt3) from DENV-4__FJ810417__SS-prME
agcaccaucacccugcucugccuuauucccacugugauggccuuccaccuguccacgagagacggagagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgauuccccuggcugagaacacuaacucuguuacaaauaucgaguuggaaccgccuuucggagacuccuauauagucauuggugugggcaacucagcgcucacccugcauugguuuaggaaagggaguagcaucggaaagauguucgaguccacauaccggggcgcaaaacgcauggccaucuuaggugaaacugcuugggauuuugggucugugggcggacuguucaccagccuaggcaaggccguccaccagguuuuugggucaguguauacgaccauguucggaggcgugaguuggaugauuagaauccucauugguuuucugguacuuuggauagggacaaauuccaggaacacuagcauggcaaugaccugcaucgccgucggaggcauuacauuguuccuggguuuuacugugcaggcugacaugggcuguguugugucuuggucagggcgugagcucaagugcggaaguggcaucuucgucguggauaauguucauaccuggacggaacaauacaaauuucagcccgagagcccagcccggcuggcauccgcgauccuuaacgcucacaaggacgggguguguggcauucgaucuacaaccagacuggagaauguaauguggaaacagauaacuaacgaauugaauuauguccucugggagggcggucacgaccugacagugguggccggggaugucaagggaguuuuaaccaaaggcaagagggcacugacuccucccgugucggaccuaaaguacagcuggaaaaccugggguaaggccaaaaucuucacaccagaagcucgcaacuccacguuucucauugauggccccgacaccucagagugcccuaaugaacggagagccuggaacagucuggagguagaggauuacggguucggaauguucacuacaaauaucuggaugaaguuuagggaaggcucuagcgaggugugugaccaucgccuuauguccgcagcuauuaaagaucagaaggccguccacgcggacaugggguauuggaucgaaucaagcaaaaaccaaaccuggcagauagagaaggccucuuugaucgaagugaagacaugccuguggccaaaaacucauacccucugguccaauggaguucuggagagucagauguuaauuccaaagagcuacgcuggccccuucucucagcacaacuaucgacaagguuacgcaacgcagacaguggggccuuggcaccugggaaaacuugagaucgauuuuggcgaaugcccagguaccacugucaccauucaggaggacugugaucaucggggccccuccuugcguacaacuaccgccucagggaagcucgugacacaguggugcuguagaaguugcacgaugccuccacugagguuccuaggagaagacggcuguugguaugggauggagauccgcccccugaacgagaaagaagagaauaugguuaagagccaagugaccgcuggacagggcacuucggaaacauuuuccaugggucuccugugccuuaccuuguucgucgaggaaugucugcggagaaggguaacucgaaagcacaugauauuagugguugugauuacacucugcgccaucauucuagggggacuuaccuggauggaucuguugcgcgcacucaucaugcugggcgacacgaugucuggccggauagggggacagauccaucuagcgauuauggccgucuuuaaaaugagcccggguuacgugcugggcguauuccucagaaagcugacuucaagggagaccgcucuuauggugaucgggauggccaugacaaccgucuugaguauuccucacgaccugauggaguuaaucgauggaauaucccucggccugauucuucugaaaaucguuacucaguuugacaacacacaaguggguacccuagcacucucucugacauucauccguagcacuaugccauuggugauggcuuggcgcaccauuauggccguccuguuugugguuacguuaaucccccucugucggacauccugccugcagaagcagucacauuggguagaaauuaccgcacuuauacugggggcccaggcuuugccuguguaucucaugacucugaugaaaggagcgagcagaaggaguuggccccuaaaugagggcaucauggccgucggccuggugucucuucucggguccgcacuguugaagaacgauguuccacuggcuggaccuaugguggccgguggcuuacuccuggccgcuuacgucaugagcgggucgucagcagaccuuucucuggaaaaggccgcgaaugugcagugggaugagauggcugacauuaccggaaguucccccaucauugaaguaaaacaggaugaggacggcagcuucucuauccgagaugucgaggaaacaaacaugauaacuuugcucgugaagcuggcccuaaucaccguuagcggucuguacccacuugcaauuccggugacgaugacacucugguauauguggcaggucaaaacccaacgguccggggcccugugggacgugccuucacccgcugcaacucagaaggccgcguugagugagggaguuuaccgcaucaugcagagaggcuuauuuggcaaaacacaggugggggucggcauucacauggaagguguguuccacaccauguggcauguaacuaggggcagcgugaucugucacgagacagggcggcuggaaccaucuugggcugauguucgaaaugacaugauauccuauggaggcgguuggagacucggggauaagugggacaaggaggaggacguccaagugcuggccauugaacccggcaaaaacccuaagcaugugcagaccaaaccaggccuuuucaagacgcugacuggcgagaucggggcagucaccuuggauuuuaaacccggaacaucagguaguccuaucauuaaucgcaagggcaaaguaauagggcuauacggaaacggcgugguuaccaagagcggugacuauguguccgccaucacacaggcugaaaggauuggggagccggauuacgaggucgacgaagauaucuuccguaagaaacggcugacuauuauggaccuccacccaggagccggcaagaccaaaagaauccugcccucuauagugagggaggcacuuaagcgccgauuaagaacgcugauccucgcuccuacacggguuguggccgcggaaauggaggaagccuugaggggccugccaauucgcuaucagacucccgcagucaaaucggagcauaccgggcgugagaucguggaucucaugugccacgcuacauuuaccacuagacugcuuagcucaacccggguaccuaauuacaaccugauugugauggacgaagcccacuucacagauccguccaguguugcugcaaggggauacaucucuacgcgcgucgagaugggugaagccgccgcuauauuuaugacugcgacacccccgggcgcaacagacccuuucccccaaagcaauuccccaauugaggauaucgaacgagagaucccugagagaucauggaacaccggguuugacuggauuacugacuaucagggaaagacagugugguucgugcccucuaucaaggccggcaaugauauagcuaacugcuugcggaaaagcgguaagaaagucauucagcuaaguaggaagaccuuugacacggaauacccaaaaacuaagcugacagauugggacuucguugugaccaccgauaucuccgagaugggggccaacuuucgcgcaggcagaguaauugacccgaggcggugucucaagccugugaucuuaacugauggacccgaacgugucauacuggccggcccaauucccgugaccccugcuagcgcggcccaacgccgagggagaaucggaaggaauccagcacaggaggacgaucaguauguuuucucuggugacccccuuaaaaacgaugaagaccaugcucacuggacagaggccaagaugcugcucgauaauaucuacacaccugagggcauuaucccgacuuuguucgggccagaacgggagaaaacgcaggcaauugacggagaauuucgccugagaggcgagcaaaggaagaccuucguggagcucaugcggcgaggugaccugcccgucuggcuuucauauaaaguagccuccgcugggauaaguuacaaggauagagaauggugcuuuacaggcgagcgcaacaaucagauccuagaagagaacauggaaguggagauuuggacuagggagggagaaaagaaaaagcugcggccucguugguuggacgccagaguuuaugcggaucccauggcauuaaaagacuucaaggaguuugccagcggcaggaaaucgaucacccuggauauccucacagaaauugcuucucugccaaccuaccuuuccagccgcgccaagcuggcucucgacaauauagugauguugcauacuacggagagagggggacgagcauaccagcacgcccugaacgaacuaccugagucacuggagacccucaugcuugucgcucuguuaggugccaugacagcaggcaucuucuuguuuuucaugcaggggaagggaauuggcaaacugaguaugggucucaucgcgauugccguggcuucugggcugcuuugggucgccgaaauccaaccccaguggauagcagcuuccaucauucuggaguuuuuccucaugguguugcugaucccagaaccugagaagcagagaacuccgcaggauaaucaauuaauuuauguuauccuaaccauacugacaauuaucggccucauugccgcaaacgaaaugggacuuaucgagaaaaccaagacugacuuuggcuucuaccaggugaaaacagagacgaccauacuggauguagacuugaggcccgccagcgcuuggacucuguaugcgguggccacaaccauccucaccccaaugcugcgccacacaauugaaaauacuucagcaaaccuuagucucgcugccaucgccaaucaggcagcuguccugaugggguugggaaagggcuggccucugcaucggauggauuuagguguuccccuacuggccaugggguguuacagccaggugaacccaacgacccucacagcgucccuugucaugcuguuggugcacuaugcuauuaucggaccuggccugcaagccaaagcaacuagagaggcccagaagcguaccgcugcagguauaaugaagaaucccacaguagacggcauuaccgugaucgaucucgaaccgaucucuuacgacccaaaauuugagaagcagcuggggcaaguuaugcuuuuagugcugugcgccggacagcucuugcugaugaggacuacgugggcguucugugagguccuaacacuggcuaccggcccuauucucacucuuugggaagggaaccccggacgguucuggaacaccacaaucgccgugagcacugcaaauauauuucgcggcuccuaucuggccggugcuggguuggccuucucacugauuaaaaacgcacagaccccacgaagaggaacaggcacgaccggugagacucucggcgaaaaguggaaaaggcagcuaaauucuuuagaccggaaggaguuugaagaguacaagcgcagugggauccuugaggucgauagaacagaagcuaaaucggcccugaaggacggaagcaaaaccaagcaugcgguguccaggggaucuucaaaaauucgauggaucguugagcgggggaugguaaagcccaagggaaaaguggucgaucucggcugcggucgugggggauggagcuacuauauggccacucuaaagaacgugacagaaguuaaaggcuacaccaagggcgggccuggacacgaggaaccgauacccauggcaacguaugguuggaaucuggugaaauugcauuccggcgucgacguguucuacaagccaaccgagcaaguagauacacugcucugugacaucggggagaguucuagcaacccuacuauugaagagggaagaacccuucgcgugcugaagaugguugaacccugguugucauccaaaccugaguuuugcaucaagguccugaauccauauaugcccacagugauugaagaacucgagaaauuacagaggaagcacggcgguaaccuggugcgguguccucuuaguagaaauagcacucacgaaauguacugggucucuggggcuuccggaaacaucguuucaagcgugaauaccacaucgaaaaugcugcuaaaccgcuucaccacuaggcaucgaaagccaacguaugagaaagauguagaccucggcgccggcacacggucugugaguaccgaaacugagaagcccgauaugaccauuaucgggagaaggcugcagcgcuugcaggaggaacacaaggagacauggcauuacgaccaagaaaauccguaccguacgugggcauaucacggauccuacgaggcuccuagcaccgguucagccuccucuauggucaacggcgugguuaaacugcucacuaagccaugggaugugauacccauggucacacagcuugccaugaccgacacuacaccuuuugggcagcagcggguguucaaagaaaagguagacaccagaacaccacaacccaaaccgggaacuaggaugauuaugaccacgaccgcgaauuggcugugggcuuuacugggcaagaagaaaaacccucgcuugugcacacgagaggaguuuaucagcaagguucggaguaaugcagccaucggugcuguguuccaggaggaacaaggguggacuuccgccagcgaagcagucaacgauucuagauuuugggagcucguggacaaagaaagggcccugcaccaagagggaaagugugagucaugcguguauaacaugaugggcaaacgcgaaaagaagcuaggcgaguucgggagagcuaaaggaagucgggcgauuugguacauguggcuuggugccagguuucuggaguucgaggcacucggcuuccugaaugaagaucauugguuugggcgugagaacuccuggagcggagucgagggcgaagguuugcaccgacugggguauauacucgaggaaaucgacaagaaagauggagaccuuauguacgcugaugacaccgccggcugggauacacgcauuacugaggacgaucugcagaaugaggaauuaaucaccgagcagauggcaccccaucacaagauucuggccaaagcuaucuucaaguugacguaucagaacaagguugugaaaguacucagaccaacaccucggggcgccgugauggacauaaucucuaggaaggaucaacgcgggucgggacaggucgguaccuacggccugaauacuuuuacaaacauggaagugcagcuaauuagacagauggaggcggaagggguuaucacccaagacgacaugcagaaucccaaaggacuuaaggagcggguggagaaauggcugagggaaugcggcgucgaucgacucaagcguauggcaauuucaggugacgauugugugguaaaaccacuggacgagagauucgggacuagcuuguuauuucugaacgauaugggaaagguucgcaaggacaucccccagugggaaccuuccaaaggcuggaagaauuggcaggaggugccauucugcagucaucacuuucacaaaauauucaugaaggauggccggucucucgucgugccguguaggaaccaagacgaacuuauugggagagcccgcaucagccagggagcugguuggucccugcgggagaccgccugccuaggcaaagcauacgcucagauguggucacugauguauuuucauaggcgagaucucagauuggccaguauggcuaucuguucugccguucccacagagugguucccuacgagccggaccacuugguccauucacgcacaucaccaguggaugacaaccgaagacaugcugaagguguggaauagggucuggauagaggauaacccaaauaugacugacaagacacccauccacucaugggaagacauuccuuaccuugggaaacgcgaggaucuguggugcggaagccucaucggcuuaucuucccgugcgaccugggccaagaacauucauacggcuaucacacaagugagaaaucugauagguaaagaagaguauguagacuacaugccagugaugaagcgauauagugcccccagcgagucggaaggggucuuguga

SEQ ID NO: 15711 - RNA, 9867 nt, Artificial Sequence
  derived and/or modified CDS sequence (opt3) from DENV-4__FJ850057__SS-prME
agcaccaucacacugcucugccuuauucccacugccauggcuuuccaccuguccacgagagacggcgagccuuugaugauaguggccaagcaugaaagggggcggccauuacuguuuaaaaccacagagggaaucaacaaguguacucugauugccauggaucucggugaaaugugcgaggacaccgucacauacaaauguccgcugcuuguuaauaccgaacccgaggauaucgacugcugguguaaccugacuucuacaugggugauguauggaaccugcacgcagucaggggagcgccgacgugaaaagagaaguguggcguugacuccucacagcggaaugggccucgagaccagggcugaaacauggauguccucugagggugccuggaaacaugcacagcggguggagucguggauucugcgcaauccaggguucgcccugcucgcuggauuuauggcauacaugaucggccagacuggcauacagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacugacuaagacaaccgcgaaagagguggcacuccugcgcacuuacuguaucgaagccaguauuuccaauaucacaaccgcuacgcgaugcccaacccaaggagagcccuaucuuaaggaggaacaggaccagcaguacauuuguagaagggauguggucgaccggggcuggggcaacgggugcggacuguucgguaaaggcgggguugugacaugcgccaaguuuucuuguagcggaaaaaucacuggcaauuugguacaaauagagaaccucgaauauaccguggucgugacaguucauaauggugauacucacgcaguggggaacgacaccuccaaucacggcgucacagcuaccauuacuccucguucaccaaguguggagguaaagcugccggauuacggagaauuaacgcuggacugcgagccccgcagcggcaucgacuucaacgagaugauucucaugaagaugaaaaagaaaacauggcuuguucauaagcagugguuucuggauuugccucuaccauggaccgccggggcggacacuucugaagugcacuggaauuacaaagagagaauggucaccuucaaggugccccaugccaaaaggcaggaugucacagugcugggaucccaggaaggugcaaugcacucagcucucgccggcgcuaccgagguugacagcggggauggaaaccacauguuugccggccaucugaaguguaaggugcggauggaaaaacuucgaaucaaggguaugaguuauacuaugugcucugggaaauucuccaucgacaaggagauggcagagacacaacacggcacgaccguagucaaagugaaguacgaaggagccggcgcuccuuguaagguuccaauugagauacgcgaugugaauaaagaaaaggucguggggagaguaaucagcucgacuccccuggcggagaacacaaacucugugaccaauauugaguuggaaccgccuuucggagacuccuauaucguuauaggugucggcaacucagcacucacacugcauugguuuaggaaagggaguagcauuggaaagauguucgaguccacuuaccggggcgccaaacgcauggcuaucuuaggugaaaccgccugggauuuugggucugugggcggacuguucacgagccuaggcaaggcagugcaccaggucuuugggucaguuuauaccacaauguucggaggcgugaguuggaugaucagaauuuugaucgguuuucuggugcuuuggauugggacuaauuccaggaacaccagcauggccaugacaugcauagcuguaggaggcaucacuuuguuccuggguuuuaccguccaggccgacaugggcugugugguuucuuggucagggcgugagcucaagugcggaaguggcauuuucguggucgauaaugugcauacguggacagaacaauacaaauuucagcccgagagcccagcacggcuggcguccgcuauccuuaacgcccacaaggacgggguuuguggaauccgaucuaccacuagacuggagaaugugauguggaaacagauuacaaacgaauugaauuauguacucugggagggcggucacgaccugaccgucguggcaggggaugugaagggagucuuaacuaaaggcaagagggcccugaccccucccguuucggaccuaaaguacagcuggaaaacaugggguaaggcuaaaauauucacgccagaagcccgcaacuccaccuuucucaucgauggccccgacacuucagagugcccuaaugaacggagagcauggaacagucuggagguggaggauuacggguucggaauguucacaaccaauauuuggaugaaguuuagggaaggcucuagcgagguaugugaccaucgccuuauguccgcugccaucaaagaucagaaggcggugcacgccgacaugggguauuggauugaaucaagcaaaaaccaaacauggcagaucgagaaggcuucuuugauagaagucaagacuugccuguggccaaaaacccauacgcucugguccaauggagugcuggagagucagauguuaaucccgaaaagcuacgcaggccccuucucucagcacaacuaucgacaagguuacgccacacagaccguugggccuuggcaccugggaaaacuugagauugauuuuggcgaaugcccagguacuaccgugacaauccaggaggacugugaucaucggggccccuccuugcguacuaccacagcuucagggaagcucgucacgcaguggugcuguagaaguugcaccaugccuccacugagguuccuaggagaagacggcuguugguaugggauggagauucgcccccugaacgagaaagaagagaauaugguaaagagccaaguuacugccggacagggcacaucggaaaccuuuuccaugggucuccugugccuuacuuuguucguggaggaaugucugcggagaagggucacacgaaagcacaugaucuuaguagugguuauaacccucugcgcaauuauccuagggggccuuacguggauggaucuguugcgcgcgcucauuaugcugggcgacacuaugucuggccggaucgggggacagauacaucuagccaucauggcuguguuuaaaaugagcccggguuacguccugggcguguuccucagaaagcugaccucaagggagacagcccuuaugguaauugggauggcaaugaccacuguguugaguaucccucacgaccugauggaguuaauugauggaaucucccucggccugauacuucugaaaauugucacacaguuugacaacacccaaguugguacacuagcucucucucugacuuucauccguagcaccaugccauuggugauggccuggcgcacgaucauggcagugcuguuugucgugacauuaauuccccucugucggaccuccugccugcagaagcagucacauuggguugaaaucacugcccuuauucugggggcucaagcguugccuguauaucucaugacccugaugaaaggagccagcagaaggaguuggccccuaaaugagggcauaauggcagugggccuggucucucuucucggguccgcucuguugaagaacgaugugccacuggccggaccuaugguugccgguggcuuacuccuggcugcauacgugaugagcgggucgucagccgaccuuucucuggaaaaggcggcuaauguccagugggaugagauggccgacaucacaggaaguucccccauuaucgaagugaaacaggaugaggacggcagcuucucuauucgagauguagaggaaacuaacaugaucaccuugcucgucaagcuggcacuaauaacggugagcggucuguacccacuugccaucccgguuacaaugacccucugguauauguggcaagugaaaacucaacgguccggggcucugugggacgucccuucacccgcagccacacagaaggcggcuuugagugagggaguguaccgcauuaugcagagaggcuuauuuggcaaaacccagguuggggugggaauccacauggaaggugucuuccacacuauguggcaugugacaaggggcagcguaauuugucacgagaccgggcggcuggaaccaucuugggccgaugugcgaaaugacaugaucuccuauggaggcgguuggagacucggggauaagugggacaaggaggaggacguucaaguccuggcaauagaacccggcaaaaacccuaagcaugugcagacgaaaccaggccuuuucaagacucugaccggcgagauuggggccgugacauuggauuuuaaacccggaaccucagguaguccuaucaucaaucgcaagggcaaagucauugggcuauacggaaacggcguagugacaaagagcggugacuauguuuccgcuauaacucaggccgaaaggaucggggagccggauuacgagguggacgaagauauuuuccguaagaaacggcugaccaucauggaccuccacccaggagcaggcaagacgaaacggauucugcccucuaucgucagggaggcucuuaagcgccgauuaagaacacugauacucgccccuacucgggugguugcggccgaaauggaggaagcauugaggggccugccaauccgcuaucagacccccgcugugaaaucggagcauacagggcgugagauugucgaucucaugugccacgccaccuuuacuaccagacugcuuagcucaacacgggugccuaauuacaaccugaucguaauggacgaagcucacuucacggauccguccaguguggcagccaggggauacauuucuacucgcguugagaugggugaagccgcugcgaucuuuaugaccgcaacacccccaggcgccaccgacccuuucccccaaagcaauuccccaauagaggauauugaacgagagaucccugagagaucauggaacacuggguuugacuggaucacagacuaucagggaaagaccgucugguucgugcccucuauuaaggcuggcaaugauaucgccaacugcuugcggaaaagcgguaagaaagugauacagcuaaguaggaagacguuugacacugaauacccaaaaacaaagcugaccgauugggacuucgucguuaccacugauauuuccgagaugggggcaaacuuucgcgccggcagagugaucgacccgaggcggugucucaagccuguaauuuuaacagauggacccgaacgugugauccuggcuggcccaauacccgucaccccugcgagcgccgcacaacgccgagggagaauuggaaggaauccagcucaggaggacgaucaguauguguucucuggugacccccuuaaaaacgaugaagaccaugcccacuggacagaggcaaagaugcugcucgauaauaucuacacuccugagggcaucauuccgacguuguucgggccagaacgggagaaaacccaggccaucgacggagaauuucgccugagaggcgagcaaaggaagacauucguugagcucaugcggcgaggugaccugcccguguggcuuucauauaaagucgcuuccgccgggauuaguuacaaggauagagaauggugcuuuacuggcgagcgcaacaaucagauacuagaagagaacauggaaguagagaucuggaccagggagggagaaaagaaaaagcugcggccucguugguuggacgcgagaguguaugcagaucccauggccuuaaaagacuucaaggaguuugcuagcggcaggaaaucgauuacacuggauauccucaccgaaaucgccucucugccaacuuaccuuuccagccgcgcuaagcuggcacucgacaauauuguuauguugcauacgaccgagagagggggacgagccuaccagcacgcucugaacgaacuaccugagucacuggagacacucaugcuuguggcccuguuaggugcaaugacugcgggcauauucuuguuuuucaugcaggggaagggaaucggcaaacugaguaugggucucauugccaucgcugucgccucugggcugcuuuggguggcagaaauucaaccccaguggaucgcugccuccauaauccuggaguuuuuccucauggucuugcugauuccagaaccugagaagcagagaaccccgcaggauaaucaauuaaucuaugugauucuaacaauccugaccauaauuggccucaucgcagccaacgaaaugggacuuauugagaaaacuaagacagacuuuggcuucuaccagguuaaaacggagaccacuauccuggauguggacuugaggcccgcuagcgcguggacacuguaugccguagcaaccaccauacucacaccaaugcugcgccacacuaucgaaaauacgucagcuaaccuuagucucgccgccauugcaaaucaggcugccgugcugaugggguugggaaagggcuggccucugcaucggauggauuuaggugucccccuacuggcgaugggguguuacagccagguuaacccaaccacacucacugcuucccuugugaugcuguugguccacuaugccaucauuggaccuggccugcaagcaaaagccaccagagaggcucagaagcguacagcagccgguaucaugaagaaucccaccguggacggcauaacuguaauugaucucgaaccgaucucuuacgacccaaaauuugagaagcagcuggggcaagugaugcuuuuaguucugugcgcgggacagcucuugcugaugaggacgacaugggcuuucugugaggugcuaacccuggccacuggcccuacccucacacuuugggaagggaaccccggacgguucuggaacacuaccaucgcagucagcacagccaauauuuuucgcggcuccuaucuggcuggugccggguuggcauucucacugaucaaaaacgcucagacgccacgaagaggaaccggcacuacaggugagacccucggcgaaaaguggaaaaggcagcuaaauucuuuagaccggaaggaguuugaagaguacaagcgcagugggauacuugagguggauagaacugaagccaaaucggcgcugaaggacggaagcaaaacaaagcaugccgucuccaggggaucuucaaaaauucgauggaucguggagcgggggaugguuaagcccaagggaaaaguaguggaucucggcugcggucgugggggauggagcuacuauauggcaacccuaaagaacgucacggaagugaaaggcuacaccaagggcgggccuggacacgaggaaccgauucccauggcuacauaugguuggaaucugguuaaauugcauuccggcguggacgucuucuacaagccaacugagcaaguggauacccugcucugugacaucggggagaguucuagcaacccuacaauagaagagggaagaacucuucgcguacugaagaugguggaacccugguugucauccaaaccugaguuuugcaucaagguucugaauccauauaugcccaccgucauugaagaacucgagaaauuacagaggaagcacggcgguaaccuggugcgguguccucuuaguagaaauagcacacacgaaauguacugggugucuggggccuccggaaacaucgucucaagcguuaauaccacuucgaaaaugcugcuaaaccgcuucacgacaaggcaucgaaagccaaccuaugagaaagauguggaccucggcgcaggcacucggucuguaaguaccgaaacagagaagcccgauaugacgauuaucgggagaaggcugcagcgcuugcaggaggaacacaaggagaccuggcauuacgaccaagaaaauccguaccguacuugggcuuaucacggauccuacgaggccccuagcacagguucagccuccucuauggugaacggcgucgugaaacugcucaccaagccaugggauguuauucccauggugacucagcuugcgaugacagacaccacaccuuuugggcagcagcgggucuucaaagaaaagguggacacuagaaccccacaacccaaaccgggaacgaggaugaucaugaccacaacugcuaauuggcugugggcauuacugggcaagaagaaaaacccucgcuugugcacccgagaggaguuuauaagcaagguacggaguaaugccgcuauuggugccguuuuccaggaggaacagggguggacauccgcaagcgaagccgugaacgauucuagauuuugggagcucgucgacaaagaaagggcucugcaccaagagggaaagugugagucaugcguguauaacaugaugggcaaacgcgaaaagaagcuaggcgaguucgggagagcgaaaggaagucgggccaucugguacauguggcuuggugcaagguuucuggaguucgaggcucucggcuuccugaaugaagaucauugguuugggcgugagaacuccuggagcggaguggagggcgaagguuugcaccgacugggguauauccucgaggaaauugacaagaaagauggagaccuuauguacgccgaugacacugcaggcugggauacccgcauaacggaggacgaucugcagaaugaggaauuaaucacagagcagauggcaccccaucacaagauucuggcuaaagccaucuucaaguugaccuaucagaacaaggucguuaaagugcucagaccaacuccucggggcgcgguaauggacauuaucucuaggaaggaucaacgcgggucgggacagguggguacauacggccugaauaccuuuacuaacauggaaguccagcuaauaagacagauggaggcagaaggggugaucacccaagacgacaugcagaaucccaaaggacuuaaggagcggguugagaaauggcugagggaaugcggcguggaucgacucaagcguauggccauuucaggugacgauugugucgugaaaccacuggacgagagauucgggacaagccucuuauuucugaacgauaugggaaagguacgcaaggacaucccccagugggaaccuuccaaaggcuggaagaauuggcaggagguuccauucugcagucaucacuuucacaaaauuuucaugaaggauggccggucucucguggucccguguaggaaccaagacgaacuuaucgggagagcucgcauaagccagggagccgguuggucccugcgggagacggcaugccuaggcaaggcuuacgcccagauguggucacugauguauuuucauaggcgagaucucagauuggcuaguauggccauuuguucugcagugcccaccgagugguucccuacuagccggacaaccugguccauccacgcgcaucaccaguggaugacuacagaagacaugcugaagguuuggaauaggguguggaucgaggauaacccaaauaugaccgacaagacgcccauucacucaugggaagacauaccuuaccuugggaaacgcgaggaucuguggugcggaagccucaucggcuuaucuucccgugccacaugggcuaagaacauucauaccgccaucacucaagucagaaaucugauugguaaagaagaguauguggacuacaugccaguaaugaagcgauauagugcacccagcgagucggaagggguguuguga

SEQ ID NO: 15712 - RNA, 9867 nt, Artificial Sequence
  derived and/or modified CDS sequence (opt3) from DENV-4__GQ199881__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuagaauacagaggaccguguucuuuguuuuaaugaugcugguggcacccucauauggcaugcggugugucggggugggaaaccgcgauuucguagaagguguuagcggcggggccuggguggaccuugucuuggagcacggaggcugcgugacaaccauggcucaggguaagccuacgcuggauuuugaacuaacuaagacaaccgccaaagagguggcgcuccugcgaacuuacuguaucgaagcaaguauuuccaauaucacaaccgccacgagaugcccaacccaaggggagcccuaucuuaaggaggaacaggaccagcaguacauuuguaggcgggaugucguugaccguggauggggcaacggcugcgggcuguucggaaaagguggcgugguaacaugcgcuaaguuuucuuguagcgggaaaaucacuggaaauuuggugcaaauagagaaccucgaauauaccgucgugguuacagugcauaauggcgauacucacgccgucgguaacgacaccuccaaucacggggugacagcaaccauuacuccucgcucaccaaguguagagguuaagcugccggauuacggcgaauuaacgcuggacugcgagcccagaagcggaaucgacuucaacgagaugauucucaugaagaugaaaaagaaaacauggcuugugcauaagcagugguuucuggauuugccucuaccauggaccgcuggcgccgacacuucugaaguccacuggaauuacaaagagaggauggugaccuucaaggucccccaugcgaaacggcaggaugugacaguucuggggucccaggaaggagccaugcacucagcacucgcuggugccaccgagguggacagcggcgaugggaaccacauguuugcuggacaucugaaguguaagguacgaauggaaaaacuucgcaucaagggcaugaguuauacuaugugcucugguaaauucuccaucgacaaggagauggccgagacacaacacgggacgaccgucgugaaaguuaaguacgaaggcgcaggagccccuuguaaggugccaauugagauaagagaugucaauaaagaaaaggugguaggcagggugaucagcucgacuccccuggcugagaacacaaacucuguuaccaauauugaguuggaaccgccuuucggggacuccuauaucgucauaggaguggguaacucagcgcucacacugcauugguuucggaaaggcaguagcauugggaagauguucgaguccacuuaccgcggagcaaaaagaauggccaucuuaggcgaaaccgcuugggauuuugguucuguggggggccuguucacgagccuaggaaaggccguccaccagguuuuuggcucaguguauaccacaauguucgggggagugaguuggaugaucaggauucucaucggcuuucugguacuuuggauugguacuaauucccguaacaccagcauggcaaugacaugcauagccgucgggggaaucacuuuguuccugggcuuuaccgugcaggcugacauggguuguguugugucuuggucaggccgggagcucaagugcgggaguggaauuuucgucguggauaauguucauacguggacagaacaauacaaauuucagcccgagagcccagcccgacuggcauccgcgauccuuaacgcucacaaggacggcgugugugggaucagaucuaccacuaggcuggagaauguaauguggaaacagauuacaaacgaauugaauuauguccucugggagggaggccacgaccugaccgugguggccggugaugucaaggggguuuuaacuaaaggaaagcgcgcacugaccccucccgugucggaccuaaaguacagcuggaaaacauggggcaaggccaaaauauucacgccagaagcucggaacuccaccuuucucaucgauggucccgacacuucagagugcccuaaugaaagaagggccuggaacagucuggagguagaggauuacggcuucgggauguucacaaccaauauuuggaugaaguuucgcgaaggaucuagcgaggugugugaccaucgacuuauguccgcagcuaucaaagaucagaaggccguccacgcggacaugggcuauuggauugaaucaagcaaaaaccaaacauggcagaucgagaaggccucuuugauagaagugaagacuugccuguggccaaaaacccauacgcucugguccaaugggguucuggagagucagauguuaaucccgaagagcuacgcuggacccuucucucagcacaacuaucggcaaggcuacgcaacacagaccguggguccuuggcaccuggggaaacuugagauugauuuuggagaaugcccaggcacuaccgucacaauccaggaggacugugaucaucguggucccuccuugagaacuaccacagccucaggcaagcucgugacgcaguggugcuguaggaguugcaccaugccuccacugcgcuuccuaggggaagacggauguugguauggcauggagauucggccccugagcgagaaagaagagaacaugguuaagucgcaaguggcugccgggcagggaacuuccgaaacauuuuucaugggccuccugugccuuaccuuguuugucgaggaaugucugagaaggcgaguaacucgcaagcacaugaucuuagcagugguuauaacacucugcgcgauuauccugggugggcuuaccuggauggaucuguugcgggcccucauuaugcugggagacacgaugucuggcagaaucggcgggcagacucaucuagcuauaauggccguguucaaaaugagcccgggauacguccuggguguguuucucaggaagcugaccucacgugagacagcacuuaugguaaucggcauggcuaugaccacuacauugaguauuccucacgaccugauggaguuaaucgaugggauuucccucggacugauccuucugaaaauagugacccaguucgacaauacacaagucggcacucuagcccucucucugaccuuuauucgcagcacgauguccuugguuauggcauggcggacaaucauggccgugcuguucguggucaccuuaaucccacucuguagaacuucaugccugcagaagcagagccauuggguggaaauuaccgcucuuauccugggugcgcaagccuugcccguuuaucucaugacacugaugaaaggggcaaguaggcgaucuuggccucuaaacgagggaaugauggcuguaggccuggugucccuucucggcagcgcccuguugaagaaugaugucccccuggccgggccaaugguggcuggagguuuacuccuggcagccuacguuaugucgggcucaucugcggaccuuagucuggaaaaggcugccaacgugcagugggaugagauggcagacauuacuggguccagcccuauaaucgaagucaaacaggaugaggacggaucuuuuagcauucgggauguggaggaaaccaauaugaucacguugcucguaaagcuggcccuaauuacagucuccggccuguacccccuugcuaucccagugaccaugacucucugguauauguggcagguuaaaacacaacgcucaggugcacugugggacgugccgaguccugccgcgacccagaaggcugccuugagcgagggggucuacagaauaaugcagaggggauuauucggcaaaacucaggugggcguugggauccacauggaaggaguguuccacacaauguggcaugucacccgggguucugugauuugucacgagacgggccgacuggaacccuccugggcagauguaagaaacgacaugaucucauaugggggaggcuggcgccucggugauaagugggacaaggaggaggacgugcaaguucuggccauugaaccagggaaaaaucccaagcauguccagacuaaaccuggacuuuuuaagacccugacaggcgagaucggcgcugugaccuuggauuucaaaccagggaguagcggaucccccauaauuaacaggaaggguaaagugaucggccuauacgggaauggagucguaacaaagucuggcgacuaugugucggccaucacucaggcagaacguauuggugagccugauuacgagguugacgaagauauauuucggaagaaaagacugaccaucauggaccuccacccgggggcuggaaagacgaaaaggauucugccaagcaucgugcgcgaggcccuuaagcgaagauuacggacacugauucucgcgcccacuagggucguggccgcagaaauggaggaagcuuugcgcggccugccuauccguuaucagaccccagccguuaaaucagagcauacaggcagagagauaguggaucucaugugccacgcuaccuucacuacccggcugcuuuccaguacaaggguccccaacuacaaucugaucgugauggacgaagcacacuuuacggauccuucuagcguagccgcccgcggguacauuuccacucgaguggagaugggagaagcugcggcaaucuucaugaccgccacaccgcccggugcuaccgacccauuuccucaaucaaacucucccauugaggauaucgaaagagagauaccagagcggagcuggaauacuggcuucgacuggauuacagacuaucaggggaagaccguuugguuugucccuaguaucaaggccggaaacgauaucgcaaauugcuugaggaaauccggcaagaaagugauucagcuaagccgcaagacguucgacacugaauaccccaaaacaaagcugaccgauugggacuuuguggucaccacugauaucucugagaugggugccaacuucagagcugggaggguuauagacccacggcguugucucaagccggugauuuuaacagauggcccugaacgcguaauccuggcgggacccauuccagugacccccgccucagcagcucaacgaagaggcaggaucgggcggaacccugcccaggaggacgaucaguaugucuucuccggagacccacuuaaaaaugaugaagaccaugcacacuggacagaggccaagaugcugcucgauaacauauacacucccgaggguauuaucccuacguuguuuggcccggaacgcgagaaaacccaggcuaucgacggggaauucagacugaggggagagcaacggaagacauuuguggagcucaugcgaagaggcgaccugccaguuuggcuuaguuauaaaguggccagcgcggguauuucguacaaggaucgcgaauggugcuucacuggggagaggaauaaccagauccuagaagagaauauggaagucgagauuuggacccgggagggcgaaaagaaaaagcugcgucccagaugguuggacgcaaggguauaugccgauccuauggcuuuaaaagacuuuaaggaguucgccucuggacgcaaauccauaacacuggauauccucaccgaaauugcuagccugcccacuuaccuuucaagucgggcaaagcuggcccucgacaacaucgugauguugcauacgaccgagcgaggcgggagagcuuaccagcacgcccugaaugaacuaccagagucucuggagacacucaugcuuguugcacuguuaggagcgaugacugccgguaucuuuuuguucuuuaugcagggcaaggggauuggaaaacuguccaugggccucauaaccaucgcuguggccagcggucugcuuugggucgcagaaauucaaccucaguggaucgcugccucaauuauccuggaguucuuucucaugguguugcugauacccgaaccagagaagcagaggacaccucaggauaaccaauuaaucuaugucauucuagcaauccugaccauuaucgggcucauagccgcuaaugaaaugggccuuauugagaaaacuaagacagacuucggauuuuaccaggugaaaacggagaccacuauccuggauguugacuugcgcccggcgagugccuggacacuguaugcaguggcuaccaccauucucacacccaugcugcggcacacuaucgaaaacacgagcgccaaucuuucccucgccgcaauagcuaaccaggccgcgguacugaugggcuuggggaagggauggccacugcauagaauggauuuaggcgugccucuacuggcuauggguuguuacucucaggucaaucccaccacacucacugccagccuuguuaugcuguuggugcacuaugcaaucauugggccaggacugcaagccaaagcuacccgugaggcacagaagaggacagccgcgggcaucaugaagaacccuaccgucgacgguauuacugugaucgaucucgaacccauauccuacgacccgaaauucgagaagcagcugggccaaguaaugcuuuuagugcugugcgcugggcagcucuugcugaugcggacgacaugggccuucugugagguucuaacccuggcaacuggaccaauucucacccuuugggaaggcaauccugggcgcuuuuggaacacaacuaucgccgugucaaccgcuaacaucuuccgaggaucuuaucuggccggcgcagguuuggcuuuuagucugauuaaaaaugcccagacacccagaagggggacgggaaccacuggcgagacacucggugaaaaguggaaacggcagcugaacucguuagaccgcaaggaguucgaagaguacaagagaagcggcauccuugaggucgauaggaccgaagcgaaauccgcccugaaggacgggucuaaaauaaagcaugcagugucacgaggaagcuccaaaauucgguggaucgucgagcguggcauggugaagccaaaggggaaaguuguagaucucggaugcggcagagguggguggaguuacuauauggcuacucuaaagaaugugacagaagucaaaggauacaccaagggcggccccgggcacgaggaaccuauuccgauggccacguauggauggaaccuggugaaauugcauucugguguugacguguuuuacaagcccaccgagcaagucgauacacugcucugugacaucggcgagagcucauccaauccaacuauagaagaggggcgcacccuuagggugcugaagaugguagaaccuugguugaguagcaaacccgaguucugcaucaaggugcugaacccuuauaugccaacaguuauugaagagcucgagaaauuacagcggaagcacggaggcaaucuggucagauguccccuuucucgcaacuccacucacgaaauguacugggugucaggugcaagcgggaauaucgugucgucugucaacaccacaaguaaaaugcugcuaaauagguuuaccacucgacaucggaagccuacguaugagaaagauguugaccucggagcuggcacaagauccgugagcaccgaaacugagaagccagauaugaccauuaucggcaggcgccugcagcguuugcaggaggaacacaaggagacauggcauuacgaccaagaaaaccccuaccggacgugggccuaucacgggucauacgaggccccguccaccggaucugcgagcaguaugguaaaugguguggucaaacugcucacuaagccuugggaugugauuccaaugguuacacagcuugcuaugaccgacacuacacccuucggccagcagagaguguuuaaagaaaaggucgacaccaggacaccucaaccaaaacccgggacucgcauggugaugaccacgaccgcaaacuggcugugggccuuacugggaaagaagaaaaauccgcgauugugcacacgggaggaguucaucuccaagguaagaagcaacgcugccauaggcgcaguuuuucaggaagagcaggguuggacuucugccucagaagcugugaaugauaguagguucugggagcucgucgacaaagaacgcgcgcugcaccaagaggggaagugugaguccugcguguauaacaugaugggaaaaagagaaaagaagcuaggcgaguuuggccgggccaaagggagcagggcaauuugguacauguggcuuggagcucguuuccuggaauucgaggcccucgguuuucugaacgaagaucauugguucggccgagagaauucuuggucggggguggagggagaaggcuugcaccgccuggguuauauccucgaggaaaucgacaagaaagauggggaccuuauguacgcagaugacaccgccggaugggauacaagaauuacugaggacgaucugcagaacgaggaauuaauaaccgagcagauggcuccucaucacaagauccuggccaaagcgauuuuuaaguugacguaucagaauaaggucguuaaagugcuccggcccacaccaaggggcgcaguaauggacaucauuucacgcaaggaucaaagaggcagcgggcaggugggaaccuacggucugaacacuuucacaaauauggaaguccagcuaauccggcagauggaggccgaaggcgugauaacccaagacgacaugcagaacccuaaagggcuuaaggagaggguugagaaauggcugcgagaaugcggaguggaucgucucaagagaauggcuaucuccggcgacgauugugucgugaaaccccuggacgagcgcuuugguacuaguuuguuauuccugaaugauauggggaagguacggaaggacauuccacagugggaacccucuaaaggauggaagaacuggcaggagguuccuuuuugcagccaucacuuccacaaaaucuuuaugaaggauggcaggucccucguggucccauguagaaaucaagacgaacuuauuggccgcgcccggaucucacagggggcaggauggagucugagggagaccgcuugccuagguaaagccuacgcucagauguggucucugauguauuuccaucgaagagaucuccgguuggccagcauggcaauauguuccgcggugccgacagagugguuucccacgucaaggaccacuuggagcauucacgcccaucaccaguggaugacaaccgaagacaugcugaagguuuggaaccgcguguggaucgaggauaauccuaacaugaucgacaagacuccaguccacucuugggaagacauucccuaccuuggcaaacgugaggaucuguggugcgggucccucauaggauuaaguagcagagcuacaugggccaagaauauccauaccgcaauuacgcaagugcgaaaccugaucggcaaagaagaguauguagacuacaugccugugaugaagagguauucggcuccauccgagucugaaggugucuuguga

SEQ ID NO: 15713 - RNA, 9867 nt, Artificial Sequence
  derived and/or modified CDS sequence (opt3) from DENV-4__GQ199882__SS-prME
agcaccaucacacugcucugccuuauucccacugugauggccuuccaccuguccacgcgggacggagagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccgaaaagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaaguggcugccggacagggcacuuccgaaacauuuucuaugggucuccugugccuuaccuuguucgucgaggaaugucugcggagaaggguaacucgaaagcacaugaucuuagcagugguuauaacacucugcgcgauuauccuagggggacuuaccuggauggaucuguugcgcgcccucauuaugcugggcgacacgaugagcggccggaucgggggacagacucaucuagcuauaauggccguguuuaaaaugucaccggguuacguccugggcguguuccucagaaagcugaccaguagggagacagcacuuaugguaaucgggauggcuaugaccacuacauuguccauuccucacgaccugauggaguuaaucgauggaauuucucucggccugauccuucugaaaauagugacccaguuugacaauacacaagucgguacucuagcccucagccugaccuucauucguuccacgaugucauugguuauggcauggcgcacaaucauggccgugcuguuuguggucaccuuaaucccacucugucggacuagcugccugcagaagcagagucauuggguggaaauuaccgcucuuauccugggggcgcaagccuugcccguuuaucucaugacacugaugaaaggagcaucuagaagguccuggccucuaaacgagggcauuauggcuguaggccuggugagccuucucgggucggcccuguugaagaaugaugucccccuggccggaccaaugguggcugguggcuuacuccuggcagccuacguuaugucagggucuagugcggaccuuucccuggaaaaggcugccaacgugcagugggaugagauggcagacauaacuggaagcucuccuaucauugaagucaaacaggaugaggacggcagcuucuccauccgagauguggaggaaaccaauaugauuacguugcucguaaagcuggcccuaaucacagucucaggucuguacccccuugcuauaccagugaccaugacucucugguauauguggcagguuaaaacacaacggaguggggcacugugggacgugccgagcccugccgcgacccagaaggcugccuugucugagggagucuaccgcaucaugcagagaggcuuauuuggcaaaacucagguggggguuggcauucacauggaagguguguuccacacaauguggcaugucaccaggggcuccgugaucugucacgagacggggcggcuggaacccucaugggcagauguacgaaacgacaugauuaguuauggaggcgguuggagacucggggauaagugggacaaggaggaggacgugcaaguucuggccaucgaaccaggcaaaaaucccaagcauguccagacuaaaccuggccuuuucaagacccugacaggcgagauaggggcugugaccuuggauuuuaaaccaggaacaagcgguucccccauuaucaaccgcaagggcaaagugaucgggcuauacggaaauggcgucguaacuaagucuggugacuaugugucggccauuacccaggcagaaaggauaggggagccugauuacgagguugacgaagauaucuuccguaagaaacggcugacgauuauggaccuccacccgggagcuggcaagacaaaaagaauccugccaagcauugugagggaggcccuuaagcgccgauuaagaacucugauccucgcgcccacccgggucguggccgcagaaauggaggaggcuuugaggggccugccuauacgcuaucagacaccagccguuaaaucagagcauaccgggcgugagaucguggaucucaugugccacgcuacuuuuaccacaagacugcuuuccaguacgcggguccccaacuacaaucugauugugauggacgaagcacacuucacugauccuucuagcguagccgccaggggauacaucuccacccgcguggagaugggugaagcugcggcaauuuuuaugacagccaccccgcccggcgcuacugacccauucccucaaucaaacucucccaucgaggauauagaacgagagauuccagagagaagcuggaauacaggguuugacuggaucaccgacuaucagggaaagacgguuugguucgucccuaguaucaaggccggcaacgauauugcaaauugcuugcggaaauccgguaagaaagugauccagcuaagcaggaagacuuuugacacagaauaccccaaaaccaagcugaccgauugggacuucguggucacuacagauauaucugagaugggggccaacuuucgcgcuggcagaguuauugacccaaggcggugucucaagccggugaucuuaaccgauggaucagaacguguaauucuggcgggcccuauccccgugacaccagccuccgcagcucaacgccgagggagaauaggaaggaaccccgcccaggaggacgaucaguaugucuucaguggugacccucuuaaaaaugaugaagaccaugcacacuggacugaggccaagaugcugcucgauaacauuuacacgccagagggcaucauccccaccuuguucgggccugaacgggagaaaacacaggcuauugacggagaauuucgccugagaggcgagcaaaggaagacuuucguggagcucaugcggcgaggugaccugccgguuuggcuuagcuauaaaguggccucggcggggaucucuuacaaggauagagaauggugcuuuaccggcgagcgcaauaaccagauucuagaagagaauauggaagucgagauauggacaagggagggagaaaagaaaaagcugcggccacguugguuggacgcaagaguauaugccgaucccauggcuuuaaaagacuucaaggaguuugccuccggcaggaaaagcaucacccuggauauucucacugaaaucgcuucacugccuacguaccuuaguucucgcgcaaagcuggcccucgacaacaucgugauguugcauaccacagagagagggggacgagcuuaccagcacgcccugaaugaacuacccgagucccuggagacucucaugcuuguugcacuguuaggugcgaugaccgccggcauuuucuuguuuuucaugcaggggaagggaauaggcaaacugagcaugggucucaucacaauugcuguggccucagggcugcuuugggucgcagaaauccaaccacaguggauugcugccaguaucauacuggaguuuuuccucaugguguugcugaucccugaacccgagaagcagagaaccccacaggauaaccaauuaauuuaugucauccuaacuauucugacaaucauaggccucauugcagccaaugaaaugggacuuaucgagaaaacgaagaccgacuuuggcuucuaccaggugaaaacugagacaaccauucuggauguugacuugaggccugcuagcgcguggacccuguaugccguggcaacaacuauccucacgccgaugcugcgccacaccauagaaaacacauccgcuaaucuuucucucgccgccaucgcaaaccaggcugccguacugaugggguugggaaagggcuggccccugcaucggauggauuuaggugugccacuacuggcgaugggguguuacagccaggucaauccuacuacccucacagcuucccuuguuaugcuguuggugcacuaugccauuaucggacccggccugcaagcaaaagccaccagagaggcucagaagcguacugcagccgguauuaugaagaacccaacggucgacggcaucacagugauagaucucgaaccuauuucauacgaccccaaauuugagaagcagcuggggcaaguaaugcuuuuagugcugugcgcgggacagcucuugcugaugaggaccacuugggcuuucugugagguucuaacccuggccacaggcccgauccucacucuuugggaagggaauccaggacgguucuggaacaccacaaucgcagugucuacggccaacauuuuucgcggcaguuaucuggcuggugccggguuggcauucucgcugaucaaaaaugcucagaccccucgaagaggaacuggcacaaccggugagacucucggcgaaaaguggaaaaggcagcugaacagcuuagaccggaaggaguuugaagaguacaagcgcuccgggauacuugaggucgauagaacagaagccaaaucugcgcugaaggacggaucaaaaauuaagcaugccgugagcaggggcuccaguaaaauccgauggauugucgagcgggggauggugaagcccaagggaaaaguuguagaucucggcugcggucgugggggauggucuuacuauauggcaacccuaaagaaugugacggaagucaaaggcuacaccaagggcgggccaggacacgaggaacccaucccuauggcuacauaugguuggaaccuggugaaauugcauagcggcguugacguguucuacaagccgacugagcaagucgauacccugcucugugacauaggggagucauccaguaaucccacaaucgaagagggaagaacucuucgcgugcugaagaugguagaaccaugguugagcucuaaaccugaguuuugcauuaaggugcugaaccccuauaugccuaccguuaucgaggaacucgagaaauuacagaggaagcacggcgguaaucugguccgguguccacuuuccagaaacucaacacacgaaauguacugggugagcggggccucgggaaauauugugucuagugucaacaccacuuccaaaaugcugcuaaaucgcuucacgacaaggcaucgaaagcccaccuaugagaaagauguugaccucggcgcaggcacucggagcgugucaaccgaaacagagaagccugauaugacgaucauugggagaaggcugcagcgcuugcaggaggaacacaaggagaccuggcauuacgaccaagaaaacccauaccguacuugggcuuaucacggauccuacgaggcccccucuacagguagcgccaguuccaugguaaauggcguggucaaacugcucaccaagccgugggaugugaucccuaugguuacucagcuugcgaugacagacaccacaccauuugggcagcagcggguguucaaagaaaaggucgacacuagaacgccccaaccuaaaccaggaaccaggauggugaugaccacaacugcuaacuggcugugggcauuacugggcaagaagaaaaauccccgcuugugcacccgagaggaguuuauaagcaagguacggucuaacgccgcuauuggugccguuuuccaggaagaacagggguggacaucagcaagugaagccgugaaugauuccagauuuugggagcucgucgacaaagaaagggcucugcaccaagagggaaagugugagagcugcguguauaacaugaugggcaaacgcgaaaagaagcuaggcgaguucgggagagcgaaaggaucucgggccaucugguacauguggcuuggugcaagguuucuggaguucgaggcucucggcuuccugaacgaagaucauugguuugggcgugaaaauucguggucaggaguggagggcgaagguuugcaccgacugggguauauccucgaggaaauugacaagaaagauggagaccuuauguacgccgaugacacugcaggcugggauacccgcauaacggaggacgaucugcagaacgaggaauuaaucacagagcagauggccccgcaucacaagauucuggcuaaagccaucuucaaguugaccuaucagaauaaggucguuaaagugcucagaccuacuccccggggcgcgguaauggacauuaucagcaggaaggaucaacgcggguccggacagguggguacauacggccugaacaccuuuacuaauauggaaguccagcuaauaagacagauggaggcagaaggggugaucacccaagacgacaugcagaacccaaaaggacuuaaggagcggguugagaaauggcugagggaaugcggcguggaucgacucaagcguauggccauuaguggugacgauugugucgugaaaccucuggacgagagauucgggacaucuuuguuauuucugaaugauaugggaaagguacgcaaggacaucccccagugggaaccaagcaaaggcuggaagaacuggcaggagguucccuucugcucccaucacuuucacaaaauuuucaugaaggauggccggucacucguggucccuuguaggaaucaagacgaacuuaucgggagagcucgcauaagucagggagccgguuggucucugcgggagacggcaugccuaggcaaggcuuacgcccagauguggagccugauguauuuucauaggcgagaucucagauuggcuuccauggccauuuguucagcagugccaaccgagugguucccgacuagccggacaaccuggucuauccacgcgcaucaccaguggaugacuacagaagacaugcugaagguuuggaacaggguguggaucgaggauaaucccaacaugauugacaagaccccuguccacuccugggaagacauaccauaccuugggaaacgcgaggaucuguggugcggaagucucaucggcuuaagcucgcgugccacgugggcuaagaauauucauacagccaucacccaagugagaaaccugauugguaaagaagaguauguagacuacaugcccgugaugaagcgauauuccgcaccuucugagucagaaggggucuuguga

SEQ ID NO: 15714 - RNA, 9867 nt, Artificial Sequence
  derived and/or modified CDS sequence (opt3) from DENV-4__GQ199883__SS-prME
agcaccaucacacugcucugccuuauucccacugugauggcauuccaccuguccacgcgggacggcgagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccagcgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaagugcugagguaaagcugccggauuacggagaauuaacgcuggacugcgagccccgcagcggcaucgacuucaacgagaugauucucaugaagaugaaaaagaaaacauggcuuguucauaagcagugguuucuggauuugccucuaccauggaccgccggggcggacacuucugaagugcacuggaauuacaaagagagaauggucaccuucaaggugccccaugccaaaaggcaggaugucacagugcugggaucccaggaaggugcaaugcacucagcucucgccggcgcuaccgagguugacagcggggauggaaaccacauguuugccggccaucugaaguguaaggugcggauggaaaaacuucgaaucaaggguaugaguuauacuaugugcucugggaaauucuccaucgacaaggagauggcagagacacaacacggcacgaccguagucaaagugaaguacgaaggagccggcgcuccuuguaagguuccaauugagauacgcgaugugaauaaagaaaaggucguggggagaguaaucagcucgacuccccuggcggagaacacaaacucugugaccaauauugaguuggaaccgccuuucggagacuccuauaucguuauaggugucggcaacucagcacucacacugcauugguuuaggaaagggaguagcauuggaaagauguucgaguccacuuaccggggcgccaaacgcauggcuaucuuaggugaaaccgccugggauuuugggucugugggcggacuguucacgagccuaggcaaggcagugcaccaggucuuugggucaguuuauaccacaauguucggaggcgugaguuggaugaucaggauucucaucgguuuucuggugcuuuggauugggacuaauuccagaaacaccagcauggccaugacaugcauagcuguaggaggcaucacuuuguuccuggguuuuaccguccaggccgacaugggcugugugguuucuuggucagggcgugagcucaagugcggaaguggcauuuucguggucgauaaugugcauacguggacagaacaauacaaauuucagcccgagagcccagcacggcuggcguccgcuauccuuaacgcccacaaggacgggguuuguggaauccgaucuaccacuagacuggagaaugugauguggaaacagauuacaaacgaauugaauuauguacucugggagggcggucacgaccugaccgucguggcaggggaugugaagggagucuuaacuaaaggcaagagggcccugaccccucccguuucggaccuaaaguacagcuggaaaacaugggguaaggcuaaaauauucacgccagaagcccgcaacuccaccuuucucaucgauggccccgacacuucagagugcccuaaugaacggagagcauggaacagucuggagguggaggauuacggguucggaauguucacaaccaauauuuggaugaaguuuagggaaggcucuagcgagguaugugaccaucgccuuauguccgcugccaucaaagaucagaaggcggugcacgccgacaugggguauuggauugaaucaagcaaaaaccaaacauggcagaucgagaaggcuucuuugauagaagucaagacuugccuguggccaaaaacccauacgcucugguccaauggagugcuggagagucagauguuaaucccgaaaagcuacgcaggccccuucucucagcacaacuaucgacaagguuacgccacacagaccguugggccuuggcaccugggaaaacuugagauugauuuuggcgaaugcccagguacuaccgugacaauccaggaggacugugaucaucggggccccuccuugcguacuaccacagcuucagggaagcucgucacgcaguggugcuguagaaguugcaccaugccuccacugagguuccuaggagaagacggcuguugguaugggauggagauucgcccccugagcgagaaagaagagaacauggugaagucgcaaguugccgcaggacagggcacuuccgaaacauuuucuaugggucuccugugccuuaccuuguucguggaggaaugucugcggagaagggucacucgaaagcacaugaucuuagcgguagugauaacacucugcgccauuauccuagggggacuuaccuggauggaucuguugcgcgcucucauuaugcugggcgacacgaugagcggccggaucgggggacagacucaucuagccauaauggcaguuuuuaaaaugucaccggguuacgugcugggcgucuuccucagaaagcugaccaguagggagacagcucuuauggugaucgggauggccaugaccacuacauuguccauuccucacgaccugauggaguuaaucgauggaauuucucucggccugauccuucugaaaauaguaacccaguuugacaauacacaaguggguacucuagcacucagccugaccuucauucguuccacgaugucauuggucauggccuggcgcacaaucauggcuguucuguuuguggugaccuuaaucccacucugucggacuagcugccugcagaagcagagucauugggucgaaauuaccgcgcuuauccugggggcccaagcauugcccguguaucucaugacacugaugaaaggagcuucuagaagguccuggccucuaaacgagggcauuauggccguuggccugguaagccuucucgggucggcccuguugaagaaugaugugccccuggcuggaccaauggucgccgguggauuacuccuggcagcguacgugaugucagggucuagugcugaccuuucccuggaaaaggccgcaaacguucagugggaugagauggccgacauaacuggaagcucuccuaucauugaagugaaacaggaugaggacggcagcuucuccauccgagaugucgaggaaaccaauaugauuacguugcucgugaagcuggcucuaaucacaguaucaggucuguacccccuugcaauaccagucaccaugacucucugguauauguggcaagugaaaacacaacggaguggggcccugugggacguuccgagcccugcggcuacccagaaggccgcauugucugagggaguguaccgcaucaugcagagaggcuuauuuggcaaaacucaggucggggugggcauucacauggaagguguuuuccacacaauguggcaugugaccaggggcuccgucaucugucacgagacggggcggcuggaacccucaugggccgaugugcgaaacgacaugauuaguuauggaggcgguuggagacucggggauaagugggacaaggaggaggacguacaagugcuggcuaucgaaccaggcaaaaaucccaagcauguucagacuaaaccuggccuuuucaagacccugacaggcgagauaggggccgucaccuuggauuuuaaaccaggaacaagcgguucccccauuaucaaccgcaagggcaaagugaucgggcuauacggaaauggcguggucacuaagucuggugacuauguaucggcaauuacccaggcugaaaggauaggggagccugauuacgagguggacgaagauaucuuccguaagaaacggcugacgauuauggaccuccacccgggagccggcaagacaaaaagaauccugccaagcauuguuagggaggcgcuuaagcgccgauuaagaacucugauccucgcccccacccggguggucgcagcugaaauggaggaagccuugaggggccugccuauacgcuaucagacaccagcugugaaaucagagcauaccgggcgugagaucguugaucucaugugccacgcaacuuuuaccacaagacugcuuuccaguacgcgggugcccaacuacaaucugauugucauggacgaagcccacuucacugauccuucuagcguggccgcuaggggauacaucuccacccgcguagagaugggugaagcggcagccauuuuuaugacagcuaccccgcccggcgccacugacccauucccucaaucaaacucucccaucgaggauauagaacgagagauuccagagagaagcuggaauacaggguuugacuggaucaccgacuaucagggaaagacggugugguucguuccuaguaucaaggcaggcaacgauauugccaauugcuugcggaaauccgguaagaaagucauccagcuaagcaggaagacuuuugacacagaauaccccaaaaccaagcugaccgauugggacuucguggugacuacagauauaucugagaugggggcuaacuuucgcgcgggcagagucauugacccaaggcggugucucaagccgguuaucuuaaccgauggaccugaacgugugauucuggccggccccaucccaguaacacccgcaucagcugcccaacgccgagggagaauaggaaggaacccugcacaggaggacgaucaguauguguucuccggugacccacuuaaaaaugaugaagaccaugcccacuggacugaggcuaagaugcugcucgauaacauuuacacgcccgagggcaucaucccuaccuuguucgggccggaacgggagaaaacacaggccauugacggagaauuucgccugagaggcgagcaaaggaagacuuucgucgagcucaugcggcgaggugaccugccaguguggcuuaguuauaaaguugcgagcgcagggaucucguacaaggauagagaauggugcuuuaccggcgagcgcaauaaccagauucuagaagagaauauggaaguggagauauggacaagggagggagaaaagaaaaagcugcggccccguugguuggacgccagagucuaugcugauccuauggccuuaaaagacuucaaggaguuugcuucuggcaggaaauccaucacccuggauauucucacugaaaucgcaagccugcccacguaccuuucaagucgcgccaagcuggcucucgacaacaucguaauguugcauaccacagagagagggggacgagccuaccagcacgcacugaaugaacuaccagagucucuggagacucucaugcuuguggcgcuguuaggugccaugaccgcuggcauuuucuuguuuuucaugcaggggaagggaauaggcaaacuguccaugggucucaucacaauugccguugcaagcgggcugcuuuggguggcugaaauccaaccucaguggauugccgcaucaaucauacuggaguuuuuccucauggucuugcugauccccgaaccagagaagcagagaaccccucaggauaaccaauuaauuuaugugauccuagccauucugacuaucauaggccucauugcugcgaaugaaaugggacuuaucgagaaaacaaagacggacuuuggcuucuaccaggucaaaaccgagacuacaauucuggauguggacuugaggccggccagugcauggacccuguaugcuguugccaccacaauccucacucccaugcugcgccacacgauagaaaacaccagcgccaaucuuucccucgcagcuaucgccaaccaggcggcugugcugaugggguugggaaagggcuggccacugcaucggauggauuuagguguaccucuacuggccaugggguguuacucucaggugaaucccacaacucucaccgcaagccuugucaugcuguugguucacuaugccauuaucggaccaggccugcaagcuaaagcaacaagagaggcccagaagcguaccgcggcugguauuaugaagaacccuacuguggacggcaucacggucauagaucucgaacccauuuccuacgacccgaaauuugagaagcagcuggggcaagugaugcuuuuaguacugugcgccggacagcucuugcugaugaggacaaccugggcauucugugaggugcuaacucuggccaccggcccaauccucacacuuugggaagggaauccuggacgguucuggaacacuaccaucgcuguuucaacagccaacauuuuucgcggcucuuaucuggccggugcuggguuggccuucagucugaucaaaaaugcgcagacgccccgaagaggaaccggcacuacaggugagacccucggcgaaaaguggaaaaggcagcugaacucguuagaccggaaggaguuugaagaguacaagcgcagcgggauacuugagguggauagaacugaagccaaauccgcacugaaggacggaucuaaaauuaagcaugcugucucaaggggcagcuccaaaauccgauggauuguggagcgggggauggucaagccaaagggaaaagugguugaucucggcugcggucgugggggauggaguuacuauauggccacacuaaagaauguaaccgaagugaaaggcuacacgaagggcgggcccggacacgaggaaccuaucccgauggcaaccuaugguuggaaccuggucaaauugcauucuggcguggacguuuucuacaagcccacagagcaaguggauacucugcucugugacauaggggagagcucauccaauccaaccaucgaagagggaagaacacuucgcguccugaagaugguggaaccuugguugaguagcaaacccgaguuuugcauuaagguacugaacccuuauaugccaacugugaucgaggaacucgagaaauuacagaggaagcacggcgguaaucugguucgguguccccuuucuagaaacuccacccacgaaauguacugggucucaggggcuagcggaaauauugugucgucugugaacacaaccaguaaaaugcugcuaaaucgcuucacuacgaggcaucgaaagccuacauaugagaaagaugucgaccucggcgccggcacccgguccguuagcacugaaaccgagaagccagauaugacaaucauugggagaaggcugcagcgcuugcaggaggaacacaaggagacguggcauuacgaccaagaaaaccccuaccguaccugggccuaucacggaucauacgaggcgccguccacugguucugcuagcaguauggugaauggcguagugaaacugcucacaaagccuugggaugucaucccaauggugacccagcuugcaaugacugacacaacccccuuugggcagcagcggguuuucaaagaaaagguggacacaagaacuccucaaccaaaacccggaaccaggauggucaugacgaccacagccaacuggcugugggcuuuacugggcaagaagaaaaauccgcgcuugugcacucgagaggaguuuauauccaaggugcggagcaacgccgcaauuggugccguauuccaggaggaacagggguggaccucugcuucagaagcgguuaaugauaguagauuuugggagcucguggacaaagaaagggcccugcaccaagagggaaagugugaguccugcgucuauaacaugaugggcaaacgcgaaaagaagcuaggcgaguucgggagagcaaaaggaagccgggcuaucugguacauguggcuuggugccagguuucuggaguucgaggcacucggcuuccugaacgaagaucauugguuugggcgugaaaauucuuggucgggaguggagggcgaagguuugcaccgacugggguauauccucgaggaaauugacaagaaagauggagaccuuauguacgccgaugacacagcuggcugggauacucgcauaaccgaggacgaucugcagaacgaggaauuaaucacggagcagauggccccucaucacaagauucuggcgaaagcaaucuucaaguugacauaucagaauaagguggucaaaguucucagacccaccccacggggcgccgugauggacauuaucucaaggaaggaucaacgcgggagcggacagguagguacuuacggccugaacacauuuaccaauauggaagugcagcuaauaagacagauggaggcugaaggggucaucacucaagacgacaugcagaacccuaaaggacuuaaggagcggguggagaaauggcugagggaaugcggcguugaucgacucaagcguauggccauuuccggugacgauuguguggucaaaccccuggacgagagauucgggaccaguuuguuauuucugaaugauaugggaaaggugcgcaaggacaucccacagugggaacccucuaaaggcuggaagaacuggcaggagguaccuuucugcagccaucacuuucacaaaauuuucaugaaggauggccggucccucguugugccauguaggaaucaagacgaacuuaucgggagagcacgcauaucacagggagcugguuggagucugcgggagacagccugccuaggcaaggcuuacgcccagauguggucucugauguauuuucauaggcgagaucucagauuggcaagcauggcgauuuguuccgccgucccgacggagugguuccccaccucacggacuacauggagcauccacgcucaucaccaguggaugaccacugaagacaugcugaagguguggaacaggguuuggaucgaggauaauccuaacaugauugacaagacaccagugcacucuugggaagacauacccuaccuugggaaacgcgaggaucuguggugcggaucccucaucggcuuaaguagccgugccaccugggcaaagaauauucauacggcuaucacacaagucagaaaccugauugguaaagaagaguauguggacuacaugccuguaaugaagcgauauucggccccauccgagucugaagggguguuguga

SEQ ID NO: 15715 - RNA, 9867 nt, Artificial Sequence
  derived and/or modified CDS sequence (opt3) from DENV-4__GQ199884__SS-prME
agcaccaucacacugcucugccuuauucccacugugauggccuuccaccuguccacgcgggacggagagccuuugaugauagucgcuaagcaugaaagggggcggccguuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccaaagagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaaguggcugccggacagggcacuuccgaaacauuuucuaugggucuccugugccuuaccuuguucgucgaggaaugucugcggagaaggguaacucgaaagcacaugaucuuagcagugguuauaacacucugcgcgauuauccuagggggacuuaccuggauggaucuguugcgcgcccucauuaugcugggcgacacgaugagcggccggaucgggggacagacucaucuagcuauaauggccguguuuaaaaugucaccggguuacguccugggcguguuccucagaaagcugaccaguagggagacagcacuuaugguaaucgggauggcuaugaccacuacauuguccauuccucacgaccugauggaguuaaucgauggaauuucucucggccugauccuucugaaaauagugacccaguuugacaauacacaagucgguacucuagcccucagccugaccuucauucguuccacgaugucauugguuauggcauggcgcacaaucauggccgugcuguuuguggucaccuuaaucccacucugucggacuagcugccugcagaagcagagucauuggguggaaauuaccgcucuuauccugggggcgcaagccuugcccguuuaucucaugacacugaugaaaggagcaucuagaagguccuggccucuaaacgagggcauuauggcuguaggccuggugagccuucucgggucggcccuguugaagaaugaugucccccuggccggaccaaugguggcugguggcuuacuccuggcagccuacguuaugucagggucuagugcggaccuuucccuggaaaaggcugccaacgugcagugggaugagauggcagacauaacuggaagcucuccuaucauugaagucaaacaggaugaggacggcagcuucuccauccgagauguggaggaaaccaauaugauuacguugcucguaaagcuggcccuaaucacagucucaggucuguacccccuugcuauaccagugaccaugacucucugguauauguggcagguuaaaacacaacggaguggggcacugugggacgugccgagcccugccgcgacccagaaggcugccuugucugagggagucuaccgcaucaugcagagaggcuuauuuggcaaaacucagguggggguuggcauucacauggaagguguguuccacacaauguggcaugucaccaggggcuccgugaucugucacgagacggggcggcuggaacccucaugggcagauguacgaaacgacaugauuaguuauggaggcgguuggagacucggggauaagugggacaaggaggaggacgugcaaguucuggccaucgaaccaggcaaaaaucccaagcauguccagacuaaaccuggccuuuucaagacccugacaggcgagauaggggcugugaccuuggauuuuaaaccaggaacaagcgguucccccauuaucaaccgcaagggcaaagugaucgggcuauacggaaauggcgucguaacuaagucuggugacuaugugucggccauuacccaggcagaaaggauaggggagccugauuacgagguugacgaagauaucuuccguaagaaacggcugacgauuauggaccuccacccgggagcuggcaagacaaaaagaauccugccaagcauugugagggaggcccuuaagcgccgauuaagaacucugauccucgcgcccacccgggucguggccgcagaaauggaggaggcuuugaggggccugccuauacgcuaucagacaccagccguuaaaucagagcauaccgggcgugagaucguggaucucaugugccacgcuacuuuuaccacaagacugcuuuccaguacgcggguccccaacuacaaucugauugugauggacgaagcacacuucacugauccuucuagcguagccgccaggggauacaucuccacccgcguggagaugggugaagcugcggcaauuuuuaugacagccaccccgcccggcgcuacugacccauucccucaaucaaacucucccaucgaggauauagaacgagagauuccagagagaagcuggaauacaggguuugacuggaucaccgacuaucagggaaagacgguuugguucgucccuaguaucaaggccggcaacgauauugcaaauugcuugcggaaauccgguaagaaagugauccagcuaagcaggaagacuuuugacacagaauaccccaaaaccaagcugaccgauugggacuucguggucacuacagauauaucugagaugggggccaacuuucgcgcuggcagaguuauugacccaaggcggugucucaagccggugaucuuaaccgauggaccugaacguguaauucuggcgggccccaucccagugacacccgccucagcagcucaacgccgagggagaauaggaaggaacccugcccaggaggacgaucaguaugucuucuccggugacccacuuaaaaaugaugaagaccaugcacacuggacugaggccaagaugcugcucgauaacauuuacacgcccgagggcaucaucccuaccuuguucgggccggaacgggagaaaacacaggcuauugacggagaauuucgccugagaggcgagcaaaggaagacuuucguggagcucaugcggcgaggugaccugccaguuuggcuuaguuauaaaguggccagcgcggggaucucguacaaggauagagaauggugcuuuaccggcgagcgcaauaaccagauucuagaagagaauauggaagucgagauauggacaagggagggagaaaagaaaaagcugcggccccguugguuggacgcaagaguauaugccgauccuauggcuuuaaaagacuucaaggaguuugccucuggcaggaaauccaucacccuggauauucucacugaaaucgcuagccugcccacguaccuuucaagucgcgcaaagcuggcccucgacaacaucgugauguugcauaccacagagagagggggacgagcuuaccagcacgcccugaaugaacuaccagagucucuggagacucucaugcuuguugcacuguuaggugcgaugaccgccggcauuuucuuguuuuucaugcaggggaagggaauaggcaaacuguccaugggucucaucacaauugcuguggccagcgggcugcuuugggucgcagaaauccaaccucaguggauugcugccucaaucauacuggaguuuuuccucaugguguugcugauccccgaaccagagaagcagagaaccccucaggauaaccaauuaauuuaugucauccuagcaauucugacuaucauaggccucauugccgcuaaugaaaugggacuuaucgagaaaacaaagacggacuuuggcuucuaccaggugaaaaccgagacuacaauucuggauguugacuugaggccggcgagugccuggacccuguaugcaguggcuaccacaauccucacucccaugcugcgccacacgauagaaaacaccagcgccaaucuuucccucgccgcaaucgcuaaccaggccgcgguacugaugggguugggaaagggcuggccacugcaucggauggauuuaggugugccucuacuggcuaugggguguuacucucaggucaaucccacaacucucaccgccagccuuguuaugcuguuggugcacuaugcaauuaucggaccaggccugcaagccaaagcuacaagagaggcacagaagcguaccgccgcggguauuaugaagaacccuacugucgacggcaucacggugauagaucucgaacccauuuccuacgacccgaaauuugagaagcagcuggggcaaguaaugcuuuuagugcugugcgcuggacagcucuugcugaugaggacaaccugggccuucugugagguucuaacucuggcaaccggcccaauccucacacuuugggaagggaauccuggacgguucuggaacacuaccaucgccgugucaacagcuaacauuuuucgcggcucuuaucuggccggugcaggguuggcuuucagucugaucaaaaaugcccagacgccccgaagaggaaccggcacuacaggugagacccucggcgaaaaguggaaaaggcagcugaacucguuagaccggaaggaguuugaagaguacaagcgcagcgggauacuugaggucgauagaacugaagcgaaauccgcccugaaggacggaucuaaaauuaagcaugcagugucaaggggcagcuccaaaauccgauggauugucgagcgggggauggugaagccaaagggaaaaguuguagaucucggcugcggucgugggggauggaguuacuauauggcuacacuaaagaaugugaccgaagucaaaggcuacacgaagggcgggcccggacacgaggaaccuaucccgauggccaccuaugguuggaaccuggugaaauugcauucuggcguugacguguucuacaagcccacagagcaagucgauacucugcucugugacauaggggagagcucauccaauccaaccaucgaagagggaagaacacuucgcgugcugaagaugguagaaccuugguugaguagcaaacccgaguuuugcauuaaggugcugaacccuuauaugccaacuguuaucgaggaacucgagaaauuacagaggaagcacggcgguaaucugguccgguguccccuuucuagaaacuccacccacgaaauguacugggugucaggggcaagcggaaauauugugucgucugucaacacaaccaguaaaaugcugcuaaaucgcuucacuacgaggcaucgaaagccuacauaugagaaagauguugaccucggcgcuggcacccgguccgugagcacugaaaccgagaagccagauaugacaaucauugggagaaggcugcagcgcuugcaggaggaacacaaggagacguggcauuacgaccaagaaaaccccuaccguaccugggccuaucacggaucauacgaggccccguccacugguucugcgagcaguaugguaaauggcguggucaaacugcucacaaagccuugggaugugaucccaaugguuacccagcuugcuaugacugacacaacccccuuugggcagcagcggguguucaaagaaaaggucgacacaagaacuccucaaccaaaacccggaaccaggauggugaugacgaccacagcaaacuggcugugggccuuacugggcaagaagaaaaauccgcgcuugugcacucgagaggaguuuauauccaagguacggagcaacgcugccauuggugcaguuuuccaggaagaacagggguggaccucugccucagaagcugugaaugauaguagauuuugggagcucgucgacaaagaaagggcgcugcaccaagagggaaagugugaguccugcguguauaacaugaugggcaaacgcgaaaagaagcuaggcgaguucgggagagccaaaggaagccgggcaaucugguacauguggcuuggugcuagguuucuggaguucgaggcccucggcuuccugaacgaagaucauugguuugggcgugaaaauucuuggucgggaguggagggcgaagguuugcaccgacugggguauauccucgaggaaauugacaagaaagauggagaccuuauguacgcagaugacacagccggcugggauacucgcauaaccgaggacgaucugcagaacgaggaauuaaucacggagcagauggcuccucaucacaagauucuggccaaagcgaucuucaaguugacauaucagaauaaggucguuaaagugcucagacccaccccacggggcgcaguaauggacauuaucucaaggaaggaucaacgcgggagcggacagguggguacuuacggccugaacacauuuaccaauauggaaguccagcuaauaagacagauggaggccgaaggggugaucacucaagacgacaugcagaacccuaaaggacuuaaggagcggguugagaaauggcugagggaaugcggcguggaucgacucaagcguauggcuauuuccggugacgauugugucgugaaaccccuggacgagagauucgggaccaguuuguuauuucugaaugauaugggaaagguacgcaaggacaucccacagugggaacccucuaaaggcuggaagaacuggcaggagguuccuuucugcagccaucacuuucacaaaauuuucaugaaggauggccggucccucguggucccauguaggaaucaagacgaacuuaucgggagagcccgcauaucacagggagcagguuggagucugcgggagacagcuugccuaggcaaagccuacgcucagauguggucucugauguauuuucauaggcgagaucucagauuggccagcauggcaauuuguuccgcggugccgacggagugguuccccaccucacggacuacauggagcauccacgcccaucaccaguggaugaccacugaagacaugcugaagguuuggaacaggguguggaucgaggauaauccuaacaugauugacaagacaccaguccacucuugggaagacauacccuaccuugggaaacgcgaggaucuguggugcggaucccucaucggcuuaaguagccgugcuaccugggccaagaauauucauacggcaaucacacaagugagaaaccugauugguaaagaagaguauguagacuacaugccugugaugaagcgauauucggcuccauccgagucugaaggggucuuguga

SEQ ID NO: 15716 - RNA, 9867 nt, Artificial Sequence
  derived and/or modified CDS sequence (opt3) from DENV-4__FJ882595__SS-prME
agcaccaucacacugcucugccuuauucccacugccauggcuuuccaccuguccacgcgggacggcgagccuuugaugauaguggcaaagcaugaaagggggcggccguuacuguuuaaaaccacagagggaaucaacaaguguacucugauugccauggaucucggugaaaugugcgaggacaccgucacauacaaauguccgcugcuuguuaauaccgaacccgaggauaucgacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacagcggguggagucguggauucugcgcaauccaggguucgcccugcucgcuggauuuauggcauacaugaucggccagacuggcauacagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguaucgaagccaguauuuccaauaucacaaccgcuacgcgaugcccaacccaaggagagcccuaucuuaaggaggaacaggaccagcaguacauuuguagaagggauguggucgaccggggcuggggcaacgggugcggacuguucgguaaaggcgggguugugacaugcgccaaguuuucuuguagcggaaaaaucacuggcaauuugguacaaauagagaaccucgaauauaccguggucgugacaguucauaauggugauacucacgcaguggggaacgacaccuccaaucacggcgucacagcuaccauuacuccucguucaccaaguguggagguaaagcugccggauuacggagaauuaacgcuggacugcgagccccgcagcggcaucgacuucaacgagaugauucucaugaagaugaaaaagaaaacauggcuuguucauaagcagugguuucuggauuugccucuaccauggaccgccggggcggacacuucugaagugcacuggaauuacaaagagagaauggucaccuucaaggugccccaugccaaaaggcaggaugucacagugcugggaucccaggaaggugcaaugcacucagcucucgccggcgcuaccgagguugacagcggggauggaaaccacauguuugccggccaucugaaguguaaggugcggauggaaaaacuucgaaucaaggguaugaguuauacuaugugcucugggaaauucuccaucgacaaggagauggcagagacacaacacggcacgaccguagucaaagugaaguacgaaggagccggcgcuccuuguaagguuccaauugagauacgcgaugugaauaaagaaaaggucguggggagaguaaucagcucgacuccccuggcggagaacacaaacucugugaccaauauugaguuggaaccgccuuucggagacuccuauaucguuauaggugucggcaacucagcacucacacugcauugguuuaggaaagggaguagcauuggaaagauguucgaguccacuuaccggggcgccaaacgcauggcuaucuuaggugaaaccgccugggauuuugggucugugggcggacuguucacgagccuaggcaaggcagugcaccaggucuuugggucaguuuauaccacaauguucggaggcgugaguuggaugaucaggauucuaaucgguuuucuggugcuuuggauugggacuaauuccagaaacaccagcauggccaugacaugcauagcuguaggaggcaucacuuuguuccuggguuuuaccguccaggccgacaugggcugugugguuucuuggucagggcgugagcucaagugcggaaguggcauuuucguggucgauaaugugcauacguggacagaacaauacaaauuucagcccgagagcccagcacggcuggcguccgcuauccuuaacgcccacaaggacgggguuuguggaauccgaucuaccacuagacuggagaaugugauguggaaacagauuacaaacgaauugaauuauguacucugggagggcggucacgaccugaccgucguggcaggggaugugaagggagucuuaacuaaaggcaagagggcccugaccccucccguuucggaccuaaaguacagcuggaaaacaugggguaaggcuaaaauauucacgccagaagcccgcaacuccaccuuucucaucgauggccccgacacuucagagugcccuaaugaacggagagcauggaacagucuggagguggaggauuacggguucggaauguucacaaccaauauuuggaugaaguuuagggaaggcucuagcgagguaugugaccaucgccuuauguccgcugccaucaaagaucagaaggcggugcacgccgacaugggguauuggauugaaucaagcaaaaaccaaacauggcagaucgagaaggcuucuuugauagaagucaagacuugccuguggccaaaaacccauacgcucugguccaauggagugcuggagagucagauguuaaucccaaagagcuacgcaggccccuucucucagcacaacuaucgacaagguuacgccacacagaccguugggccuuggcaccugggaaaacuugagauugauuuuggcgaaugcccagguacuaccgugacaauccaggaggacugugaucaucggggccccuccuugcguacuaccacagcuucagggaagcucgucacgcaguggugcuguagaaguugcaccaugccuccacugagguuccuaggagaagacggcuguugguaugggauggagauucgcccccugagcgagaaagaagagaacauggugaagucgcaaguugccgcaggacagggcacuuccgaaacauuuucuaugggucuccugugccuuaccuuguucguggaggaaugucugcggagaagggucacucgaaagcacaugaucuuagcgguagugauaacacucugcgccauuauccuagggggacuuaccuggauggaucuguugcgcgcucucauuaugcugggcgacacgaugagcggccggaucgggggacagacucaucuagccauaauggcaguuuuuaaaaugucaccggguuacgugcugggcgucuuccucagaaagcugaccaguagggagacagcucuuauggugaucgggauggccaugaccacuacauuguccauuccucacgaccugauggaguuaaucgauggaauuucucucggccugauccuucugaaaauaguaacccaguuugacaauacacaaguggguacucuagcacucagccugaccuucauucguuccacgaugucauuggucauggccuggcgcacaaucauggcuguucuguuuguggugaccuuaaucccacucugucggacuagcugccugcagaagcagagucauugggucgaaauuaccgcgcuuauccugggggcccaagcauugcccguguaucucaugacacugaugaaaggagcuucuagaagguccuggccucuaaacgagggcauuauggccguuggccugguaagccuucucgggucggcccuguugaagaaugaugugccccuggcuggaccaauggucgccgguggauuacuccuggcagcguacgugaugucagggucuagugcugaccuuucccuggaaaaggccgcaaacguucagugggaugagauggccgacauaacuggaagcucuccuaucauugaagugaaacaggaugaggacggcagcuucuccauccgagaugucgaggaaaccaauaugauuacguugcucgugaagcuggcucuaaucacaguaucaggucuguacccccuugcaauaccagucaccaugacucucugguauauguggcaagugaaaacacaacggaguggggcccugugggacguuccgagcccugcggcuacccagaaggccgcauugucugagggaguguaccgcaucaugcagagaggcuuauuuggcaaaacucaggucggggugggcauucacauggaagguguuuuccacacaauguggcaugugaccaggggcuccgucaucugucacgagacggggcggcuggaacccucaugggccgaugugcgaaacgacaugauuaguuauggaggcgguuggagacucggggauaagugggacaaggaggaggacguacaagugcuggcuaucgaaccaggcaaaaaucccaagcauguucagacuaaaccuggccuuuucaagacccugacaggcgagauaggggccgucaccuuggauuuuaaaccaggaacaagcgguucccccauuaucaaccgcaagggcaaagugaucgggcuauacggaaauggcguggucacuaagucuggugacuauguaucggcaauuacccaggcugaaaggauaggggagccugauuacgagguggacgaagauaucuuccguaagaaacggcugacgauuauggaccuccacccgggagccggcaagacaaaaagaauccugccaagcauuguuagggaggcgcuuaagcgccgauuaagaacucugauccucgcccccacccggguggucgcagcugaaauggaggaagccuugaggggccugccuauacgcuaucagacaccagcugugaaaucagagcauaccgggcgugagaucguugaucucaugugccacgcaacuuuuaccacaagacugcuuuccaguacgcgggugcccaacuacaaucugauugucauggacgaagcccacuucacugauccuucuagcguggccgcuaggggauacaucuccacccgcguagagaugggugaagcggcagccauuuuuaugacagcuaccccgcccggcgccacugacccauucccucaaucaaacucucccaucgaggauauagaacgagagauuccagagagaagcuggaauacaggguuugacuggaucaccgacuaucagggaaagacggugugguucguuccuaguaucaaggcaggcaacgauauugccaauugcuugcggaaauccgguaagaaagucauccagcuaagcaggaagacuuuugacacagaauaccccaaaaccaagcugaccgauugggacuucguggugacuacagauauaucugagaugggggcuaacuuucgcgcgggcagagucauugacccaaggcggugucucaagccgguuaucuuaaccgauggaccugaacgugugauucuggccggccccaucccaguaacacccgcaucagcugcccaacgccgagggagaauaggaaggaacccugcacaggaggacgaucaguauguguucuccggugacccacuuaaaaaugaugaagaccaugcccacuggacugaggcuaagaugcugcucgauaacauuuacacgcccgagggcaucaucccuaccuuguucgggccggaacgggagaaaacacaggccauugacggagaauuucgccugagaggcgagcaaaggaagacuuucgucgagcucaugcggcgaggugaccugccaguguggcuuaguuauaaaguugcgagcgcagggaucucguacaaggauagagaauggugcuuuaccggcgagcgcaauaaccagauucuagaagagaauauggaaguggagauauggacaagggagggagaaaagaaaaagcugcggccccguugguuggacgccagagucuaugcugauccuauggccuuaaaagacuucaaggaguuugcuucuggcaggaaauccaucacccuggauauucucacugaaaucgcaagccugcccacguaccuuucaagucgcgccaagcuggcucucgacaacaucguaauguugcauaccacagagagagggggacgagccuaccagcacgcacugaaugaacuaccagagucucuggagacucucaugcuuguggcgcuguuaggugccaugaccgcuggcauuuucuuguuuuucaugcaggggacaggaauaggcaagcuguccaugggucucaucaccauugccguugcaagcgggcugcuuuggguggcugaaauccaaccucaguggauugccgcaucaaucauacuggaguuuuuccucauggucuugcugauccccgaaccagagaaacagagaacuccucaggauaaccaauuaauuuaugugauccuaacaauucugacgaucauaggccucauugccgcuaaugaaaugggacuuaucgagaagaccaaaacugacuuuggcuucuaccaggucaagacagagaccaccauucuggauguggacuugaggccggcgagugccuggacacuguaugcaguugcuacuacgauccucacccccaugcugcgccacacaauagaaaacacuagcgccaaucuuucccucgccgcaaucgcuaaccaggccgcggugcugaugggguugggaaaaggcuggccacugcaucggauggauuuagguguaccucuacuggcuaugggguguuacucucaggugaaucccaccacacucaccgccagccuugucaugcuguugguucacuaugcaauuaucggaccaggccugcaagccaaggcuacuagagaggcacagaaacguacggccgcggguauuaugaagaacccuacaguggacggcaucaccgucauagaucucgaacccauuuccuacgacccgaaguuugagaaacagcuggggcaagugaugcuuuuaguacugugcgcuggacagcucuugcugaugaggacuaccugggccuucugugaggugcuaacacuggcaacuggcccaauccucacccuuugggaagggaauccuggacgguucuggaacacaacgaucgccguuucaaccgcuaacauuuuucgcggcucuuaucuggccggugcaggguuggcuuucagucugaucaagaaugcccagacuccccgaagaggaacaggcaccacuggugagacacucggcgaaaaauggaagaggcagcugaacucguuagaccggaaagaguuugaagaguacaagcgcagcgggauacuugagguggauagaaccgaagcgaaguccgcccugaaagacggaucuaagauuaaacaugcagucucaaggggcagcuccaagauccgauggauuguggagcgggggauggucaaaccaaagggaaaggugguugaucucggcugcggucgugggggauggaguuacuauauggcuacgcucaaaaauguaaccgaagugaagggcuacacaaaaggcgggcccggacacgaggaaccuaucccgauggccacuuaugguuggaaccuggucaaguugcauucuggcguggacguuuucuacaaacccaccgagcaaguggauacacugcucugugacauaggggagagcucauccaauccaacuaucgaagagggaagaacccuucgcguccugaagaugguggaaccuugguugaguagcaagcccgaguuuugcauuaaaguacugaacccuuauaugccaacagugaucgaggaacucgagaaguuacagaggaaacacggcgguaaucugguucgguguccccuuucuagaaacuccacccacgaaauguacugggucucaggggcaagcggaaauauugugucgucugugaacacuacgaguaagaugcugcuaaaucgcuucacaaccaggcaucgaaaaccuacuuaugagaaggaugucgaccucggcgcuggcacccgguccguuagcacagaaacggagaaaccagauaugaccaucauugggagaaggcugcagcgcuugcaggaggaacacaaggagacuuggcauuacgaccaagaaaaccccuaccguacaugggccuaucacggaucauacgaggccccguccaccgguucugcgagcaguauggugaauggcguagugaagcugcucacuaaaccuugggaugucaucccaauggugacacagcuugcuaugaccgacacaacucccuuugggcagcagcggguuuucaaggaaaaaguggacaccagaacgccucaaccaaagcccggaaccaggauggucaugacaacuaccgcaaacuggcugugggccuuacugggcaaaaagaagaauccgcgcuugugcacacgagaggaguuuauauccaaagugcggagcaacgcugccauuggugcaguauuccaggaagaacagggguggacuucugccucagaagcuguuaaugauaguagauuuugggagcucguggacaaggaaagggcgcugcaccaagagggaaaaugugaguccugcgucuauaacaugaugggcaagcgcgagaaaaagcuaggcgaguucgggagagccaagggaagccgggcaaucugguacauguggcuuggugcuagguuucuggaguucgaggcccucggcuuccugaacgaagaucauugguuugggcgugaaaauucuuggucgggaguggagggcgaagguuugcaccgacugggguauauccucgaggaaauugacaaaaaggauggagaccuuauguacgcagaugacaccgccggcugggauacgcgcauaacagaggacgaucugcagaacgaggaauuaaucaccgagcagauggcuccucaucacaaaauucuggccaaggcgaucuucaaauugacuuaucagaauaagguggucaagguucucagacccacaccacggggcgcagugauggacauuaucucaaggaaagaucaacgcgggagcggacagguagguaccuacggccugaacacuuuuaccaauauggaagugcagcuaauaagacagauggaggccgaaggggucaucacacaagacgacaugcagaacccuaagggacuuaaagagcggguggagaaguggcugagggaaugcggcguugaucgacucaaacguauggcuauuuccggugacgauuguguggucaagccccuggacgagagauucgggacgaguuuguuauuucugaaugauaugggaaaagugcgcaaggacaucccacagugggaacccucuaagggcuggaaaaacuggcaggagguaccuuucugcagccaucacuuucacaagauuuucaugaaagauggccggucccucguugugccauguaggaaucaagacgaacuuaucgggagagcccgcauaucacagggagcagguuggagucugcgggagaccgcuugccuaggcaaggccuacgcucagauguggucucugauguauuuucauaggcgagaucucagauuggccagcauggcaauuuguuccgcggucccgacugagugguuccccacaucacggaccacuuggagcauccacgcccaucaccaguggaugacaaccgaagacaugcugaaaguguggaacaggguuuggaucgaggauaauccuaacaugauugacaagacgccagugcacucuugggaagacauacccuaccuugggaagcgcgaggaucuguggugcggaucccucaucggcuuaaguagccgugcuacaugggccaaaaauauucauaccgcaaucacucaagucagaaaccugauugguaaggaagaguauguggacuacaugccuguaaugaaacgauauucggcuccauccgagucugaagggguguuguga

SEQ ID NO: 15717 - RNA, 9867 nt, Artificial Sequence
  derived and/or modified CDS sequence (opt3) from DENV-4__FJ882596__SS-prME
agcaccaucacucugcucugccuuauucccacugugauggccuuccaccuguccacgagagacggagagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucuaaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaggggaguuuuaacuaagggcaaacgcgcacugaccccucccgugucggaccuaaaguacagcuggaagacaugggguaaagccaagauauucacgccagaagcucggaacuccaccuuucucaucgauggccccgacacuucagagugcccuaaugaaagaagggccuggaacagucuggagguagaggauuacggguucggaauguucacaaccaauauuuggaugaaauuucgcgaaggcucuagcgaggugugugaccaucgacuuauguccgcagcuaucaaggaucagaaagccguccacgcggacaugggguauuggauugaaucaagcaagaaccaaacauggcagaucgagaaagccucuuugauagaagugaagacuugccuguggccaaagacccauacgcucugguccaauggaguucuggagagucagauguuaaucccgaaaagcuacgcuggccccuucucucagcacaacuaucggcaagguuacgcaacacagaccguggggccuuggcaccugggaaaacuugagauugauuuuggcgaaugcccagguacuaccgucacaauccaggaggacugugaucaucguggccccuccuugagaacuaccacagccucagggaaacucgugacgcaguggugcuguaggaguugcaccaugccuccacugcgcuuccuaggagaagacggcuguugguaugggauggagauucggccccugagcgagaaggaagagaacaugguuaaaucgcaaguggcugccggacagggcacuuccgaaacauuuucuaugggucuccugugccuuaccuuguucgucgaggaaugucugagaaggcgaguaacucgcaagcacaugaucuuagcagugguuauaacacucugcgcgauuauccuagggggacuuaccuggauggaucuguugcgggcccucauuaugcugggcgacacgaugagcggcagaaucgggggacagacucaucuagcuauaauggccguguuuaagaugucaccggguuacguccugggcguguuccucaggaaacugaccagucgugagacagcacuuaugguaaucgggauggcuaugaccacuacauuguccauuccucacgaccugauggaguuaaucgauggaauuucucucggccugauccuucugaagauagugacccaguuugacaauacacaagucgguacucuagcccucagccugaccuucauucgcuccacgaugucauugguuauggcauggcggacaaucauggccgugcuguuuguggucaccuuaaucccacucuguagaacuagcugccugcagaaacagagucauuggguggaaauuaccgcucuuauccugggggcgcaagccuugcccguuuaucucaugacacugaugaagggagcaucuaggcgauccuggccucuaaacgagggcauuauggcuguaggccuggugagccuucucgggucggcccuguugaaaaaugaugucccccuggccggaccaaugguggcugguggcuuacuccuggcagccuacguuaugucagggucuagugcggaccuuucccuggaaaaggcugccaacgugcagugggaugagauggcagacauaacuggaagcucuccuaucauugaagucaagcaggaugaggacggcagcuucuccauccgggauguggaggaaaccaauaugauuacguugcucguaaaacuggcccuaaucacagucucaggucuguacccccuugcuauaccagugaccaugacucucugguauauguggcagguuaagacacaacgcaguggggcacugugggacgugccgagcccugccgcgacccagaaagcugccuugucugagggagucuacagaaucaugcagaggggcuuauuuggcaagacucagguggggguuggcauucacauggaagguguguuccacacaauguggcaugucacccggggcuccgugaucugucacgagacggggcgacuggaacccucaugggcagauguaagaaacgacaugauuaguuauggaggcgguuggcgccucggggauaaaugggacaaggaggaggacgugcaaguucuggccaucgaaccaggaaagaaucccaaacauguccagacuaagccuggccuuuucaaaacccugacaggcgagauaggggcugugaccuuggauuuuaagccaggaacaagcgguucccccauuaucaacaggaaaggcaaggugaucgggcuauacggaaauggcgucguaacuaaaucuggugacuaugugucggccauuacccaggcagaacguauaggggagccugauuacgagguugacgaagauaucuuccggaagaagagacugacgauuauggaccuccacccgggagcuggcaaaacaaagaggauccugccaagcauugugcgcgaggcccuuaaacgaagauuacggacucugauccucgcgcccaccagggucguggccgcagaaauggaggaggcuuugcgcggccugccuauacguuaucagacaccagccguuaagucagagcauaccgggagagagaucguggaucucaugugccacgcuacuuuuaccacacggcugcuuuccaguacgaggguccccaacuacaaucugauugugauggacgaagcacacuucacugauccuucuagcguagccgcccgcggauacaucuccacccgaguggagaugggugaagcugcggcaauuuuuaugacagccaccccgcccggcgcuacugacccauucccucaaucaaacucucccaucgaggauauagaaagagagauuccagagcggagcuggaauacaggguuugacuggaucaccgacuaucagggaaaaacgguuugguucgucccuaguaucaaggccggcaacgauauugcaaauugcuugaggaaguccgguaaaaaggugauccagcuaagccgcaaaacuuuugacacagaauaccccaagaccaaacugaccgauugggacuucguggucacuacagauauaucugagaugggggccaacuuuagagcuggcaggguuauugacccacggcguugucucaagccggugaucuuaaccgauggaccugaacgcguaauucuggcgggccccaucccagugacacccgccucagcagcucaacgaagagggaggauaggacggaacccugcccaggaggacgaucaguaugucuucuccggugacccacuuaagaaugaugaagaccaugcacacuggacugaggccaaaaugcugcucgauaacauuuacacgcccgagggcaucaucccuaccuuguucgggccggaacgcgagaagacacaggcuauugacggagaauuuagacugaggggcgagcaacggaaaacuuucguggagcucaugcgaagaggugaccugccaguuuggcuuaguuauaagguggccagcgcggggaucucguacaaagaucgcgaauggugcuuuaccggcgagaggaauaaccagauucuagaagagaauauggaagucgagauauggacacgggagggagaaaagaagaaacugcgucccagaugguuggacgcaaggguauaugccgauccuauggcuuuaaaggacuucaaagaguuugccucuggccgcaaguccaucacccuggauauucucacugaaaucgcuagccugcccacguaccuuucaagucgggcaaaacuggcccucgacaacaucgugauguugcauaccacagagcgagggggcagagcuuaccagcacgcccugaaugaacuaccagagucucuggagacucucaugcuuguugcacuguuaggugcgaugaccgccggcauuuucuuguuuuucaugcaggggaagggaauaggcaagcuguccaugggucucaucacaauugcuguggccagcgggcugcuuugggucgcagaaauccaaccucaguggauugcugccucaaucauacuggaguuuuuccucaugguguugcugauccccgaaccagagaaacagaggaccccucaggauaaccaauuaauuuaugucauccuaacuauucugacaaucauaggccucauugcagccaaugaaaugggacuuaucgagaagacgaaaaccgacuuuggcuucuaccaggugaagacugagacaaccauucuggauguugacuugcgcccggcuagugcguggacccuguaugccguggcaacaacuauccucacgcccaugcugcggcacaccauagaaaacacaagcgcuaaucuuucccucgccgccaucgcaaaccaggcugccguacugaugggguugggaaaaggcuggccacugcauagaauggauuuaggugugccucuacuggcgaugggguguuacucucaggucaaucccacuacccucacagcuagccuuguuaugcuguuggugcacuaugccauuaucggaccaggccugcaagcaaaggccacccgugaggcucagaaaaggacugcagccgguauuaugaagaacccuacggucgacggcaucacagugauagaucucgaacccauuuccuacgacccgaaguuugagaaacagcuggggcaaguaaugcuuuuagugcugugcgcgggacagcucuugcugaugcggaccacuugggcuuucugugagguucuaacccuggccacaggcccaauccucacucuuugggaagggaauccuggacgcuucuggaacaccacaaucgcagugucaacggccaacauuuuucgaggcucuuaucuggcuggugccggguuggcauucagucugaucaagaaugcucagacccccagaaggggaacuggcacaaccggugagacucucggcgaaaaauggaagcggcagcugaacucguuagaccgcaaagaguuugaagaguacaagagaagcgggauacuugaggucgauaggacagaagccaaguccgcgcugaaagacggaucuaagauuaaacaugccgugucacgaggcagcuccaagauccgguggauugucgagcgugggauggugaaaccaaagggaaagguuguagaucucggcugcgguagagggggauggaguuacuauauggcaacccucaagaaugugacggaagucaagggcuacaccaaaggcgggcccggacacgaggaaccuaucccgauggcuacauaugguuggaaccuggugaaguugcauucuggcguugacguguucuacaaacccacugagcaagucgauacccugcucugugacauaggggagagcucauccaauccaacaaucgaagagggacgcacucuuagggugcugaagaugguagaaccuugguugaguagcaagcccgaguuuugcauuaaagugcugaacccuuauaugccaaccguuaucgaagaacucgagaaguuacagcggaaacacggcgguaaucuggucagauguccccuuucucgcaacuccacacacgaaauguacugggugucaggggccagcggaaauauugugucgucugucaacaccacaaguaagaugcugcuaaauagguucacgacacgacaucggaaaccuaccuaugagaaggauguugaccucggcgcaggcacuagauccgugagcaccgaaacagagaaaccagauaugacgaucauugggaggcgccugcagcguuugcaggaggaacacaaggagaccuggcauuacgaccaagaaaaccccuaccggacuugggcuuaucacggaucauacgaggccccguccacagguucugccagcaguaugguaaauggcguggucaagcugcucaccaaaccuugggaugugaucccaaugguuacucagcuugcgaugacagacaccacacccuuugggcagcagagaguguucaaggaaaaagucgacacuaggaccccucaaccaaagcccggaacgcgcauggugaugaccacaacugcuaacuggcugugggcauuacugggcaaaaagaagaauccgcgauugugcacccgggaggaguuuauauccaaaguaagaagcaacgccgcuauuggugccguuuuccaggaagaacagggguggacaucugcaucagaagccgugaaugauaguagguuuugggagcucgucgacaaggaacgcgcucugcaccaagagggaaaaugugaguccugcguguauaacaugaugggcaagagagagaaaaagcuaggcgaguucgggcgggcgaagggaagcagggccaucugguacauguggcuuggugcacguuuucuggaguucgaggcucucggcuuccugaacgaagaucauugguuugggcgagaaaauucuuggucgggaguggagggcgaagguuugcaccgccugggguauauccucgaggaaauugacaaaaaggauggagaccuuauguacgccgaugacacugcaggcugggauaccagaauaacggaggacgaucugcagaacgaggaauuaaucacagagcagauggccccucaucacaaaauucuggcuaaggccaucuucaaauugaccuaucagaauaaggucguuaaggugcuccggcccacuccaaggggcgcgguaauggacauuaucucacgcaaagaucaaagagggagcggacagguggguacauacggccugaacaccuuuacuaauauggaaguccagcuaauacggcagauggaggcagaaggggugaucacccaagacgacaugcagaacccuaagggacuuaaagagaggguugagaaguggcugcgagaaugcggcguggaucgucucaaaagaauggccauuuccggugacgauugugucgugaagccccuggacgagcgcuucgggacaaguuuguuauuucugaaugauaugggaaaaguacggaaggacaucccacagugggaacccucuaagggcuggaaaaacuggcaggagguuccuuucugcagccaucacuuucacaagauuuucaugaaagauggcaggucccucguggucccauguagaaaucaagacgaacuuaucgggcgcgcucggauaucacagggagccgguuggagucugagggagacggcaugccuaggcaaggcuuacgcccagauguggucucugauguauuuucaucgaagagaucuccgguuggcuagcauggccauuuguuccgcagugccgaccgagugguuccccacuucaaggacaaccuggagcauccacgcgcaucaccaguggaugacuacagaagacaugcugaaaguuuggaaccgcguguggaucgaggauaauccuaacaugauugacaagaccccaguccacucuugggaagacauacccuaccuugggaagcgugaggaucuguggugcggaucccucaucggcuuaaguagcagagccacgugggcuaaaaauauucauacagccaucacccaagugcgaaaccugauugguaaggaagaguauguagacuacaugccugugaugaaaagguauucggcaccauccgagucugaaggggucuuguga

SEQ ID NO: 15718 - RNA, 9867 nt, Artificial Sequence
  derived and/or modified CDS sequence (opt3) from DENV-4__FJ850059__SS-prME
agcaccauaacacugcucugccuuauucccacugugauggccuuccaccuguccacgagagacggagagccuuugaugauagucgcuaagcaugaaagggggcggccguuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagugugggucgaccuuguguuggagcacggcgguugcgugacaaccauggcccaggggaagccuacgcuggauuuugaacugacuaagacaaccgcuaaagaggucgcccuccugcgcacuuacuguaucgaagcgaguauuuccaauaucacaaccgcaacgcgaugcccaacccaaggagagcccuaucuuaaggaggaacaggaccagcaguacauuuguagaagggauguuguggaccggggcuggggcaacgggugcggacuguucgguaaaggcgggguagugacaugcgccaaguuuucuuguagcggaaaaaucacuggcaauuugguccaaauagagaaccucgaauauaccgugguugugacaguccauaauggugauacucacgcuguggggaacgacaccuccaaucacggcguaacagccaccauuacuccucguucaccaaguguugaggugaagcugccggauuacggagaauuaacgcuggacugcgagccccgcagcggcaucgacuucaacgagaugauucucaugaagaugaaaaagaaaacauggcuuguccauaagcagugguuucuggauuugccucuaccauggaccgcaggggcugacacuucugaagugcacuggaauuacaaagagagaauggucaccuucaaggugccccaugccaaaaggcaggauguuacagugcugggaucccaggaaggugcgaugcacucagcccucgcaggcgcuaccgagguagacagcggggauggaaaccacauguuugccggccaucugaaguguaagguccggauggaaaaacuucgaaucaaggguaugaguuauacuaugugcucugggaaauucuccaucgacaaggagauggcugagacacaacacggcacgaccgugguuaaagugaaguacgaaggagccggcgcaccuuguaaggucccaauugagauacgcgaugugaauaaagaaaagguaguggggagaguuaucagcucgacuccccuggccgagaacacaaacucugucaccaauauugaguuggaaccgccuuucggagacuccuauaucgugauaggugugggcaacucagcucucacacugcauugguuuaggaaagggaguagcauuggaaagauguucgaguccacuuaccggggcgcgaaacgcauggcaaucuuaggugaaaccgccugggauuuugggucugucggcggacuguucacgagccuaggcaaggcuguucaccagguguuugggucaguguauaccacaauguucggaggcguaaguuggaugaucaggauucucaucgguuuucugguccuuuggauugggacuaauuccagaaacaccagcauggccaugacaugcauagcagugggaggcaucacuuuguuccuggguuuuaccguucaggccgacaugggcuguguggucucuuggucagggcgugagcucaagugcggaaguggcauuuucgugguugauaaugugcauacguggacagaacaauacaaauuucagcccgagagcccagcucggcuggccuccgcaauccuuaucgcgcacaaggacgggguauguggcauucgaucuaccacuagacuggagaacgucauguggaaacagauaacaaaugaauugaacuaugugcucugggagggcggucacgaccugaccguggucgcuggggaugccaagggaguuuuaacuaaaggcaagagggcacugaccccucccgugucggaccuaaaguacagcuggaaaacaugggguaaggccaaaaucuucacgccagaagcucgcaauuccaccuuucucauugauggccccgacacuucagagugcccuaacgaacggagagccuggaauagucuggagguagaggauuacggguucggaauguucacaaccaacaucuggaugaaguuuagggaaggcucuagcgaggugugugaccaucgccuuauguccgcagcuauuaaagaucagaaggccguccacgcggacaugggguauuggaucgaaucaagcaaaaaucaaacauggcagauagagaaggccucuuugaucgaagugaagacuugccuguggccaaaaacccauacgcucugguccaacggaguucuggagagucagauguuaauuccaaagagcuacgcuggccccuucucucagcacaauuaucgacaagguuacgcaacacagaccguggggccuuggcaccugggaaaacuugagaucgauuuuggcgaaugcccagguacuaccgucacaauucaggaggacugugaucaucggggccccuccuugcguacuaccacagccucagggaagcucgugacgcaguggugcuguagaaguugcaccaugccuccacugagguuccuaggagaagacggcuguugguaugggauggagauccgcccccugagcgagaaagaagagaacaugguuaagucgcaagugacugcuggacagggcacauccgaaaccuuuucuaugggucuccugugccuuacuuuguucgucgaggaaugucugcggagaaggguaacacgaaagcacaugauauuagccgugguuauuacccucugcgcaaucauucuagggggacuuacguggauggaucuguugcgcgcgcucaucaugcugggcgacacuaugagcggccggauagggggacagacccaucuagccaucauggcuguguuuaaaaugucaccggguuacguccugggcguguuccucagaaagcugacaaguagggagaccgcccuuaugguaauugggauggcaaugacuacaaccuuguccaucccucacgaccugauggaguuaauugauggaaucucucucggccugauacuucugaaaauugugacacaguuugacaacacucaagucgguacccuagcucucagccugacguucauccguuccacaaugucauugguuauggccuggcgcaccaucauggcagugcuguuuguggucacuuuaauuccacucugucggaccagcugccugcagaagcagagucauuggguggaaaucacagcccuuauucugggggcucaagcguugcccguuuaucucaugacucugaugaaaggagccucuagaagguccuggccucuaaaugagggcauaauggcaguaggccuggugagccuucucgggucggcucuguugaagaacgaugucccccuggccggaccaaugguggccgguggcuuacuccuggcugcauacguuaugucagggucuagugccgaccuuucccuggaaaaggcggcuaaugugcagugggaugagauggccgacaucaccggaagcucuccuauuaucgaagucaaacaggaugaggacggcagcuucuccauucgagauguggaggaaacgaacaugaucacauugcucguaaagcuggcacuaauaaccgucucaggucuguacccccuugccaucccagugacuaugacacucugguauauguggcagguuaaaacccaacggaguggggcucugugggacgugccgagcccugcagccacucagaaggcggcuuugucugagggagucuaccgcauuaugcagagaggcuuauuuggcaaaacacagguggggguuggaauccacauggaagguguguuccacaccauguggcaugucacgaggggcuccgugauuugucacgagacugggcggcuggaacccucaugggccgauguacgaaaugacaugaucaguuauggaggcgguuggagacucggggauaagugggacaaggaggaggacgugcaaguucuggcaauagaaccaggcaaaaaccccaagcauguccagaccaaaccuggccuuuucaagacacugaccggcgagauuggggccgugacauuggauuuuaaaccaggaacuagcgguucccccaucaucaaucgcaagggcaaagugauugggcuauacggaaacggcgucguaaccaagucuggugacuaugugucggcuauaacgcaggccgaaaggaucggggagccugauuacgagguugacgaagauauuuuccguaagaaacggcugacaaucauggaccuccacccgggagcaggcaagacuaaacggauucugccaagcaucgugagggaggcucuuaagcgccgauuaagaacccugauacucgcccccacacgggucguggcggccgaaauggaggaagcauugaggggccugccuauccgcuaucagaccccagcuguuaaaucagagcauacugggcgugagauuguggaucucaugugccacgccaccuuuacaacgagacugcuuuccaguacucggguccccaauuacaaccugaucgugauggacgaagcucacuucaccgauccuucuagcguagcagccaggggauacauuuccacacgcguggagaugggugaagccgcugcgaucuuuaugaccgcaacuccgcccggcgccacagacccauucccucaaucaaauucucccauagaggauauugaacgagagaucccagagagaagcuggaacaccggguuugacuggaucacggacuaucagggaaagacuguuugguucgucccuaguauuaaggcuggcaaugauaucgccaacugcuugcggaaauccgguaagaaagugauacagcuaagcaggaagacauuugacaccgaauaccccaaaaccaagcugacugauugggacuucguggucacaaccgauauuucugagaugggggcaaauuuucgcgccggcagaguuaucgacccaaggcggugucucaagccggugauuuuaacagauggaccugaacguguaauccuggcuggccccauaccagugacucccgcgucagccgcacaacgccgagggagaauuggaaggaacccugcucaggaggacgaucaguaugucuucuccggugacccacuuaaaaacgaugaagaccaugcccacuggacggaggcaaagaugcugcucgauaauaucuacacccccgagggcaucauuccuacauuguucgggccggaacgggagaaaacucaggccaucgacggagaauuucgccugagaggcgagcaaaggaagaccuucguggagcucaugcggcgaggugaccugccaguuuggcuuaguuauaaaguggcuagcgccgggauuucguacaaggauagagaauggugcuuuacaggcgagcgcaacaaucagauacuagaagagaacauggaagucgagaucuggaccagggagggagaaaagaaaaagcugcggccccguugguuggacgcgagaguauaugcagauccuauggccuuaaaagacuucaaggaguuugcuucuggcaggaaauccauuacucuggauauccucacggaaaucgccagccugcccaccuaccuuucaagucgcgcuaagcuggcacucgacaauauugugauguugcauacaacugagagagggggacgagccuaccagcacgcucugaacgaacuaccagagucucuggagacccucaugcuuguugcccuguuaggugcaaugacagcgggcauauucuuguuuuucaugcaggggaagggaaucggcaaacuguccaugggucucauuaccaucgccguggcuagcgggcugcuuugggucgccgaaauucaaccucaguggaucgcagcuucaauaauccuggaguuuuuccucaugguguugcugauucccgaaccagagaagcagagaacuccucaggauaaucaauuaaucuaugucauucuaacaauccugacgauaauuggccucaucgccgcaaacgaaaugggacuuauugagaaaaccaagacugacuuuggcuucuaccaggugaaaacagagaccaccauccuggauguugacuugaggccggccagugcuuggacacuguaugcgguggccacuacgauacucacccccaugcugcgccacacaaucgaaaauacuagcgcaaaccuuucccucgcugccauugccaaucaggcagcuguacugaugggguugggaaagggcuggccacugcaucggauggauuuaggugugccucuacuggccaugggguguuacucucaggucaaccccaccacacucaccgcgagccuuguuaugcuguuggugcacuaugcuaucauuggaccaggccugcaagccaaagcaacuagagaggcccagaagcguacggcugcagguaucaugaagaauccuacagucgacggcauaaccgugauugaucucgaacccaucuccuacgacccgaaauuugagaagcagcuggggcaaguaaugcuuuuagugcugugcgccggacagcucuugcugaugaggacuaccugggcguucugugagguucuaacacuggcuacuggcccaauccucacccuuugggaagggaacccuggacgguucuggaauacaacgauugccgugucaaccgcaaacaucuuucgcggcucuuaucuggccggugcuggguuggccuucagucugaucaaaaacgcacagacuccccgaagaggaacaggcaccacuggugagacacucggcgaaaaguggaaaaggcagcuaaauucguuagaccggaaggaguuugaagaguacaagcgcagcgggauucuugaggucgauagaaccgaagcuaaauccgcccugaaggacggaucuaaaaucaagcaugcggugucaaggggcagcuccaaaauucgauggaucgucgagcgggggauggugaagccaaagggaaaaguuguagaucucggcugcggucgugggggauggaguuacuauauggccacgcuaaagaacgugaccgaagucaaaggcuacacaaagggcgggcccggacacgaggaaccuauaccgauggcaacuuaugguuggaaucuggugaaauugcauucuggcguugacguguucuacagacccaccgagcaagucgauacacugcucugugacaucggggagagcucauccaacccaacuauugaagagggacgcacccuuagggugcugaagaugguagaaccuugguugaguagcaagcccgaguuuugcaucaaagugcugaauccuuauaugccaacaguuauugaagaacucgagaaguuacagcggaaacacggcgguaaccuggucagauguccccuuucucgcaauuccacccacgaaauguacugggugucaggggcuagcggaaacaucgugucgucugucaauacuacgaguaagaugcugcuaaacagguucacaacccgacaucggaaaccuacuuaugagaaggauguugaccucggcgccggcaccagauccgugagcacagaaacggagaaaccagauaugaccauuaucgggaggcgccugcagcguuugcaggaggaacacaaggagacuuggcauuacgaccaagaaaaucccuaccggacaugggcauaucacggaucauacgaggcuccguccaccgguucugccagcaguaugguaaacggcguggucaagcugcucacuaaaccuugggaugugauaccaaugguuacacagcuugccaugaccgacacaacucccuuugggcagcagagaguguucaaggaaaaagucgacaccaggacgccucaaccaaagcccggaacccgcauggugaugacaacuaccgcgaauuggcugugggcuuuacugggcaaaaagaagaacccgcgauugugcacacgggaggaguuuauuuccaaaguaagaagcaaugcagccaucggugcuguuuuccaggaagaacagggguggacuucugccucagaagcagugaacgauaguagguuuugggagcucgucgacaaggaacgcgcccugcaccaagagggaaaaugugaguccugcguguauaauaugaugggcaagagagagaaaaagcuaggcgaguucgggcgggcuaagggaagcagggcgaucugguacauguggcuuggugcccguuuucuggaguucgaggcacucggcuuccugaacgaagaucauugguuugggcgagagaacucuuggucgggaguggagggcgaagguuugcaccgccugggguauauucucgaggaaauagacaaaaaggauggagaccuuauguacgcugaugacaccgccggcugggauacgagaaucacagaggacgaucugcagaaugaggaauuaauuaccgagcagauggcaccucaucacaaaauccuggccaaggcuauuuucaaauugacuuaucagaacaaggucguuaaggugcuccggcccacaccaaggggcgccguaauggacaucauaucacgcaaagaucaaagagggagcggacagguggguaccuacggccugaauacuuuuaccaacauggaaguccagcuaauccggcagauggaggcggaaggggugauuacacaagacgacaugcagaauccuaagggacuuaaagagaggguugagaaguggcugcgagaaugcggcguggaucgucucaaaagaauggcaaucuccggugacgauugugucgugaagccccuggacgagcgcuucgggacgaguuuguuauuucugaacgauaugggaaaaguacggaaggacauuccacagugggaacccucuaagggcuggaaaaauuggcaggagguuccuuucugcagccaucacuuucacaagaucuucaugaaagauggcaggucccucguggucccauguagaaaccaagacgaacuuauagggcgcgcccggauuucacagggagcugguuggagucugagggagaccgccugccuaggcaaggcauacgcucagauguggucucugauguauuuucaucgaagagaucuccgguuggccagcauggcuaucuguuccgccgugccgacugagugguuccccacaucaaggaccacuuggagcauccacgcacaucaccaguggaugacaaccgaagacaugcugaaaguuuggaaucgcguguggauugaggauaacccuaauaugauagacaagacgccaguccacucuugggaagacauccccuaccuugggaagcgugaggaucuguggugcggaucccucauuggcuuaaguagcagagcgacaugggccaaaaacauccauaccgcuauuacucaagugcgaaaucugaucgguaaggaagaguauguagacuacaugccugugaugaaaagguauucggccccauccgagucugaaggggucuuguga

SEQ ID NO: 15719 - RNA, 9867 nt, Artificial Sequence
  derived and/or modified CDS sequence (opt3) from DENV-4__FJ882598__SS-prME
agcaccaucacucugcucugccuuauucccacugccauggcuuuccaccuguccacgcgggacggcgagccuuugaugauaguggcaaagcaugaaagggggcggccguuacuguuuaaaaccaccgagggaaucaacaaguguacucugauugccauggaucucggugaaaugugcgaggacaccgucacauacaaauguccgcugcuuguuaauaccgaacccgaggauaucgacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacagcggguggagucguggauucugcgcaauccaggguucgcccugcucgcuggauuuauggcauacaugaucggccagacuggcauacagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguaucgaagccaguauuuccaauaucacaaccgcuacgcgaugcccaacccaaggagagcccuaucuuaaggaggaacaggaccagcaguacauuuguagaagggauguggucgaccggggcuggggcaacgggugcggacuguucgguaaaggcgggguugugacaugcgccaaguuuucuuguagcggaaaaaucacuggcaauuugguacaaauagagaaccucgaauauaccguggucgugacaguucauaauggugauacucacgcaguggggaacgacaccuccaaucacggcgucacagcuaccauuacuccucguucaccaaguguggagguaaagcugccggauuacggagaauuaacgcuggacugcgagccccgcagcggcaucgacuucaacgagaugauucucaugaagaugaaaaagaaaacauggcuuguucauaagcagugguuucuggauuugccucuaccauggaccgccggggcggacacuucugaagugcacuggaauuacaaagagagaauggucaccuucaaggugccccaugccaaaaggcaggaugucacagugcugggaucccaggaaggugcaaugcacucagcucucgccggcgcuaccgagguugacagcggggauggaaaccacauguuugccggccaucugaaguguaaggugcggauggaaaaacuucgaaucaaggguaugaguuauacuaugugcucugggaaauucuccaucgacaaggagauggcagagacacaacacggcacgaccguagucaaagugaaguacgaaggagccggcgcuccuuguaagguuccaauugagauacgcgaugugaauaaagaaaaggucguggggagaguaaucagcucgacuccccuggcggagaacacaaacucugugaccaauauugaguuggaaccgccuuucggagacuccuauaucguuauaggugucggcaacucagcacucacacugcauugguuuaggaaagggaguagcauuggaaagauguucgaguccacuuaccggggcgccaaacgcauggcuaucuuaggugaaaccgccugggauuuugggucugugggcggacuguucacgagccuaggcaaggcagugcaccaggucuuugggucaguuuauaccacaauguucggaggcgugaguuggaugaucaggauucucaucgguuuucuggugcuuuggauugggacuaauuccagaaacaccagcauggccaugacaugcauagcuguaggaggcaucacuuuguuccuggguuuuaccguccaggccgacaugggcugugugguuucuuggucagggcgugagcucaagugcggaaguggcauuuucguggucgauaaugugcauacguggacagaacaauacaaauuucagcccgagagcccagcacggcuggcguccgcuauccuuaacgcccacaaggacgggguuuguggaauccgaucuaccacuagacuggagaaugugauguggaaacagauuacaaacgaauugaauuauguacucugggagggcggucacgaccugaccgucguggcaggggaugugaagggagucuuaacuaaaggcaagagggcccugaccccucccguuucggaccuaaaguacagcuggaaaacaugggguaaggcuaaaauauucacgccagaagcccgcaacuccaccuuucucaucgauggccccgacacuucagagugcccuaaugaacggagagcauggaacagucuggagguggaggauuacggguucggaauguucacaaccaauauuuggaugaaguuuagggaaggcucuagcgagguaugugaccaucgccuuauguccgcugccaucaaagaucagaaggcggugcacgccgacaugggguauuggauugaaucaagcaaaaaccaaacauggcagaucgagaaggcuucuuugauagaagucaagacuugccuguggccaaaaacccauacgcucugguccaauggagugcuggagagucagauguuaaucccaaagagcuacgcaggccccuucucucagcacaacuaucgacaagguuacgccacacagaccguugggccuuggcaccugggaaaacuugagauugauuuuggcgaaugcccagguacuaccgugacaauccaggaggacugugaucaucggggccccuccuugcguacuaccacagcuucagggaagcucgucacgcaguggugcuguagaaguugcaccaugccuccacugagguuccuaggagaagacggcuguugguaugggauggagauucgcccccugagcgagaaagaagagaacauggugaagucgcaaguugccgcaggacagggcacuuccgaaacauuuucuaugggucuccugugccuuaccuuguucguggaggaaugucugcggagaagggucacucgaaagcacaugaucuuagcgguagugauaacacucugcgccauuauccuagggggacuuaccuggauggaucuguugcgcgcucucauuaugcugggcgacacgaugagcggccggaucgggggacagacucaucuagccauaauggcaguuuuuaaaaugucaccggguuacgugcugggcgucuuccucagaaagcugaccaguagggagacagcucuuauggugaucgggauggccaugaccacuacauuguccauuccucacgaccugauggaguuaaucgauggaauuucucucggccugauccuucugaaaauaguaacccaguuugacaauacacaaguggguacucuagcacucagccugaccuucauucguuccacgaugucauuggucauggccuggcgcacaaucauggcuguucuguuuguggugaccuuaaucccacucugucggacuagcugccugcagaagcagagucauugggucgaaauuaccgcgcuuauccugggggcccaagcauugcccguguaucucaugacacugaugaaaggagcuucuagaagguccuggccucuaaacgagggcauuauggccguuggccugguaagccuucucgggucggcccuguugaagaaugaugugccccuggcuggaccaauggucgccgguggauuacuccuggcagcguacgugaugucagggucuagugcugaccuuucccuggaaaaggccgcaaacguucagugggaugagauggccgacauaacuggaagcucuccuaucauugaagugaaacaggaugaggacggcagcuucuccauccgagaugucgaggaaaccaauaugauuacguugcucgugaagcuggcucuaaucacaguaucaggucuguacccccuugcaauaccagucaccaugacucucugguauauguggcaagugaaaacacaacggaguggggcccugugggacguuccgagcccugcggcuacccagaaggccgcauugucugagggaguguaccgcaucaugcagagaggcuuauuuggcaaaacucaggucggggugggcauucacauggaagguguuuuccacacaauguggcaugugaccaggggcuccgucaucugucacgagacggggcggcuggaacccucaugggccgaugugcgaaacgacaugauuaguuauggaggcgguuggagacucggggauaagugggacaaggaggaggacguacaagugcuggcuaucgaaccaggcaaaaaucccaagcauguucagacuaaaccuggccuuuucaagacccugacaggcgagauaggggccgucaccuuggauuuuaaaccaggaacaagcgguucccccauuaucaaccgcaagggcaaagugaucgggcuauacggaaauggcguggucacuaagucuggugacuauguaucggcaauuacccaggcugaaaggauaggggagccugauuacgagguggacgaagauaucuuccguaagaaacggcugacgauuauggaccuccacccgggagccggcaagacaaaaagaauccugccaagcauuguuagggaggcgcuuaagcgccgauuaagaacucugauccucgcccccacccggguggucgcagcugaaauggaggaagccuugaggggccugccuauacgcuaucagacaccagcugugaaaucagagcauaccgggcgugagaucguugaucucaugugccacgcaacuuuuaccacaagacugcuuuccaguacgcgggugcccaacuacaaucugauugucauggacgaagcccacuucacugauccuucuagcguggccgcuaggggauacaucuccacccgcguagagaugggugaagcggcagccauuuuuaugacagcuaccccgcccggcgccacugacccauucccucaaucaaacucucccaucgaggauauagaacgagagauuccagagagaagcuggaauacaggguuugacuggaucaccgacuaucagggaaagacggugugguucguuccuaguaucaaggcaggcaacgauauugccaauugcuugcggaaauccgguaagaaagucauccagcuaagcaggaagacuuuugacacagaauaccccaaaaccaagcugaccgauugggacuucguggugacuacagauauaucugagaugggggcuaacuuucgcgcgggcagagucauugacccaaggcggugucucaagccgguuaucuuaaccgauggaccugaacgugugauucuggccggccccaucccaguaacacccgcaucagcugcccaacgccgagggagaauaggaaggaacccugcacaggaggacgaucaguauguguucuccggugacccacuuaaaaaugaugaagaccaugcccacuggacugaggcuaagaugcugcucgauaacauuuacacgcccgagggcaucaucccuaccuuguucgggccggaacgggagaaaacacaggccauugacggagaauuucgccugagaggcgagcaaaggaagacuuucgucgagcucaugcggcgaggugaccugccaguguggcuuaguuauaaaguugcgagcgcagggaucucguacaaggauagagaauggugcuuuaccggcgagcgcaauaaccagauucuagaagagaauauggaaguggagauauggacaagggagggagaaaagaaaaagcugcggccccguugguuggacgccagagucuaugcugauccuauggccuuaaaagacuucaaggaguuugcuucuggcaggaaauccaucacccuggauauucucacugaaaucgcaagccugcccacguaccuuucaagucgcgccaagcuggcucucgacaacaucguaauguugcauaccacagagagagggggacgagccuaccagcacgcacugaaugaacuaccagagucucuggagacucucaugcuuguggcgcuguuaggugccaugaccgcuggcauuuucuuguuuuucaugcaggggaagggaauaggcaaacuguccaugggucucaucacaauugccguugcaagcgggcugcuuuggguggcugaaauccaaccucaguggauugccgcaucaaucauacuggaguuuuuccucauggucuugcugauccccgaaccagagaagcagagaaccccucaggauaaccaauuaauuuaugugauccuaacuauucugacaaucauaggccucauugccgcuaaugaaaugggacuuaucgagaaaacgaagaccgacuuuggcuucuaccaggucaaaacugagacaaccauucuggauguggacuugaggccggcgagugccuggacccuguaugcaguugcuacaacuauccucacgcccaugcugcgccacaccauagaaaacacaagcgccaaucuuucccucgccgcaaucgcuaaccaggccgcggugcugaugggguugggaaagggcuggccacugcaucggauggauuuagguguaccucuacuggcuaugggguguuacucucaggugaaucccacuacccucacagccagccuugucaugcuguugguucacuaugcaauuaucggaccaggccugcaagccaaagcuaccagagaggcacagaagcguacugccgcggguauuaugaagaacccuacgguggacggcaucacagucauagaucucgaacccauuuccuacgacccgaaauuugagaagcagcuggggcaagugaugcuuuuaguacugugcgcuggacagcucuugcugaugaggaccacuugggccuucugugaggugcuaacccuggcaacaggcccaauccucacucuuugggaagggaauccuggacgguucuggaacaccacaaucgccguuucaacggcuaacauuuuucgcggcucuuaucuggccggugcaggguuggcuuucagucugaucaaaaaugcccagacaccccgaagaggaacuggcacaaccggugagacucucggcgaaaaguggaaaaggcagcugaacucguuagaccggaaggaguuugaagaguacaagcgcagcgggauacuugagguggauagaacagaagcgaaauccgcccugaaggacggaucuaaaauuaagcaugcagucucaaggggcagcuccaaaauccgauggauuguggagcgggggauggucaagccaaagggaaaagugguugaucucggcugcggucgugggggauggaguuacuauauggcuacccuaaagaauguaacggaagugaaaggcuacaccaagggcgggcccggacacgaggaaccuaucccgauggccacauaugguuggaaccuggucaaauugcauucuggcguggacguuuucuacaagcccacugagcaaguggauacccugcucugugacauaggggagagcucauccaauccaacaaucgaagagggaagaacucuucgcguccugaagaugguggaaccuugguugaguagcaaacccgaguuuugcauuaagguacugaacccuuauaugccaaccgugaucgaggaacucgagaaauuacagaggaagcacggcgguaaucugguucgguguccccuuucuagaaacuccacacacgaaauguacugggucucaggggcaagcggaaauauugugucgucugugaacaccacaaguaaaaugcugcuaaaucgcuucacgacaaggcaucgaaagccuaccuaugagaaagaugucgaccucggcgcuggcacucgguccguuagcaccgaaacagagaagccagauaugacgaucauugggagaaggcugcagcgcuugcaggaggaacacaaggagaccuggcauuacgaccaagaaaaccccuaccguacuugggccuaucacggaucauacgaggccccguccacagguucugcgagcaguauggugaauggcguagugaaacugcucaccaagccuugggaugucaucccaauggugacucagcuugcuaugacagacaccacacccuuugggcagcagcggguuuucaaagaaaagguggacacuagaaccccucaaccaaaacccggaacgaggauggucaugaccacaacugcaaacuggcugugggccuuacugggcaagaagaaaaauccgcgcuugugcacccgagaggaguuuauauccaaggugcggagcaacgcugccauuggugcaguauuccaggaggaacagggguggacaucugccucagaagcuguuaaugauaguagauuuugggagcucguggacaaagaaagggcgcugcaccaagagggaaagugugaguccugcgucuauaacaugaugggcaaacgcgaaaagaagcuaggcgaguucgggagagccaaaggaagccgggcaaucugguacauguggcuuggugcuagguuucuggaguucgaggcccucggcuuccugaacgaagaucauugguuugggcgugaaaauucuuggucgggaguggagggcgaagguuugcaccgacugggguauauccucgaggaaauugacaagaaagauggagaccuuauguacgcagaugacacugccggcugggauacccgcauaacggaggacgaucugcagaacgaggaauuaaucacagagcagauggcuccucaucacaagauucuggccaaagcgaucuucaaguugaccuaucagaauaagguggucaaaguucucagacccacuccacggggcgcagugauggacauuaucucaaggaaggaucaacgcgggagcggacagguagguacauacggccugaacaccuuuacuaauauggaagugcagcuaauaagacagauggaggccgaaggggucaucacccaagacgacaugcagaacccuaaaggacuuaaggagcggguggagaaauggcugagggaaugcggcguugaucgacucaagcguauggcuauuuccggugacgauuguguggucaaaccccuggacgagagauucgggacaaguuuguuauuucugaaugauaugggaaaggugcgcaaggacaucccacagugggaacccucuaaaggcuggaagaacuggcaggagguaccuuucugcagccaucacuuucacaaaauuuucaugaaggauggccggucccucguugugccauguaggaaucaagacgaacuuaucgggagagcccgcauaucacagggagcagguuggagucugcgggagacggcuugccuaggcaaagccuacgcucagauguggucucugauguauuuucauaggcgagaucucagauuggccagcauggcaauuuguuccgcggucccgaccgagugguuccccacuucacggacaaccuggagcauccacgcccaucaccaguggaugacuacagaagacaugcugaagguguggaacaggguuuggaucgaggauaauccuaacaugauugacaagaccccagugcacucuugggaagacauacccuaccuugggaaacgcgaggaucuguggugcggaucccucaucggcuuaaguagccgugcuacgugggccaagaauauucauacagcaaucacccaagucagaaaccugauugguaaagaagaguauguggacuacaugccuguaaugaagcgauauucggcuccauccgagucugaagggguguuguga

SEQ ID NO: 15720 - RNA, 9867 nt, Artificial Sequence
  derived and/or modified CDS sequence (opt3) from DENV-4__FJ882601__SS-prME
agcaccaucacucugcucugccuuauucccacugugauggccuuccaccuguccacgagagacggagagccuuugaugauagucgcuaagcaugaaagggggcggccguuacuguuuaaaaccaccgagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucaggauucucaucgguuuucugguacuuuggauugggacuaauuccagaaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccaaagagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaaguggcugccggacagggcacuuccgaaacauuuucuaugggucuccugugccuuaccuuguucgucgaggaaugucugcggagaaggguaacucgaaagcacaugaucuuagcagugguuauaacacucugcgcgauuauccuagggggacuuaccuggauggaucuguugcgcgcccucauuaugcugggcgacacgaugagcggccggaucgggggacagacucaucuagcuauaauggccguguuuaaaaugucaccggguuacguccugggcguguuccucagaaagcugaccaguagggagacagcacuuaugguaaucgggauggcuaugaccacuacauuguccauuccucacgaccugauggaguuaaucgauggaauuucucucggccugauccuucugaaaauagugacccaguuugacaauacacaagucgguacucuagcccucagccugaccuucauucguuccacgaugucauugguuauggcauggcgcacaaucauggccgugcuguuuguggucaccuuaaucccacucugucggacuagcugccugcagaagcagagucauuggguggaaauuaccgcucuuauccugggggcgcaagccuugcccguuuaucucaugacacugaugaaaggagcaucuagaagguccuggccucuaaacgagggcauuauggcuguaggccuggugagccuucucgggucggcccuguugaagaaugaugucccccuggccggaccaaugguggcugguggcuuacuccuggcagccuacguuaugucagggucuagugcggaccuuucccuggaaaaggcugccaacgugcagugggaugagauggcagacauaacuggaagcucuccuaucauugaagucaaacaggaugaggacggcagcuucuccauccgagauguggaggaaaccaauaugauuacguugcucguaaagcuggcccuaaucacagucucaggucuguacccccuugcuauaccagugaccaugacucucugguauauguggcagguuaaaacacaacggaguggggcacugugggacgugccgagcccugccgcgacccagaaggcugccuugucugagggagucuaccgcaucaugcagagaggcuuauuuggcaaaacucagguggggguuggcauucacauggaagguguguuccacacaauguggcaugucaccaggggcuccgugaucugucacgagacggggcggcuggaacccucaugggcagauguacgaaacgacaugauuaguuauggaggcgguuggagacucggggauaagugggacaaggaggaggacgugcaaguucuggccaucgaaccaggcaagaaucccaagcauguccagacuaaaccuggccuuuucaagacccugacaggcgagauaggggcugugaccuuggauuuuaaaccaggaacaagcgguucccccauugugaaccgcaagggcaaagucaucgggcuauacggaaauggcguagugacuaagucuggugacuauguuucggccaucacccaggcagaaaggauuggggagccugauuacgagguggacgaagauauauuccguaagaaacggcugacgaucauggaccuccacccgggagcuggcaagacaaaacggauucugccaagcaucgucagggaggcccuuaagcgccgauuaagaacucugauucucgcgcccacccgggugguugccgcagaaauggaggaggcuuugaggggccugccuauccgcuaucagacaccagccgugaaaucagagcauaccgggcgugagauagucgaucucaugugccacgcuacuuuuaccacaagacugcuuuccaguacgcgggugcccaacuacaaucugaucguaauggacgaagcacacuucacugauccuucuagcguggccgccaggggauacauuuccacccgcguugagaugggugaagcugcggcaaucuuuaugacagccaccccgcccggcgcuacugacccauucccucaaucaaacucucccauugaggauaucgaacgagagauaccagagagaagcuggaauacaggguuugacuggauuaccgacuaucagggaaagacggucugguucgugccuaguaucaaggccggcaacgauaucgcaaauugcuugcggaaauccgguaagaaagugauucagcuaagcaggaagacuuuugacacagaauaccccaaaaccaagcugaccgauugggacuucgucguuacuacagauaucucugagaugggggccaacuuucgcgcuggcagagugauagacccaaggcggugucucaagccgguaauuuuaaccgauggaccugaacgugugauccuggcgggccccauuccagucacacccgccucagcagcucaacgccgagggagaaucggaaggaacccugcccaggaggacgaucaguauguguucuccggugacccacuuaaaaaugaugaagaccaugcacacuggacugaggccaagaugcugcucgauaacauauacacgcccgagggcauuaucccuaccuuguucgggccggaacgggagaaaacacaggcuaucgacggagaauuucgccugagaggcgagcaaaggaagacuuucguugagcucaugcggcgaggugaccugccaguguggcuuaguuauaaagucgccagcgcggggauuucguacaaggauagagaauggugcuuuaccggcgagcgcaauaaccagauccuagaagagaauauggaaguagagauuuggacaagggagggagaaaagaaaaagcugcggccccguugguuggacgcaagaguguaugccgauccuauggcuuuaaaagacuucaaggaguuugccucuggcaggaaauccauaacccuggauauccucacugaaauugcuagccugcccacguaccuuucaagucgcgcaaagcuggcccucgacaacaucguuauguugcauaccacagagagagggggacgagcuuaccagcacgcccugaaugaacuaccagagucucuggagacucucaugcuuguggcacuguuaggugcgaugaccgccggcaucuucuuguuuuucaugcaggggaagggaauuggcaaacuguccaugggucucauaacaaucgcugucgccagcgggcugcuuuggguggcagaaauucaaccucaguggaucgcugccucaauuauccuggaguuuuuccucauggucuugcugauacccgaaccagagaagcagagaaccccucaggauaaccaauuaaucuaugugauucuagcaauccugacuauuaucggccucauagccgcuaaugaaaugggacuuauugagaaaacaaagacggacuuuggcuucuaccaggagaaaaccgaaacuacaauccuggauguugacuugaggccggcgagugccuggacccuguaugcaguggcuaccacaauucucacucccaugcugcgccacacgaucgagaacaccagcgccaaucuuucccucacagccauagcaaaccaggcugccguacugaugggguugggaaagggcuggccacugcaucggauggauuuaggugugccucuacuggcgaugggguguuacucucaggucaaucccacuacccucacagcuagccuuguuaugcuguuggugcacuaugccaucauuggaccaggccugcaagcaaaagccaccagagaagcucucaagcguacugcagccgguaucaugaagaacccuacggucgacggcauuacagugaucgaucuggagcccauauccuacgacccgaaauuugagaagcagcuugggcagguaauguuacuggugcucugcgcgggacaauugcugcuaaugaggaccacuugggcuuucugugaaguucugacccucgccacaggcccaauucuuacucugugggaggggaauccuggacgguucuggaacaccacaaucgcagugucaacggccaacaucuuucgcggcucuuauuuggcuggugccgggcuggcauucagucucauuaaaaauguccagacaccccgaagaggaacuggcacaaccggugaaacucugggcgagaaguggaaaaggcaguuaaacucgcuugaccggaaggaauuugaggaguacaagcgcagcgggauccuggaaguggauagaacagaggcuaaauccgcccucaaggacggaucuaaaauaaagcaugcggucucaaggggcagcuccaaaauucgauggaucguggaacgggggaugguuaagccaaagggaaaaguaguggaucuaggcugcggucgugggggauggaguuacuauauggccacccugaagaaugucacggaggugaaaggcuacaccaagggcgggcccggacacgaggaaccuauuccgauggcaacauaugguuggaacuugguuaaacugcauucuggcguggacgucuucuacaagcccacugaacagguggauacccuccuuugugacaucggggaaagcucauccaauccaacaauagaggaaggaagaacucugcgcguauugaagaugguggagccuuggcugaguagcaaacccgaauuuugcaucaagguucucaacccuuauaugccaaccgucauugaggaguuagaaaaacugcaaaggaagcacggcgguaaucuugugcgguguccccugucuagaaacuccacacacgagauguacugggugucaggggcuagcggaaauaucgucucgucuguuaacaccacaaguaaaaugcuacucaaucgcuucacgacaaggcaucgaaagccuaccuaugaaaaagauguggaccugggcgccggcacucgguccguaagcaccgagacagagaagccagauaugacgauuaucgggagaagguugcagcgccugcaggaggaacacaaggaaaccuggcauuacgaccaggagaaccccuaccguacuugggcauaucacggaucauacgaagcuccguccacagguucugccagcaguauggugaauggcgucgugaaacuccuuaccaagccuugggauguuauuccaauggugacucaacuggccaugacagacaccacacccuuugggcagcagcgggucuucaaagagaagguggacacuagaaccccucagccaaaacccggaacgaggaugguaaugaccacaacugcgaacugguuaugggcucuguugggcaagaagaaaaauccgcgccucugcacccgagaggaauuuaucuccaagguucggagcaacgcagccauaggugcuguguuccaagaggaacagggguggacaucugccucagaggcagucaaugauaguagauuuugggaacugguggacaaagagagggcccuacaccaggagggaaagugugaauccugcguguauaacaugaugggcaaacgcgagaagaaacuuggcgaguucgggagagcuaaaggaagccgggcgauuugguacauguggcugggugccagguuucucgaguucgaagcacugggcuucuugaacgaggaucauugguuugggcgugaaaauucuuggucgggagucgaaggcgagggucugcaccgacucggguauauccuugaagagaucgacaagaaagauggagaccugauguacgcugaugacacugccggcugggauacccgcauuacggaggacgauuuacaaaacgaggaacugguuacagaacagauggcaccucaucacaagauauuggccaaagcuaucuucaagcucaccuaucagaauaaggugguaaaagugcugagacccacuccacggggcgccgucauggacauuaucucaaggaaggaucagcgcgggagcggacaaguggguacauacggccuaaacaccuuuacuaauauggagguucagcuuauuagacagauggaagcggagggggugaucacccaggacgacaugcaaaacccuaaaggacugaaggagcgggucgaaaaauggcucagggagugcggcguggaucgacugaagcguauggcaauauccggugacgauuguguaguuaaacccuuggacgaaagauucgggacaaguuuacuguuucucaaugauaugggaaaggugcgcaaggacaucccacagugggagcccucuaaaggcuggaagaacuggcaggaagucccuuucugcagccaucacuuucacaaaauuuucaugaaggauggccggucccuugugguuccauguaggaaucaggacgagcugaucgggagagcccgcauuucacaaggagcugguuggagucuacgggagacggccugccugggcaaagcauacgcucagauguggucucucauguauuuucauaggcgagauuugagacuggccagcauggcuaucuguuccgccgugccgaccgaaugguuccccacuucacggacaaccuggagcauacacgcacaucaccaguggaugacuacagaggacaugcuuaaggucuggaacaggguguggauugaagauaauccuaacaugaucgacaagaccccaguacacucuugggaggacauccccuaccuggggaaacgcgaagaucucuggugcggauccuuaauuggccugaguagccgugcgacgugggccaagaauauacauacagcuaucacccaggugagaaacuugauugguaaagaggaguaugucgacuacaugccuguuaugaagcgauauucggccccauccgaaucugagggggugcuguga

SEQ ID NO: 15721 - RNA, 9867 nt, Artificial Sequence
  derived and/or modified CDS sequence (opt3) from DENV-4__FJ226067__SS-prME
agcaccaucacccugcucugccuuauucccacugugauggccuuccaccuguccacgagagacggcgagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacaugggugauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggcgggggaguagcauuggaaaaauguucgaguccacuuaccgcggcgcaaagagaauggccaucuuaggugaaaccgcuugggauuuugggucugugggcggacuguucacgagccuaggcaaagccguccaccagguuuuugggucaguguauaccacaauguucggaggcgugaguuggaugaucaggauucucaucgguuuucugguacuuuggauugggacuaauucccguaacaccagcauggcaaugacaugcauaacugucggaggcaucaccuuguuccuggguuuuacggugcaggccgacaugggcuguguugugucuuggucagggcgggagcucaagugcggaaguggcauuuucgucguggauaauguucauacauggaccgaacaauacaaguuucagcccgagagcccagcucgacuggccuccgcaauccuuaacgcgcacaaagacgggguguguggaaucagaucuacuacaaggcuggagaauguaauguggaagcagauuaccaacgaauugaauuaugcucucugggagggcggucacgaccugacugucguggccggggaugugaaaggagucuuaaccaagggcaaacgcgcacugacaccucccguuucggaccuaaaguacagcuggaagacgugggguaaagccaagauauucaccccagaagcucggaacuccacuuuucucaucgauggccccgacacaucagagugcccuaaugaaagaagggccuggaacagucuggagguggaggauuacggguucggaauguucaccacaaauauuuggaugaaauuucgcgaaggcucuagcgagguaugugaccaucgacuuauguccgcagcuaucaaggaucagaaagccgugcacgcggacaugggguauuggauugaaucaagcaagaaccaaacuuggcagaucgagaaagccucuuugauagaagucaagaccugccuguggccaaagacgcauacacucugguccaauggagugcuggagagucagauguuaaucccgaaaagcuacgcuggccccuucucucagcacaacuaucggcaagguuacgcaacccagacuguugggccuuggcaccugggaaaacuugagauugauuuuggcgaaugcccagguaccacagugacuauccaggaggacugugaucaucguggccccuccuugagaaccacaacggccucagggaaacucgucacccaguggugcuguaggaguugcacuaugccuccacugcgcuuccuaggagaagacggcuguugguaugggauggagauucggccccugagcgagaaggaagagaacauggugaaaucgcaaguuacagcuggacagggcaccuccgaaacuuuuucuaugggucuccugugccuuacauuguucguggaggaaugucugagaaggcgagucacccgcaagcacaugaucuuaguagugguuauaacgcucugcgccauuauccuagggggacuuacuuggauggaucuguugcgggcacucauuaugcugggcgacaccaugagcggcagaaucgggggacagauacaucuagcgaucauggccguguuuaagaugucaccggguuacguccugggcguguuccucaggaaacugacaagucgugagaccgcucuuaugguaauugggauggccaugacuacaguguuguccaucccucacgaccugauggaguuaauugauggaaucucucucggccugauacuucugaagauugucacccaguuugacaauacacaaguugguacucuagcacucagccugaccuucauccgcuccacgaugccauuggugauggcuuggcggacaaucauggccgugcuguuugucgugaccuuaauuccccucuguagaacuucaugccugcagaaacagagccauuggguugaaaucaccgcacuuauucugggggcccaggcuuugccuguauaucucaugacacugaugaagggagcgaguaggcgaucuuggccccuaaacgagggcauaauggccgugggccuggucucccuucucgggagcgcacuguugaaaaaugaugugccacuggcuggaccuaugguugccgguggcuuacuccuggccgcuuacgugaugucggggucaucugcagaccuuagucuggaaaaggccgcgaacguccagugggaugagauggcugacaucacuggauccagccccauuaucgaagugaagcaggaugaggacggcucuuucagcauucgggauguagaggaaaccaauaugaucacguugcucgucaaacuggcccuaauaacaguguccggucuguacccacuugcaaucccgguuaccaugacucucugguauauguggcaagugaagacacaacgcucaggggcccugugggacgucccuagucccgcugcaacccagaaagccgcguugagcgagggaguguacagaauuaugcagaggggcuuauuuggcaagacucagguuggggugggaauccacauggaaggugucuuccacacaauguggcaugugacccggggcucuguaauuugucacgagacggggcgacuggaaccauccugggcugaugugagaaacgacaugaucucauauggaggcgguuggcgccucggggauaaaugggacaaggaggaggacguucaaguccuggccauagaacccggaaagaauccuaaacaugugcagacuaagccaggccuuuucaaaacccugacaggcgagauuggggcagugaccuuggauuuuaagcccggaacaagugguagcccuaucaucaacaggaaaggcaaggucauugggcuauacggaaauggcguagugacuaaauccggugacuauguuucugccauaacccaggcugaacguaucggggagccggauuacgagguggacgaagauauuuuccggaagaagagacugacgaucauggaccuccacccaggagccggcaaaacaaagaggauucugcccucgaucguccgcgaggcacuuaaacgaagauuacggacucugauacucgcuccuaccagggugguugccgcggaaauggaggaagccuugcgcggccugccaauccguuaucagacacccgcaguaaagagcgagcauaccgggagagagauugucgaucucaugugccacgcuacuuuuaccacacggcugcuuucauccacgagggugccuaacuacaaucugaucguaauggacgaagcccacuucacugauccgaguucuguggcugcacgcggauacauuagcacccgaguugagaugggugaagccgccgcuaucuuuaugacagcgacacccccaggcgcaacugacccuuucccccaauccaacucaccaauagaggauauugaaagagagaucccugagcggucuuggaauacaggguuugacuggaucaccgacuaucagggaaaaacggucugguucgugcccagcauuaaggccggcaacgauaucgcuaauugcuugaggaagagugguaaaaaggugauacagcuaucccgcaaaacuuuugacacagaauacccaaagaccaaacugaccgauugggacuucgucguuacuacagauauuagcgagaugggggccaacuuuagagcaggcagggugaucgacccgcggcguugucucaagccuguaauuuuaaccgauggacccgaacgcgugauccuggccggcccaauacccgucacuccugcuucugcggcccaacgaagagggaggauuggacggaacccagcacaggaggacgaucaguauguguucucaggugacccccuuaagaaugaugaagaccaugcucacuggacagaggccaaaaugcugcucgauaacaucuacacgccugagggcaucauuccgaccuuguucgggccagaacgcgagaagacacaggcaaucgacggagaauuuagacugaggggcgagcaacggaaaacuuucguugagcucaugcgaagaggugaccugcccguguggcuuuccuauaaggucgccagugcugggauuagcuacaaagaucgcgaauggugcuuuaccggcgagaggaauaaccagauacuagaagagaauauggaaguagagaucuggacacgggagggagaaaagaagaaacugcguccuagaugguuggacgccaggguguaugcggaucccauggcauuaaaggacuucaaagaguuugccucgggccgcaagucuauuacccuggauauccucacugaaaucgcuucccugccaacguaccuuagcucacgggccaaacuggcucucgacaacauuguuauguugcauaccacagagcgagggggcagagcauaccagcacgcccugaaugaacuaccugagagucuggagacucucaugcuuguggcucuguuaggugccaugaccgcaggcauauucuuguuuuucaugcaggggaagggaaucggcaagcugucuaugggucucauugcgaucgccgucgcuuccgggcugcuuuggguggccgaaauucaaccccaguggaucgcagcuagcauaauccuggaguuuuuccucauggucuugcugauuccagaaccugagaaacagaggacaccgcaggauaaccaauuaaucuaugugauucuaaccauccugacuauaauuggccucaucgccgcaaaugaaaugggacuuauugagaagacaaaaacggacuuuggcuucuaccagguuaagaccgagacuacaauccuggauguggacuugcgccccgccucagcuuggacccuguaugcgguagccaccacaauacucacuccaaugcugcggcacacgaucgaaaacaccagugcaaaucuuagccucgcugccauugccaaccaggcagcugugcugaugggguugggaaaaggcuggccucugcauagaauggauuuaggugucccccuacuggccaugggguguuacucccagguuaauccaacaacucucaccgcgucucuugugaugcuguugguccacuaugcuaucauuggaccuggccugcaagccaaggcaacacgugaggcccagaaaaggaccgcugcagguaucaugaagaaccccacuguggacggcauaacgguaauugaucucgaaccgaucagcuacgacccaaaguuugagaaacagcuggggcaagugaugcuuuuaguucugugcgccggacagcucuugcugaugcggacaaccugggcguucugugaggugcuaacucuggcuaccggcccuauccucacacuuugggaagggaaucccggacgcuucuggaacacuaccauugccgucuccacagcaaacaucuuucgaggcucauaucuggccggugcuggguuggccuucucucugauaaagaaugcacagacgccaagaaggggaaccggcacuacaggugagacccucggcgaaaaauggaagcggcagcugaacaguuuagaccgcaaagaguuugaagaguacaagagaucggggauucuugagguggauaggacugaagcuaagagcgcccugaaagacggauccaagaucaaacaugcggucucucgaggcucaagcaagauucgguggaucguggagcgugggaugguuaaacccaagggaaagguaguggaucucggcugcgguagagggggaugguccuacuauauggccacacucaagaaugucaccgaagugaagggcuacacgaaaggcgggccuggacacgaggaaccgauacccauggcaaccuaugguuggaaccugguuaaguugcauaguggcguggacgucuucuacaaaccaacagagcaaguggauacucugcucugugacaucggggagucuagcucaaauccuaccauugaagagggacgcacacuuaggguacugaagaugguggaacccugguuguccaguaagccugaguuuugcaucaaaguucugaacccauauaugcccacugucauugaagaacuagagaaguuacagcggaaacacggcgguaaucuggugagauguccucuuagccgcaacucuacccacgaaauguacuggguguccggggcuucaggaaauaucgucagcucgguuaacacaaccucuaagaugcugcuaaauagguucacuacgcgacaucggaaaccaacauaugagaaggauguggaccucggcgccggcaccagaaguguauccacugaaaccgagaaacccgauaugacaauuaucgggaggcgccugcagcguuugcaggaggaacacaaggagacguggcauuacgaccaagaaaacccguaccggaccugggcauaucacggaagcuacgaggcuccuucaacugguuccgccucuagcauggugaauggcgucgugaagcugcucacaaaaccaugggauguuauacccauggugacccagcuugccaugacugacacaaccccuuuugggcagcagagagucuucaaggaaaaaguggacacaaggacuccacaacccaagccgggaacccgcaugguaaugacgaccacagcgaacuggcugugggcuuuacugggcaaaaagaagaauccucgauugugcacucgggaggaguuuauuaguaaaguuagauccaacgcagccaucggugcuguguuccaggaagaacagggguggaccagcgccucugaagcagucaaugauucaagguuuugggagcucguggacaaggaacgcgcccugcaccaagagggaaaaugugagaguugcguguauaacaugaugggcaagagagagaaaaagcuaggcgaguucgggcgggcuaagggauccagggcgaucugguacauguggcuuggugcccguuuucuggaguucgaggcacucggcuuccugaacgaagaucauugguuugggcgagagaauagcuggucuggagucgagggcgaagguuugcaccgccugggguauauucucgaggaaauagacaaaaaggauggagaccuuauguacgcugaugacacagccggcugggauacuagaaucaccgaggacgaucugcagaacgaggaauuaauuacggagcagauggcaccccaucacaaaauccuggccaaggcuauuuucaaauugacauaucagaauaagguugugaagguacuccggccaaccccuaggggcgccgugauggacaucauaucgcgcaaagaucaaagagggucaggacaggucgguacuuacggccugaacacauuuaccaauauggaagugcagcuaauccggcagauggaggcggaagggguuauuacucaagacgacaugcagaaccccaagggacuuaaagagaggguggagaaguggcugcgagaaugcggcgucgaucgucucaaaagaauggcaaucagcggugacgauugugugguaaagccacuggacgagcgcuucgggaccuccuuguuauuucugaaugauaugggaaaaguucggaaggacauuccccagugggaaccuaguaagggcuggaaaaacuggcaggaggugccauucugcucucaucacuuucacaagaucuucaugaaagauggcaggagccucgucgugccguguagaaaucaagacgaacuuauagggcgcgcccggauuucccagggagcugguuggucacugagggagacagccugccuaggcaaggcauacgcucagauguggagucugauguauuuucaucgaagagaucuccgguuggccucuauggcuaucuguagcgccguucccacggagugguucccuaccuccaggacuacauggucaauccacgcacaucaccaguggaugaccacugaagacaugcugaaaguguggaaccgcgucuggauugaggauaauccaaacaugacagacaagacccccgugcacagcugggaagacauaccuuaccuugggaagcgugaggaucuguggugcggaucucucaucggcuuauccaguagagcgacgugggccaaaaauauucauacagcuaucacccaaguacgaaaccugauugguaaggaagaguauguggacuacaugccagucaugaaaagguauagcgccuugucggaguccgaagggguucuguga

SEQ ID NO: 15722 - RNA, 9867 nt, Artificial Sequence
  derived and/or modified CDS sequence (opt3) from DENV-4__EU854299__SS-prME
agcaccauaacacugcucugccuuauucccacugugauggccuuccaccuguccacgcgggacggcgaaccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaaacuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgagcccugccgcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuaugucuccgccauaacacaggcagaacguaucggggagccugacuacgagguagaugaagacauuuuucggaagaagagacugacuaucauggaucuccacccgggagcuggcaaaaccaagaggauucugccaucuaucgugcgcgaggcccuuaaacgaagauuacggacacugauacucgcgcccaccaggguuguggccgcagaaauggaggaggcuuugcgcggccugccuauccguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaaaucagguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaguucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagagagggggccgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccaucauuggaccaggccugcaagcaaaagccacgagagaggcucagaagcguacagcagccgguaucaugaagaauccuaccguugauggcauaacugugauugaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauccucacacuuugggaagggaacccuggacgguuuuggaacacgaccauugcagugagcacugccaauaucuuccgcggcuccuaucuggcuggugccggguuggcauuuucacugaucaagaacgcucagacaccccgaagaggaaccggcacuacaggugagacccucggcgaaaaguggaaaaggcagcuaaauucuuuagaccggaaggaguucgaagaguacaagcgcagugggauucuugagguugacagaacggaagccaaaucggcgcugaaggauggaagcaaaaucaagcaugccguguccaggggaucuucaaaaauucgauggaucgucgagcgggggauggugaagccaaagggaaaagucguggaccucggcugcggucgugggggauggagcuacuauauggcaacccuaaagaacguuacagaaguaaaaggcuacacuaagggcgggcccggacacgaggaaccuauaccgauggcuaccuaugguuggaaucuggugaaauugcauuccggcgucgauguguuuuacaagcccacagagcaaguugacacucugcucugugauaucggggagaguucuagcaacccaaccauugaagagggaagaacacuucgcgugcugaagauggucgaaccuugguugucauccaaacccgaguucugcaucaaggugcugaauccuuauaugccaaccguaauugaagaacucgagaaauuacagaggaagcacggcgguaaccuggugcgguguccccuuaguagaaauagcacucacgaaauguacuggguuucuggggccuccggaaacaucgucucaagcgugaauacgacaucgaaaaugcugcuaaaccgcuuuaccacuaggcaucgaaagccuaccuaugagaaagacguggaucucggcgcaggcacacggucugucaguacggaaaccgagaagccagacaugacuauuaucgggagaaggcugcagcgcuugcaggaggaacacaaggagacauggcauuacgaucaagaaaaucccuaccguaccugggcuuaucacggauccuacgaggccccgagcacugguucagccuccucuaugguuaacggcgugguaaaacugcucacaaagccuugggacgugauaccaauggucacccagcuugcgaugacagauacuacccccuucgggcagcagcggguguuuaaagaaaagguugacacgagaaccccucaaccaaaacccggaacaaggauggugaugacuaccacagcuaauuggcugugggcauuacugggcaagaagaaaaacccgcgcuugugcacucgagaggaguucauuagcaagguccggaguaaugccgcuaucggugccguguuucaggaagaacagggguggaccuccgcaagcgaagccguaaacgacucuagauucugggagcucguugauaaagaaagggcucugcaccaagagggaaagugugagucaugcguguauaacaugaugggcaaacgcgaaaagaagcuaggcgaguuugggagagcgaaaggaagucgggccaucugguacauguggcuuggugcaagguuccuggaguucgaggcucucggcuuucugaaugaagaccauugguucgggcgugagaacuccuggagcggagucgagggcgaagguuugcaccgacugggguauauucucgaggaaauagauaagaaagacggagaucuuauguacgccgacgauacggcaggcugggacacacgcaucaccgaggaugaccugcagaaugaggaauuaauuacugagcagauggccccucaucacaagauccuggcuaaagccauuuuuaaguugacauaucagaacaagguggugaaaguccucagacccaccccacggggcgcgguuauggauaucauaucuaggaaggaccaacgcgggucgggacagguggguacuuacggccugaauaccuucacaaacauggaaguacagcuaaucagacagauggaggcagaaggggugauuacgcaagaugacaugcagaauccuaaaggacuuaaggagcgggucgagaaauggcugagggaaugcggcguggaccgacucaagcguauggccaucucaggugaugacuguguugugaaaccccuggaugagagauuugggaccagcuuguuauuccugaacgacaugggaaagguccgcaaggauauuccacagugggaacccuccaaaggcuggaagaauuggcaggaggugccuuuuugcagucaucacuuccacaaaaucuuuaugaaggacggccggucucucguaguuccauguaggaaccaagaugaacuuauagggagagcucgcauuagccagggagccgguuggucccugcgggagacugcaugccuaggcaaggcuuacgcccagauguggucacugauguauuuccauaggcgagaccucagauuggcuaguauggccaucuguucugcagugccgacagagugguuucccaccagccggacuacaugguccauccacgcgcaucaccaguggaugaccacggaagauaugcugaaggucuggaauaggguguggauugaggacaacccuaauaugauagauaagacaccaguucacucaugggaagacauccccuaccuugggaaacgcgaggaccuguggugcggaagccucauuggcuuaucuucccgugccaccugggcuaagaacauccauacugccauuacccaagugagaaaucugaucgguaaagaagaguaugucgauuacaugccugugaugaagcgauauagugcaccaagcgagucggaagggguauuguga

SEQ ID NO: 15723 - RNA, 9867 nt, Artificial Sequence
  derived and/or modified CDS sequence (opt3) from DENV-4__FJ182016__SS-prME
agcaccauaacacugcucugccuuauucccacugugauggccuuccaccuguccacgcgggacggcgaaccuuugaugauagucgcuaagcaugaaagggggcggccauuacuguuuaaaaccacagaaggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaaacuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgagcccugccgcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuaugucuccgccauaacacaggcagaacguaucggggagccugacuacgagguagaugaagacauuuuucggaagaagagacugacuaucauggaucuccacccgggagcuggcaaaaccaagaggauucugccaucuaucgugcgcgaggcccuuaaacgaagauuacggacacugauacucgcgcccaccaggguuguggccgcagaaauggaggaggcuuugcgcggccugccuauccguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaaaucagguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaguucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagagagggggccgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccaucauuggaccaggccugcaagcaaaagccacgagagaggcucagaagcguacagcagccgguaucaugaagaauccuaccguugauggcauaacugugauugaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauccucacacuuugggaagggaacccuggacgguuuuggaacacgaccauugcagugagcacugccaauaucuuccgcggcuccuaucuggcuggugccggguuggcauuuucacugaucaagaacgcucagacaccccgaagaggaaccggcacuacaggugagacccucggcgaaaaguggaaaaggcagcuaaauucuuuagaccggaaggaguucgaagaguacaagcgcagugggauucuugagguugacagaacggaagccaaaucggcgcugaaggauggaagcaaaaucaagcaugccguguccaggggaucuucaaaaauucgauggaucgucgagcgggggauggugaagccaaagggaaaagucguggaccucggcugcggucgugggggauggagcuacuauauggcaacccuaaagaacguuacagaaguaagaggcuacacuaaaggcgggcccggacacgaggaaccuauaccgauggcuaccuaugguuggaaucuggugaaguugcauuccggcgucgauguguuuuacaaacccacagagcaaguugacacucugcucugugauaucggggagaguucuagcaacccaaccauugaagagggacgcacacuuagggugcugaagauggucgaaccuugguugucauccaagcccgaguucugcaucaaagugcugaauccuuauaugccaaccguaauugaagaacucgagaaguuacagcggaaacacggcgguaaccuggugagauguccccuuagucgcaauagcacucacgaaauguacuggguuucuggggccuccggaaacaucgucucaagcgugaauacgacaucgaagaugcugcuaaacagguuuaccacucgacaucggaaaccuaccuaugagaaggacguggaucucggcgcaggcacaagaucugucaguacggaaaccgagaaaccagacaugacuauuaucgggaggcgccugcagcguuugcaggaggaacacaaggagacauggcauuacgaucaagaaaaucccuaccggaccugggcuuaucacggauccuacgaggccccgagcacugguucagccuccucuaugguuaacggcgugguaaagcugcucacaaaaccuugggacgugauaccaauggucacccagcuugcgaugacagauacuacccccuucgggcagcagagaguguuuaaggaaaaaguugacacgaggaccccucaaccaaagcccggaacacgcauggugaugacuaccacagcuaauuggcugugggcauuacugggcaaaaagaagaacccgcgauugugcacucgggaggaguucauuagcaaagucagaaguaaugccgcuaucggugccguguuucaggaagaacagggguggaccuccgcaagcgaagccguaaacgacucuagguucugggagcucguugauaaggaacgcgcucugcaccaagagggaaaaugugagucaugcguguauaacaugaugggcaagagagagaaaaagcuaggcgaguuugggcgggcgaagggaaguagggccaucugguacauguggcuuggugcacguuuccuggaguucgaggcucucggcuuucugaaugaagaccauugguucgggcgagagaacuccuggagcggagucgagggcgaagguuugcaccgccugggguauauucucgaggaaauagauaaaaaggacggagaucuuauguacgccgacgauacggcaggcugggacacaagaaucaccgaggaugaccugcagaaugaggaauuaauuacugagcagauggccccucaucacaaaauccuggcuaaggccauuuuuaaauugacauaucagaacaagguggugaagguccuccggcccaccccaaggggcgcgguuauggauaucauaucucgcaaagaccaaagagggucgggacagguggguacuuacggccugaauaccuucacaaacauggaaguacagcuaauccggcagauggaggcagaaggggugauuacgcaagaugacaugcagaauccuaagggacuuaaagagagggucgagaaguggcugcgagaaugcggcguggaccgucucaaaagaauggccaucucaggugaugacuguguugugaagccccuggaugagcgcuuugggaccagcuuguuauuccugaacgacaugggaaaaguccggaaggauauuccacagugggaacccuccaagggcuggaaaaauuggcaggaggugccuuuuugcagucaucacuuccacaggaucuuuaugaaggacggcagaucucucguaguuccaugucgcaaccaagaugaacuuauagggcgggcuaggauuagccagggagccgguuggucccugcgagagacugcaugccuaggcaaggcuuacgcccagauguggucacugauguauuuccauagacgggaccucagguuggcuaguauggccaucuguucugcagugccgacagagugguuucccaccagccgcacuacaugguccauccacgcgcaucaccaguggaugaccacggaagauaugcugaaggucuggaaucguguguggauugaggacaacccuaauaugauagauaaaacaccaguucacucaugggaagacauccccuaccuugggaagagagaggaccuguggugcggaagccucauuggcuuaucuucccgagccaccugggcuaagaacauccauacugccauuacccaagugaggaaucugaucgguaaagaagaguaugucgauuacaugccugugaugaagcgguauagugcaccaagcgagucggaagggguauuguga

SEQ ID NO: 15724 - RNA, 9867 nt, Artificial Sequence
  derived and/or modified CDS sequence (opt3) from DENV-4__EU854300__SS-prME
agcaccaucacucugcucugccuuauucccacugugauggccuuccaccuguccacgcgggacggcgaaccuuugaugauagucgcuaagcaugaaagggggcggccauuacuguuuaagaccaccgagggaaucaacaaguguacucugauugcaauggaucucggugaaaugugcgaggacaccguuaccuacaaauguccgcugcuugugaauaccgaacccgaggauaucgacugcugguguaaccugacuucuacguggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggaaugggcgugagcugaagugcggaagcggcauuuucgucguggauaacguucauacauggaccgaacaauacaaauuucagcccgagucuccagcccggcuugcaucagcgauccugaaugcucacaaggacgggguguguggaauccgaaguacuacaagauuggagaacguaauguggaaacagauuaccaaugaacucaacuauguccugugggagggcggucacgacuuaacugugguggccggggaugucaagggaguucugaccaaaggcaagagggcacuaacaccucccgccagcgaccucaaguacuccuggaaaacgugggguaaggcuaaaauauucaccccagaaacucgcaauucuacauuucugaucgauggccccgacaccucggagugcccuaacgaacggagagccuggaauagcuucgagguggaggauuacggguucggaauguuuacaacuaacauuuggaugaaguucagggaaggcuccucagagguaugugaccaucgccuuaugagugcagcuaucaaagaucagaaggccgugcacgcggacaugggguauuggauugaaucuagcaaaaaucaaaccuggcagaucgagcgagccuccuugauagaagucaagacgugccuguggccaaagacacauacccucuggucaaacggagugcuggagagccagauguuaaucccgaaaucuuacgcuggccccuuuucccagcacaacuaucggcaagguuacgcaacucagaccguugggccuuggcaccugggaaaacuugagauugauuucggcgaaugcccagguacaacugugaccauccaggagaauugugaccaucguggccccaguuugagaacaacgaccgccagcgggaaacucgucacucaguggugcuguaggucuugcacaaugccuccacugcgcuuucuaggagaagauggcuguugguaugggauggagauucggccccuguccgagaaggaagagaacauggugaaaucacaaguuaccgcuggacagggcacaagugaaacauucagcaugggucuccugugccuuaccuuguuuguggaggaaugucugagaaggcgagucacgcgcaagcacaugaucuuagccguagugauaacucucugcgcaauuauccuagggggccuuaccuggauggaccuguugcgggcgcucauuaugcugggcgauacaaugucgggcagaaucgggggacagacccaucuagccauaauggcuguuuucaagauguccccggguuacgugcugggcgucuuucucaggaaacugacuucucgugagacagcccuuauggugaucgggauggcaaugaccacaacuuugagcauuccucacgaccugauggaguuaaucgacggaauuucacucggccugauccuucugaagauaguaacccaguucgauaauacgcaaguggguacacuagcucucagucugaccuuuauucgcuccacuaugucuuuggucauggccuggcggaccaucauggcaguucuguucguggugacauuaaucccacucuguagaacuagcugccugcagaaacagucccauugggucgaaauuaccgcccuuauccugggggcucaagcguugcccguguaucucaugacgcugaugaagggagccucaaggcgaagcuggccucuaaacgagggcauuauggcaguuggccugguaagucuucucgggucugcucuguugaaaaaugacgugccccuggccggaccaauggucgccgguggcuuacuccuggcugcauacgugauguccgggagcucggccgaucuuucacuggaaaaggcggcuaacguucagugggacgagauggccgauauaacaggaucuaguccuaucauugaagugaagcaggacgaggauggcuccuuuagcauccgggacgucgaggaaaccaauaugauuacuuugcucgugaaacuggcacuaaucacaguaucuggucuguacccccuugccauaccaaucaccaugacucucugguauauguggcaggucaagacacaacgcagcggggcucugugggaugugccguccccugcagccacccagaaagcggcuuugucagagggaguuuacagaauuaugcagaggggcuuauucggcaagacacaggugggggucggaauccacauugaagguguguuccacacuauguggcauguuacccggggcagugugaucugucacgagacagggcgacuggaacccagcugggccgacgucagaaacgauaugauaucuuauggaggcgguuggcgccucggggacaaaugggauaaggaggaggacgugcaaguacuggcaauugaaccaggaaagaaucccaaacaugugcagaccaagccuggccuuuuuaaaacacugacuggcgagaucggggccguuaccuuggacuucaagccaggaacguccgguucacccaucauuaacaggaaaggcaaggucauagggcuauacggaaauggcguggugacaaaaaguggugauuaugucagcgcuaucacucaggccgaacguauuggggagccugacuacgagguagaugaagacaucuuucggaagaagagacugaccauuauggaucuccacccgggagcaggcaaaacaaagaggauccugccauccauagugcgcgaggcucuuaaacgaagauuacggacccugauccucgcccccacuaggguuguggcggccgaaauggaggaagcauugcgcggccugccuauucguuaucagaccccagcugucaagucugagcauacagggagagagaucguggaccucaugugccacgccacguucacuacccggcugcuuucgagcacaaggguucccaacuacaaucugauugugauggaugaagcucacuuuaccgacccuucauccgucgcagcccgcggauacaucaguacucgaguggagaugggugaagccgcugcgauauucaugacagcaaccccgcccggcgccacggauccauuuccucaaucuaacagccccauugaggacaucgaaagagagaucccagagcgguccuggaauacuggguucgauuggauuacagacuaucagggaaaaaccguaugguuugugccuucaaucaaggcuggcaacgacauagccaacugcuugaggaagucugguaaaaagguuauucagcuaagccgcaaaaccuucgauacugaauaccccaagacaaaacugaccgacugggauuuugucgugacaacugacaucagugagaugggggcaaauuucagagccggcagggugauugauccacggcguugucucaagccggucaucuuaacggacggaccugaacgcguuauacuggcuggccccauuccagugacccccgcguccgccgcacaacgaagagggaggaucggacggaaccuugcucaggaggaugaccaguauguauucagcggugauccucugaagaaugacgaagaucaugcccacuggacagaggcaaaaaugcucuuggacaacaucuacacuccagagggcauuauccccacccuguuugggccugaacgcgagaagacacaggccauugauggagaguucagacucaggggcgagcaacggaaaaccuuuguggagcugaugcgaagaggugaccuuccggucuggcuaucuuauaagguggcuucagccgggauauccuacaaagaccgcgaauggugcuucacuggcgagaggaauaaccagauccuggaagagaauauggaaguugagauuuggacgcgggagggagaaaagaagaaauugcguccaaagugguuagaugcgagaguguaugcagaccccauggcccugaaagauuuuaaggaguucgcuaguggcaggaaaagcaucacccucgacauccugacagaaauugccucgcuuccuacuuaccugucuucccgcgcuaagcucgcauuggauaacauagucaugcugcauaccacagagagagggggacgagccuaccagcacgcucuaaaugaacugcccgagagccucgagacccuuaugcugguagccuuauugggugcaaugacugcgggcaucuuucuguucuuuaugcaggggaagggaauuggcaaacucucaaugggucugaucacaauugccguggcuagugggcuucuguggguugccgaaauccaaccacaguggauagcagcuucuaucauucucgaguucuuuuugauggugcuguuaaucccugaacccgagaagcagagaacgccacaggacaaccaacuaauuuaugucauccugaccauacucacuauuaucggccuuauugccgcaaaugaaaugggacugaucgagaaaacaaaggccgauuucggcuuuuaccaggugaaaaccgagaccacaauauuggacgucgaucugaggccugcuuccgcguggacucucuaugccguggcaacgaccauccugacaccgaugcuucgccacacuauugaaaacaccagcgcuaaucucucacuggccgccaucgcaaaccaggcugccguuuugauggggcugggaaagggcuggcccuuacaucggauggaccuaggugugccacugcucgcgaugggguguuacagucagguaaauccuacaacccuuacugcuagccuggugauguugcugguccacuaugccauuaucggacccggccuccaagcaaaagccacgagagaggcucagaagcguacagcagccgguauaaugaagaacccaaccguugauggcauuacugugaucgaccuggaaccuaucuccuacgaucccaaauucgagaagcagcuugggcaagucauguuacuggugcucugcgcgggacaguugcugcuaaugaggaccacaugggcuuucugugagguacugacucucgccaccggcccgauucuuacacugugggaagggaacccaggacgguuuuggaauacgaccaucgcagugucuacugccaacauauuccgcggcagcuauuuggcuggugccgggcuggcauuuucccucauuaaaaaugcucagacaccucgaagaggaaccggcacuacaggugagacccugggcgaaaaguggaaaaggcaguuaaacucacuugaccggaaggaguucgaagaguacaagcgcucugggauccuggagguugacagaacggaagccaaaagugcgcucaaggauggaucgaaaauuaagcaugccgugagcaggggcuccucuaaaauccgauggauagucgagcgggggauggugaagcccaagggaaaagucguggaccuaggcugcggucgugggggauggucauacuauauggcaacccugaagaauguuacagaaguaaaaggcuacacuaagggcgggccaggacacgaggaacccaucccuauggcuaccuaugguuggaacuuggugaaacugcauagcggcgucgauguguuuuacaagccgacagagcaaguugacacucuccuuugugauauuggggaguccaguucuaaucccaccaucgaagagggaagaacacugcgcguguugaagauggucgaaccauggcugagcucaaaaccugaguucugcauuaaggugcucaaccccuauaugccuaccguaaucgaagaguuagagaaacugcagaggaagcacggcgguaaucuugugcgguguccacuguccagaaacaguacucacgaaauguacuggguuagcggggccucuggaaauauugucuccucagugaacacgacaagcaaaaugcuacucaaucgcuuuaccacuaggcaucgaaagcccaccuaugagaaagacguggaucugggcgcaggcacacggucggucucuacggaaaccgagaagccugacaugacuaucauagggagaagguugcagcgccugcaggaggaacacaaggagacauggcauuacgaucaagaaaacccauaccguaccugggcuuaucacggaaguuacgaggcccccuccacugguagcgccucauccaugguuaauggcgugguaaaacuccuuacaaagccgugggacgugauuccuauggucacccagcuggcgaugacagauacuaccccauucgggcagcagcggguguuuaaagaaaagguugacacgagaacaccccaaccuaaaccaggaacaaggauggugaugacuaccacagcuaacugguuaugggcacuguugggcaagaagaaaaauccccgccucugcacucgagaggaguucaucucuaagguccggagcaacgccgcuaucggugccguguuucaggaagaacagggguggaccagugcauccgaagccguaaacgacagcagauucugggagcugguugauaaagaaagggcucuacaccaagagggaaagugugagucuugcguguauaauaugaugggcaaacgcgaaaagaaacuuggcgaguuugggagagcgaaaggaucacgggccauuugguacauguggcugggugcaagguuccucgaguucgaggcucugggcuuuuugaacgaagaccauugguucgggcgugagaauaguugguccggagucgagggcgaaggucugcaccgacucggguauauacuugaggaaaucgauaagaaagacggagaucugauguacgccgacgauacggcaggcugggacacacgcauuaccgaggaugacuuacagaacgaggaacugaucacugagcagauggccccgcaucacaagauuuuggcuaaagccaucuuuaagcucacauaucagaauaagguggugaaaguccugagaccuacaccccggggcgcgguuauggauauaaucagcaggaaggaccaacgcgggucuggacagguggguacuuacggccuaaacaccuucacaaauauggaaguacagcuuauuagacagauggaggcagaaggggugaucacgcaagaugacaugcagaacccaaaaggacugaaggagcgggucgagaaauggcucagggaaugcggcguggaccgacugaagcguauggccauuucgggugaugacuguguugugaaaccuuuggaugagagauuugggaccucauuacuguuccucaaugacaugggaaagguccgcaaggauaucccccagugggaaccaagcaaaggcuggaagaacuggcaggaggugcccuuuugcucccaucacuuccacaaaauauuuaugaaggacggccggagucuuguaguuccuuguaggaaucaagaugaacugauugggagagcucgcaucucucagggagccgguuggagccuacgggagacugcaugccugggcaaggcuuacgcccagauguggucccucauguauuuccauaggcgagacuugagacuggcuucaauggccaucuguagugcagugccaacagagugguuuccgaccucucggacuacauggagcauucacgcgcaucaccaguggaugaccacggaagauaugcuuaaggucuggaacaggguguggauagaggacaaucccaacaugaucgauaagacaccuguucacuccugggaagacauuccauaccuggggaaacgcgaggaccucuggugcggaucauuaaucggccugagcucucgugccaccugggcuaagaauauucauacugccaucacccaagugagaaacuugauagguaaagaagaguaugucgauuacaugcccgugaugaagcgauauuccgcaccuagugagagcgaagggguacuguga

SEQ ID NO: 15725 - RNA, 9867 nt, Artificial Sequence
  derived and/or modified CDS sequence (opt3) from DENV-4__FJ182017__SS-prME
agcaccauaacacugcucugccuuauucccacugugauggcauuccaccuguccacgcgggacggcgagccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucugcauggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuguuuuaaugaugcugguggcccccucauaugggaugaggugugucggaguggguaaccgggauuucguagaaggcguuagcgggggagcuuggguggaccuugucuuggagcacggcgguugcgugaccacaauggcccaggggaagccuacccuggauuuugaacugacgaagacuacagcgaaagagguggcacuccugcgcaccuacuguaucgaagcccuuauuaguaauaucacuacagcuacccgaugcccaacgcaaggagagcccuaucugaaggaggaacaggaccagcaguacauuuguagaagggaugucguugaccggggcuggggcaacgggugcggauuguucgguaaaggcggggugguaaccugcgccaaguuuuccuguucuggaaaaaucacaggcaaucucgugcaaauagagaaccuggaauauacugucgugguuaccgugcauaauggugauacacacgcagucgggaacgacacuagcaaucacggcgugaccgcuacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacaaccggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaaucaaggguaugagcuauacuaugugcagugggaaauucucuaucgacaaggagauggccgagacacaacacggcacgaccgucgugaaaguuaaguacgaaggagcaggcgccccuuguaaggugccaauugagauacgcgaugucaauaaagaaaaggugguagggagagugaucuccgcuacucccuuggcggagaacacaaacagcguuaccaauauugagcucgaaccgccuuucggagacucguauaucgucauaggugugggcaacucugcacugacauuacauugguuuaggaaaggguccucaauuggaaagauguucgagaguacuuaccggggcgccaaacgcauggcuauccugggugaaaccgccugggauuuugggagcgugggcggacuauucacgucccucggcaaggcaguccaccagguuuuugggucuguguauaccacaauguucggaggcgugagcuggaugaucaggauucugaucgguuuucuuguauuguggauugggacuaauucaagaaacaccaguauggccaugacaugcauagcugucggaggcaucacucuguuccucgguuuuaccgugcaggccgacaugggcuguguuguguccuggagcgggcgugagcugaagugcggaucuggcauuuucgucguggauaauguucauacguggacagaacaauacaaauuucagcccgagucaccagcacggcuugcgagugcuauccugaacgcccacaaggacgggguguguggaauccgaagcaccacuagauuggagaauguaauguggaaacagauuacaaacgaacucaauuauguccugugggagggcggucacgacuuaaccgugguggcaggggaugucaagggaguucugacuaaaggcaagagggcccuaaccccucccgcuuccgaccucaaguacucuuggaaaacaugggguaaggccaaaauauucacgccagaagcacgcaacucgaccuuucugaucgauggccccgacacuagcgagugcccuaaugaacggagagcuuggaacuccuucgagguggaggauuacggguucggaauguuuacaaccaauauuuggaugaaguucagggaaggcucaagugagguaugugaccaucgccuuaugucugccgcgaucaaagaucagaaggccgugcacgcugacaugggguauuggauugaaagcuccaaaaaccaaacauggcagaucgagcgagcaucauugauagaagucaagacuugccuguggccaaagacccauacgcucuggagcaauggagugcuggagucucagauguuaaucccgaaauccuacgccggccccuuuagucagcacaacuaucggcaagguuacgcuacacagaccguugggccuuggcaccugggaaaacuugagauugauuucggcgaaugcccagguacuaccgugacaauccaggagaacugugaccaucguggccccagcuugagaacuaccacagccucugggaaacucgucacgcaguggugcuguagguccugcaccaugccuccacugcgcuuucuaggagaagauggcuguugguaugggauggagauucggccccugucagagaaggaagagaauauggugaaaagucaaguuacugcaggacagggcacaagcgaaaccuucucgaugggucuccugugccuuacuuuguuuguggaggaaugucugagaaggcgagucacacgcaagcacaugaucuuagcgguagugauaacccucugcgccauuauccuagggggccuuacguggauggaccuguugcgggcucucauuaugcugggcgauacuauguccggcagaaucgggggacagacccaucuagccauaauggcaguuuucaagaugucuccggguuacgugcugggcgucuuucucaggaaacugacaagccgugagaccgcucuuauggugaucgggauggccaugacuacaaccuugucaauuccucacgaccugauggaguuaaucgacggaauuagucucggccugauccuucugaagauaguaacacaguucgauaacacucaaguggguacccuagcacucucccugacguuuauucgcucuacaaugagcuuggucauggccuggcggaccaucauggcuguucuguucguggugacuuuaaucccacucuguagaaccuccugccugcagaaacagucacauugggucgaaauuacagcgcuuauccugggggcccaagcauugcccguguaucucaugacucugaugaagggagcuagcaggcgaaguuggccucuaaaugagggcauuauggccguuggccugguaucucuucucggguccgcccuguugaaaaacgacgugccccuggcuggaccaauggucgccgguggcuuacuccuggccgcguacgugaugagcgggucgucagcugaucuuucucuggaaaaggccgcaaauguucagugggacgagauggccgauauaaccggaaguuccccuaucauugaagugaagcaggacgaggauggcagcuuuucuauccgggacgucgaggaaacgaacaugauuacauugcucgugaaacuggcucuaaucaccguaagcggucuguacccccuugcaauaccaaucacuaugacacucugguauauguggcaggucaagacccaacgcuccggggcccugugggaugugccgagcccugcggcuacucagaaagccgcauugagugagggaguuuacagaauuaugcagaggggcuuauucggcaagacacaggugggggucggaauccacauggaagguguguuccacaccauguggcauguuacgcggggcagcgugauuugucacgagacugggcgacuggaacccucuugggccgacgucagaaaugauaugaucuccuauggaggcgguuggcgccucggggacaaaugggauaaggaggaggacgugcaaguacuggcuauagaaccaggaaagaaccccaaacaugugcagaccaagccuggccuuuuuaaaacacugaccggcgagauuggggccguuacauuggacuucaagccaggaacuucagguagucccaucaucaauaggaaaggcaaggucauugggcuauacggaaacggcguggugaccaaaagcggugauuaugucuccgcaauaacgcaggcugaacguaucggggagccugacuacgagguagaugaagacauuuuucggaagaagagacugacaaucauggaucuccacccgggagccggcaaaacuaagaggauucugccaucuaucgugcgcgaggcgcuuaaacgaagauuacggacccugauacucgcccccacaaggguuguggcagcugaaauggaggaagccuugcgcggccugccuauccguuaucagaccccagcugucaagucggagcauacugggagagagauuguggaccucaugugccacgcaaccuucacaacgcggcugcuuagcucaacuaggguucccaauuacaaccugaucgugauggaugaagcccacuuuaccgacccuuccagugucgccgcucgcggauacauuucuacacgaguggagaugggugaagcggcagccaucuucaugaccgcuacuccgcccggcgccacagauccauuuccucaaagcaauucccccauagaggacauugaaagagagaucccagagcggucauggaacaccggguucgauuggaucacggacuaucagggaaaaacuguaugguuugugccuucuauuaaggcaggcaaugacaucgccaacugcuugaggaaaucagguaaaaagguuauacagcuaagucgcaaaacauucgauaccgaauaccccaagaccaaacugacugacugggauuuugucgugacaaccgacauuuccgagaugggggcuaacuucagagcgggcagggugaucgauccacggcguugucucaagccggucauuuuaacagacggaccugaacgcguuauccuggccggccccauaccagugacucccgcaagcgcugcccaacgaagagggaggauuggacggaauccugcacaggaggaugaccaguauguauucucuggugauccacuuaagaacgacgaagaucaugcccacuggacggaggcuaaaaugcugcucgacaauaucuacacccccgagggcaucauuccuacauuguuugggccggaacgcgagaagacucaggccaucgauggagaguucagacugaggggcgagcaacggaaaaccuuuguggagcucaugcgaagaggugaccugccagucuggcuuucauauaagguggcguccgcagggauuaguuacaaagaccgcgaauggugcuucacaggcgagaggaacaaucagauacuagaagagaacauggaaguugagaucuggacccgggagggagaaaagaagaaacugcgucccaagugguuggaugccagaguguaugcugacccuauggccuuaaaagauuuuaaggaguucgcuagcggcaggaaaucgauuacucuggacauccucacggaaaucgcaucucugcccaccuaccuuuccagccgcgccaagcuggcucucgauaauauugucauguugcauacaacugagagagggggacgagccuaccagcacgcacugaacgaacuaccagagucacuggagacccucaugcuuguagcgcuguuaggugccaugacagcuggcauauuuuuguucuuuaugcaggggaagggaaucggcaaacugaguaugggucucauuaccaucgccguggcaucugggcugcuuuggguugcugaaauucaaccucaguggaucgccgcauccauaauccuggaguucuuucucaugguguugcugauucccgaaccagagaagcagagaacuccucaggacaaucaauuaaucuaugucauucuaacaauccugacgauaauuggccucaucgccgcuaacgaaaugggacuuauugagaaaaccaagacugauuucggcuuuuaccaggugaaaacagagaccaccauccuggacgucgauuugaggccggcgagcgccuggacacuguaugcaguggcuacuacgauacucacccccaugcugcgccacacaaucgaaaauacuucagccaaccuuagucucgccgcaauugcuaaucaggccgcgguucugaugggguugggaaagggcuggccacugcaucggauggacuuaggugugccucuacuggcuaugggguguuacagccagguaaaccccaccacacucaccgccucccuugugaugcuguugguccacuaugcaaucauuggaccaggccugcaagccaaagcuacuagagaggcacagaagcguacggccgcggguaucaugaagaauccuacaguugauggcauaaccgugauugaccucgaacccaucucuuacgauccgaaauucgagaagcagcuggggcaagucaugcuuuuagcucugugcgccggacagcucuugcugaugaggacuaccugggcauucugugaggugcuaacacuggccacuggcccaauccucacccuuugggaagggaacccuggacgguuuuggaacacaacgauugcuguaagcaccgccaauaucuuccgcggcuccuaucuggccggugcuggguuggccuuuucacugaucaagaacgcgcagacuccccgaagaggaacaggcaccacuggugagacacucggcgaaaaguggaaaaggcagcuaaauucuuuagaccggaaggaguucgaagaguacaagcgcagugggauucuugagguggacagaaccgaagccaaaucggcacugaaggauggaagcaaaaucaagcaugcuguuuccaggggaucuucaaaaauucgauggaucguggagcgggggauggucaagccaaagggaaaaguggucgaccucggcugcggucgugggggauggagcuacuauauggccacgcuaaagaacgugaccgaaguuaaaggcuacacaaagggcgggcccggacacgaggaaccuauaccgauggcaacuuaugguuggaaucugguaaaauugcauuccggcguggaugucuuuuacaagcccaccgagcaaguggacacacugcucugugauaucggggagaguucuagcaacccaacuauugaagagggaagaacccuucgcguucugaagaugguggaaccuugguugucauccaaacccgaguucugcaucaagguccugaauccuuauaugccaacagugauugaagaacucgagaaauuacagaggaagcacggcgguaaccugguacgguguccccuuaguagaaauagcacccacgaaauguacugggugucuggggcuuccggaaacaucguuucaagcgucaauacuacgucgaaaaugcugcuaaaccgcuuuacaaccaggcaucgaaagccuacuuaugagaaagacguggaucucggcgccggcacccggucugugaguacagaaacggagaagccagacaugaccauuaucgggagaaggcugcagcgcuugcaggaggaacacaaggagacuuggcauuacgaucaagaaaaucccuaccguacaugggccuaucacggauccuacgaggcgccgagcaccgguucagcuuccucuauggucaacggcguugugaaacugcucacuaagccuugggacguaauaccaauggugacacagcuugcaaugaccgauacaacucccuucgggcagcagcgggucuuuaaagaaaagguggacaccagaacgccucaaccaaaacccggaaccaggaugguuaugacaacuaccgccaauuggcugugggcuuuacugggcaagaagaaaaacccgcgcuugugcacacgagaggaguucauuagcaaggugcggaguaaugccgcaaucggugccgucuuucaggaagaacagggguggacuuccgcuagcgaagcggugaacgacucuagauucugggagcucguagauaaagaaagggcccugcaccaagagggaaagugugagucaugcguuuauaacaugaugggcaaacgcgaaaagaagcuaggcgaguuugggagagcaaaaggaagucgggcuaucugguacauguggcuuggugccagguuccuggaguucgaggcacucggcuuucugaaugaagaccauugguucgggcgugagaacuccuggagcggaguggagggcgaagguuugcaccgacugggguauauucucgaggaaauagauaagaaagacggagaucuuauguacgccgacgauaccgcuggcugggacacgcgcaucacagaggaugaccugcagaaugaggaauuaauuaccgagcagauggccccucaucacaagauccuggcgaaagcaauuuuuaaguugacuuaucagaacaaggucgugaaagugcucagacccacaccacggggcgccgucauggauaucauaucuaggaaggaccaacgcgggucgggacagguugguaccuacggccugaauacuuucaccaacauggaagugcagcuaaucagacagauggaggcugaagggguaauuacacaagaugacaugcagaauccuaaaggacuuaaggagcggguggagaaauggcugagggaaugcggcgucgaccgacucaagcguauggccaucucaggugaugacugugugguuaaaccccuggaugagagauuugggacgagcuuguuauuccugaacgacaugggaaaggugcgcaaggauauuccacagugggaacccuccaaaggcuggaagaauuggcaggaggucccuuuuugcagucaucacuuccacaaaaucuuuaugaaggacggccggucucucgugguaccauguaggaaccaagaugaacuuauagggagagcacgcauuagccagggagcugguuggucccugcgggagaccgccugccuaggcaaggcuuacgcccagauguggucacugauguauuuccauaggcgagaccucagauuggcaaguauggcgaucuguucugccguuccgacugagugguuucccacaagccggaccacuugguccauccacgcucaucaccaguggaugacaaccgaagauaugcugaagguguggaauagggucuggauugaggacaacccuaauaugauagauaagacgccagugcacucaugggaagacauccccuaccuugggaaacgcgaggaccuguggugcggaagccucauuggcuuaucuucccgugccacaugggcaaagaacauccauaccgcuauuacucaaguuagaaaucugaucgguaaagaagaguauguggauuacaugccugucaugaagcgauauagugccccaagcgagucggaagggguguuguga

SEQ ID NO: 15726 - RNA, 9867 nt, Artificial Sequence
  derived and/or modified CDS sequence (opt3) from DENV-4__EU854301__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccacuggggcugacaccucugaaguccacuggaauuacaaagagagaauggugacauucaaggucccccaugccaaaaggcaggaugugaccguucugggaucccaggaaggugcgaugcacucagcccucgcaggcgcuacugagguggacagcggggauggaaaccacauguuugccggccaucugaaguguaagguacggauggaaaaacuucgaaucaaggguaugaguuauacaaugugcucugggaaauucuccaucgacaaggagauggcugagacgcaacacggcaccacugucgugaaaguuaaguacgaaggagccggcgcaccuuguaaggugccaauugagauacgcgaugucaauaaagaaaaggugguagggagagugaucagcgccacaccccuggcugagaacaccaacucgguuacaaauauugaguuggaaccgccuuucggagacucuuauaucgucauaggugugggcaacuccgcgcucacucugcauugguuuaggaaagggucaaguauuggaaagauguucgagagcaccuaccggggcgcaaaacgcauggccaucuuaggugaaacggcuugggauuuuggguccgugggcggacuguucaccucucuaggcaaggccguccaccagaucuuugggagcguuuauacaacuauguucggaggcgugucauggaugauuagaauccucauugguuuucuggugcuuuggauagggaccaauaguaggaacacauccauggcaaugacuugcaucgccguaggaggcauuaccuuguuccuggguuuuacgguccaggcugacaugggcugugugguuagcuggucugggcgugagcucaagugcggaucaggcaucuucguggucgauaaugugcauacauggaccgaacaauacaaauuucagcccgagaguccagcccggcuggcaagcgcgauccuuaacgcucacaaggacgggguuuguggaauucgauccacuacaagacuggagaaugugauguggaaacagauaaccaacgaauugaauuauguacucugggagggcggucacgaccugacugucguggccggggaugugaagggagucuuaaccaaaggcaagagggcacugacaccucccgccucugaccuaaaguacucguggaaaacgugggguaaggcuaaaaucuucaccccagaagcccgcaacagcacuuuucucauugauggccccgacacauccgagugcccuaaugaacggagagcauggaacucauucgagguugaggauuacggguucggaauguuuaccacaaauaucuggaugaaguucagggaaggcaguucugaggugugugaccaucgccugaugagcgcugccauuaaagaucagaaggcgguacacgccgacaugggguauuggaucgaauccucaaaaaaccaaacuuggcagauagagcgagcuagccuuaucgaagugaagaccugcuuguggccaaagacgcauacacuguggucuaauggaguccucgagucccagaugcugauuccgaaaaguuacgcaggccccuuuagccagcacaacuaucggcaagguuacgccacccagacuguggggccuuggcacuuaggaaagcuggagaucgauuucggcgaaugcccagguaccacaguuacuauucaggagaacugugaccaucguggccccucucuuagaaccacaacggcuuccgggaaauuggugacccaguggugcuguaggucaugcacuaugccuccacuccgcuuucugggagaagauggcuguugguaugggauggagauccggccccuaagugagaaggaagagaauauggucaaaagccaagugacagccggacagggcaccucggaaacuuucuccaugggucugcucugccugacacuuuuuguugaggaauguuugagaaggcgagugacccgcaagcacaugauacuggcagucguaauuacguuaugcgcgaucauucucgggggacugacuuggauggaccuucugcgggccuugaucaugcucggcgauaccaugucuggcagaauagggggacagacacaucuggcuaucauggccguguucaagaugagcccggguuacguucuaggcguguuucugaggaaacucaccucacgugagacugcacugauggucauugggauggcuaugacaaccacacuuaguaucccucacgacuugauggagcugauugacggaaucuccuuaggccucauacugcuuaagauugugacucaguucgauaacacccaaguagguacgcuggcccuaucucucacauuuauccgcagcaccaugucccuggugauggcauggcggacuaucauggccgucuuguucguugugacccugauuccauuauguagaacaucaugccuccagaaacagagccauuggguggaaaucacugcucugauucuuggggcgcaagcccugcccgucuauuugaugacccucaugaagggagcaaguaggcgaucuuggccucugaaugagggcauaauggcugugggccuaguuucccugcuugggagcgcccuccugaaaaacgacguacccuuggccggaccaaugguggcugguggccuguuacucgcagccuacgucaugucggggucaucugcggaucugagucuugaaaaggcugccaaugugcagugggacgagauggcagauaucacgggauccagcccuauuaucgaaguuaagcaggacgaggauggcucuuuuagcauucgggacguggaggaaacaaacaugaucacccuguuggucaaacucgcccugauaacuguguccggucuauacccccuggcuaucccaauuacaaugacccuuugguauauguggcagguaaagacucaacgcucaggggcacucugggaugucccgaguccugccgcgacacagaaagcugcccugagcgagggaguguacagaaucaugcagaggggcuuguucggcaagacccagguuggggugggaauucacauggaaggugucuuccacacgauguggcaugugacucggggcucuguuaucugucacgagaccgggcgauuagaacccuccugggcagacgugagaaaugauaugauaucauauggaggcgguuggcgccugggggacaaaugggauaaggaggaggacguccaagugcucgccauugaaccaggaaagaaccccaaacauguacagacaaagccuggccuguuuaaaacccuuacaggcgagaucggggcugugacucuggacuucaagccaggaaccagugguagccccaucauuaauaggaaaggcaagguuauaggguuguacggaaacggcgucgugacgaaauccggugauuaugugucugccaucacacaggcagaacguauuggggagccugacuacgaggucgaugaagacaucuuucggaagaagagacuaacuauuauggaucugcacccgggagcuggcaaaaccaagaggauccucccaucgauaguacgcgaggcccugaaacgaagacuucggacauuaauccuggcgcccaccagggugguugccgcagaaauggaggaagcucuccgcggcuugccuauucguuaucagacuccagccgugaagagcgagcauaccgggagagagaucgucgaccugaugugccacgcuacauucacgacucggcuccugucauccaccagggugcccaauuacaaccuuauuguuauggaugaagcacacuuuacagacccuaguucuguggccgcccgcggauacaucagcacccgagucgagaugggugaagcugcggcaauauucaugacugccacaccgcccggcgcuaccgauccauuuccucaauccaauucacccauugaggacaucgaaagagagaucccagagcggucuuggaacacgggguucgauuggauuacugacuaucagggaaaaacagugugguuuguaccuagcaucaaggccggcaaugacauagcaaacugccugaggaagagugguaaaaaggugauucaguugucccgcaaaaccuucgauaccgaauaccccaagacuaaacuaacagacugggauuuuguugucaccacagacaucagcgagaugggggccaacuucagagcuggcagggugauugauccacggcguugucugaagccggugauccucacugacggaccugaacgcgucauauuagcgggccccauuccaguuacgcccgccucugcagcucaacgaagagggaggaucggacggaauccugcccaggaggaugaccaguauguguucucaggugauccacugaagaacgacgaagaucaugcacacuggaccgaggccaaaaugcuucuggacaauaucuacacacccgagggcauuaucccuacucucuuugggccggaacgcgagaagacccaggcuauugauggagaauucagauugaggggcgagcaacggaaaacauuuguagagcugaugcgaagaggugaccucccaguguggcuguccuauaaggucgccagugcggggauaagcuacaaagaccgcgaauggugcuucaccggcgagaggaacaaucagauccuugaagagaacauggaaguggagauuuggacucgggagggagaaaagaagaaacuacgucccaaguggcuggaugcaagaguuuaugccgacccuauggcuuugaaagauuuuaaggaguucgccucgggcaggaaaucuaucacguuagacauccugaccgaaauugcuucccuccccacauaccugagcucacgcgcaaagcuugcccuggauaauauagugaugcuccauacuaccgagcgggggggacgagcuuaccagcacgccuugaacgaacugccagagagucuagagacacugaugcucgucgcacuucugggugcgaugaccgccggcaucuuuuuauucuuuaugcaggggaagggaaugggcaaauugucuaugggucugauuacuaucgcuguagccuccgggcuccuguggguggcagaaauucaaccucaguggaucgcugccagcauaauccuugaguucuuucugaugguucucuugauucccgaaccagagaagcagagaacaccucaggacaaucaacugaucuaugugauuuuaacgauccuaaccauaauuggccugaucgcagccaacgaaaugggacucauugagaaaacuaagacagauuucggcuuuuaccaggucaaaaccgagaccacaauccuugacguggaucugaggccggcuucagcguggacuuuguaugccgucgcaacgaccauacugacacccaugcuccgccacacuaucgaaaauaccagugcuaaccugagccuugccgccauugcaaaucaggcugccgugcucauggggcugggaaagggcuggccauugcaucggauggaccuggguguuccuuuacuagcgaugggguguuacucccaggugaaccccacaacccugacugcuucucucguaaugcuucuggugcacuaugccaucauuggaccaggcuugcaagcaaaagccacgagagaggcucagaagcguacagcagccgguaucaugaagaauccuaccgucgauggcauaacuguuauugaccuggaacccaucagcuacgauccgaaauucgagaagcagcucgggcaagugaugcugcuugucuuaugcgcgggacagcuguuccucaugaggaccacaugggcuuuuugugagguguugacucuggccaccggcccaauccuaacacugugggaagggaacccuggacgguucuggaacacgaccauugcaguauccacugccaauaucuuucgcggcucauaucucgcuggugccgggcuugcauucucucugauaaaaaacgcucagacaccccgaagaggaaccggcacuacaggugagaccuugggcgaaaaguggaaaaggcagcugaauagucucgaccggaaggaguuugaagaguacaagcgcucggggauucuggagguggacagaacggaagccaaaagcgcguuaaaggauggauccaaaaucaagcaugccguuucuaggggcucaagcaaaauucgauggaucguggagcgggggauggucaagccaaagggaaaaguggucgaccuuggcugcggucgugggggaugguccuacuauauggcaacccugaagaacgugacagaaguuaaaggcuacacuaagggcgggcccggacacgaggaaccuauaccgauggcuaccuaugguuggaaucucguaaaacuacauaguggcguggaugucuucuacaagcccacagagcaaguggacacucuguugugugauaucggggagucuagcucaaacccaaccauugaagagggaagaacacugcgcguucucaagaugguggaaccuuggcuuuccaguaaacccgaguuuugcaucaagguccugaauccuuauaugccaaccgugauugaagaguuggagaaacugcagaggaagcacggcgguaaccucguacggugucccuuaagcagaaauucuacucacgaaauguacuggguguccggggccucaggaaacaucguuagcucggucaauacgacaucuaaaaugcugcuuaaccgcuucaccacuaggcaucgaaagccuaccuaugagaaagacguggaucugggcgcaggcacacggaguguguccacggaaaccgagaagccagacaugacuauuaucgggagaaggcuacagcgccuccaggaggaacacaaggagacauggcauuacgaucaagaaaaucccuaccguaccugggcuuaucacggaagcuacgaggccccgucaacugguuccgccucuagcauggucaacggcguugugaaacuguugacaaagccuugggacguaauaccaauggugacccagcuggcgaugacagauacuacccccuuugggcagcagcgggucuucaaagaaaagguggacacgagaaccccucaaccaaaacccggaacaaggaugguuaugacuaccacagcuaauuggcucugggcacuucugggcaagaagaaaaacccgcgcuuaugcacucgagaggaguuuauuaguaaggugcgguccaaugccgcuaucggugccgucuuccaggaagagcagggguggaccagcgcaucugaagccgugaacgacucaagauuuugggagcugguagauaaagaaagggcuuugcaccaagagggaaagugugagaguugcguuuauaacaugaugggcaaacgcgaaaagaagcucggcgaguucgggagagcgaaaggaucccgggccaucugguacauguggcugggugcaagguuccuagaauuugaggcucuuggcuuccugaaugaagaccauugguuugggcgugagaacagcuggucuggaguggagggcgaaggucuccaccgacugggguauauuuuggaggaaauagauaagaaagacggagaucugauguacgccgacgauacggcaggcugggacacacgcaucaccgaggaugaccuccagaaugaggaacuuauuacugagcagauggccccucaucacaagauccuggcuaaagccauuuucaaguuaacauaucagaacaaggucgugaaagugcugagacccaccccacggggcgcggucauggauaucauaucgaggaaggaccaacgcgggucaggacagguugguacuuacggcuugaauaccuuuacaaacauggaagugcagcucaucagacagauggaggcagaagggguaauuacgcaagaugacaugcagaauccuaaaggacugaaggagcggguggagaaauggcuaagggaaugcggcgucgaccgacuuaagcguauggccaucagcggugaugacugugugguuaaaccccuggaugagagauucgggaccucccuccuguuuuugaacgacaugggaaaggugcgcaaggauauuccacagugggaacccaguaaaggcuggaagaauuggcaggaggucccuuucugcucucaucacuuucacaaaaucuucaugaaggacggccggagcuuagugguaccauguaggaaccaagaugaacugauagggagagcucgcauuucccagggagccgguuggucacuccgggagacugcaugccuuggcaaagcuuacgcccagauguggagucugauguauuuucauaggcgagaccuaagacuggcuucuauggccaucuguagcgcaguuccgacagagugguuccccaccucccggacuacauggucaauccacgcgcaucaccaguggaugaccacggaagauaugcucaagguguggaauagggucuggauugaggacaacccuaauaugauagauaagacaccagugcacagcugggaagacauccccuacuuggggaaacgcgaggaccuguggugcggaucucuuauuggccuguccagucgugccaccugggcuaagaacauccauacugccauuacccaaguuagaaaucucaucgguaaagaagaguauguggauuacaugccugcaaugaagcgauauagcgcuccaucggaguccgaaggggucuuauga

SEQ ID NO: 15727 - RNA, 9867 nt, Artificial Sequence
  derived and/or modified CDS sequence (opt3) from DENV-4__FJ639736__SS-prME
agcaccaugacucugcucugccuuauccccacugccauggcuuuccaccuguccacgagagacggcgaaccuuugaugauuguggcaaagcaugaaagggggcggccauuacuguuuaaaaccacugagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacagcggguggagucguggauccugcgcaauccaggguucgcccugcucgcuggauuuauggcauacaugauuggccagacuggcauccagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguauagaagcccuuaucaguaauauuacaaccgcuacgcgaugcccaacccaaggagagcccuaucugaaggaggaacaggaccagcaguacaucuguagaagggauguggucgaccggggcuggggcaacgggugcggauuguucgguaaaggcgggguugugacaugcgccaaguuuuccuguucuggaaaaauuacuggcaaucucguacaaaucgagaaccuggaauauaccguggucgugacaguucauaauggugauacucacgcaguggggaacgacaccagcaaucacggcgucacagcuaccauaacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgccggggcggacacuagcgaagugcacuggaauuacaaagagagaauggucaccuucaaggugccccaugccaaaaggcaggaugucacagugcucggaucucaggaaggugcaaugcacuccgcucuggccggcgcuaccgagguugacucaggggauggaaaccacauguuugccggccaucuuaaguguaaggugcggauggaaaaacugcgaauuaaggguaugagcuauacuaugugcagugggaaauucucuaucgacaaggagauggcagagacacaacacggcacgaccguagucaaagugaaguacgaaggagccggcgcuccuuguaagguuccaaucgagauucgcgaugugaauaaagaaaaggucguggggagaguaauauccagcacucccuuggcggagaacacaaacucggugaccaauaucgagcucgaaccgccuuucggagacucuuauauuguuaucggugucggcaacuccgcacugacauuacauugguuuaggaaagggucaaguauaggaaagauguucgagagcacuuaccggggcgccaaacgcauggcuauucugggugaaaccgccugggauuuuggguccgugggcggacuauucacgucucucggcaaggcagugcaccaggucuuugggagcguuuauaccacaauguucggaggcgugucauggaugaucagaauccugauugguuuucuuguguuguggaucgggacuaauaguaggaacaccuccauggccaugacaugcauugcuguaggaggcauaacucuguuccucgguuuuaccguccaggccgacaugggcugugugguuagcuggucugggcgugagcugaagugcggaucaggcaucuucguggucgauaaugugcauacguggacagaacaauacaaauuucagcccgagaguccagcacggcuugcgagcgcuauucugaacgcccacaaggacgggguuuguggaauccgauccaccacuagauuggagaaugugauguggaaacagaucacaaacgaacucaauuauguacugugggagggcggucacgacuuaaccgucguggcaggggaugugaagggaguccugacuaaaggcaagagggcccuaaccccucccguuucugaccucaaguacucguggaaaacaugggguaaggcuaaaauuuucacgccagaagcccgcaacagcaccuuucugauagauggccccgacacuuccgagugcccuaaugaacggagagcauggaacucacuugagguggaggauuacggguucggaauguucacaaccaauaucuggaugaaguuuagggaaggcaguucugagguaugugaccaucgcuugaugagcgcugccauuaaagaucagaaggcggugcacgccgacaugggguauuggaucgaauccagcaagaaccaaacauggcagauugagcgagcuagccugaucgaagucaagacuugccucuggccaaagacccauacgcuguggucuaauggaguguuagagucccagaugcugauaccgaaaaguuacgcaggccccuucagccagcacaacuaucggcaagguuacgccacacagaccguugggccuuggcaccuuggaaaguuggagaucgauuuuggcgaaugcccagguacuaccgugacaauucaggaggacugugaucaucguggccccucucucagaacuaccacagcuuccgggaaacuggucacgcaguggugcuguaggucaugcaccaugccuccacuacgcuuccugggagaagacggcuguugguaugggauggagauccggccccucagugagaaggaagagaacauggugaaaagccaaguuacugccggacagggcacaucggaaaccuuuuccaugggucugcuuugcuugacucuguucguggaggaauguuuaagaaggcgagucacacgcaagcacaugauucucgcaguagugaucacccugugcgcgauaauucuugggggacugacguggauggauuugcuccgggcccugaucaugcuaggcgacacuaugucuggcagaauugggggacagacccaucuggcuaucauggccguuuuuaagaugagcccggguuacgugcucggcgucuuccugaggaaacuuacaucacgugagaccgcauugauggugauagggauggcuaugacuacaacccugaguaucccucacgacuuaauggagcucauugauggaaucucccugggccuuauucugcuaaagaucguaacacaguuugacaauacucaaguggguacccucgcccugucuuugacguucauacgcagcacaaugucccuggucauggcauggcggaccauuauggccguuuuauuuguggugacucucaucccacuguguagaaccucaugccuucagaaacagagccauugggucgaaaucacagcucugauuuugggggcgcaagcccuccccguguaucugaugacucuaaugaagggagcaaguaggcgaucuuggccucugaacgagggcaucauggcuguuggccuuguaucccuccuggggagcgccuugcugaaaaaugaugugcccuuagccggaccaauggucgcugguggccuccugcuugcagccuacgugaugucggggucaucugcggaccugaguuuggaaaaggcugccaacguucagugggaugagauggcagacauuaccggauccagcccuauaaucgaagugaagcaggaugaggacggcucuuucagcauucgggaugucgaggaaacgaauaugaucacacuccuggugaaacuagcccugauuaccguauccggucuuuacccccucgcuaucccagucacuaugacacugugguauauguggcaagugaagacccaacgcucaggggcauugugggacguuccgaguccugccgcgacucagaaagcugccuuaagcgagggaguguacagaauaaugcagaggggccuguuuggcaagacacaggucggggugggaauccacauggaagguguuuuccacaccauguggcaugugacgcggggcucugucauuugucacgagacugggcgacucgaacccuccugggcagaugugagaaacgacaugaucucauauggaggcgguuggcgccugggggauaaaugggacaaggaggaggacguacaagugcuugccauugaaccaggaaagaaucccaaacauguucagaccaagccuggccuguucaaaacauugaccggcgagaucggggcugucacacuagauuuuaagccaggaacaagugguagccccauaauuaacaggaaaggcaaggugaucgggcuguacggaaauggcguggucaccaaauccggugacuauguaucugccaucacgcaggcagaacguauuggggagccugauuacgagguggacgaagauauauuccggaagaagagacucacaaucauggaccugcacccgggagcuggcaaaacuaagaggauucuuccaucgaucguucgcgaggccuuaaaacgaagacugcggacccucauuuuggcgcccacaaggguggucgccgcagaaauggaggaagcucugcgcggccucccuauccguuaucagaccccagccgugaagucagagcauacugggagagagauaguugaucugaugugccacgcuaccuuuacaacgcggcuucugucauccacuagggugcccaacuacaauuugaucgucauggacgaagcacacuucaccgauccuaguucuguggccgcccgcggauacauuagcacacgaguagagaugggugaagcugcggcaaucuuuaugaccgccacuccgcccggcgcuacagacccauucccucaauccaacucacccauugaggauaucgaaagagagauaccagagcggucuuggaauaccggguuugacuggauuacggacuaucagggaaaaacugugugguucguuccuagcaucaaggccggcaacgauaucgcaaauugccuaaggaagagugguaaaaaggucauucagcugucccgcaaaacauuugacaccgaauaccccaagaccaaacucacugauugggacuucguggugacaaccgauaucagcgagaugggggccaacuuuagagcuggcagggucauagacccacggcguuguuuaaagccgguuauucugacagauggaccugaacgcgugauccuugcgggccccauuccaguaacucccgccucugcagcucaacgaagagggaggaucggacggaacccugcccaggaggacgaucaguauguguucucaggugacccacugaagaaugaugaagaccaugcacacuggacggaggccaaaaugcucuuggauaacauauacacccccgagggcauuaucccuacacuguucgggccggaacgcgagaagacucaggcuaucgacggagaauuuagacucaggggcgagcaacggaaaaccuucgucgagcugaugcgaagaggugaccuuccaguguggcuauccuauaagguugccagugcggggauuagcuacaaagaucgcgaauggugcuuuacaggcgagaggaauaaccagauccuggaagagaauauggaaguggagauuuggacccgggagggagaaaagaagaaauugcgucccagaugguuagacgcaagggucuaugccgauccuauggcucugaaggacuucaaagaguuugccucgggccgcaagucuauaacucucgauauccugacggaaauugcuucccuucccaccuaccugagcucacgggcaaaacucgccuuggacaacaucguaaugcugcauacaacugagcgagggggcagagcuuaccagcacgcccuaaaugaacugccagagagucucgagacccuuaugcugguggcauuauugggugcgaugacagccggcaucuuccuguuuuucaugcaggggaagggaauuggcaagcucucuaugggucugauaaccaucgcuguugccuccgggcuucuguggguggcagaaauucaaccucaguggaucgcugccagcauuauccucgaguuuuucuugaugguccuguuaauacccgaaccagagaaacagaggacuccucaggauaaccaacuaaucuaugugauucugacaauccucacgauuaucggccuuauagcagccaaugaaaugggacugauugagaagaccaaaacugacuuuggcuucuaccaggucaagacagagaccaccaucuuggauguggaccugcgcccggcuucagcguggacacucuaugccguugcaacuacgauucugacccccaugcuucggcacacaaucgaaaacacaagugcuaaucucagccuggccgccauagcaaaccaggcugccguguugauggggcugggaaaaggcuggccauuacauagaauggaucuagguguaccucugcucgcgaugggguguuacucccaggugaaucccaccacacuuaccgcuucucuggucauguugcugguucacuaugccaucauuggaccaggccuccaagcaaaggccacucgugaggcucagaaaaggacggcagccgguaucaugaagaacccuacaguggacggcauuaccgucaucgaucuggaacccauaagcuacgacccgaaguuugagaaacagcuugggcaagugauguuacugguacucugcgcgggacaguugcugcuaaugcggacuaccugggcuuucugugaggugcugacacucgccacuggcccaauucuuacccugugggaagggaauccuggacgcuucuggaacacaacgaucgcaguuuccaccgccaacaucuuucgaggcucauauuuggcuggugccgggcuggcauucucucucauuaagaaugcucagacucccagaaggggaacaggcaccacuggugagacacugggcgaaaaauggaagcggcaguuaaacagucuugaccgcaaagaguuugaagaguacaagagaucggggauccuggagguggauaggaccgaagccaagagcgcgcucaaagacggauccaagauaaaacaugccgucucucgaggcucaagcaagauucgguggaucguggagcgugggauggucaaaccaaagggaaaggugguugaucuaggcugcgguagagggggaugguccuacuauauggcaacgcugaaaaauguaaccgaagugaagggcuacacaaaaggcgggcccggacacgaggaaccuauuccgauggcuacuuaugguuggaacuuggucaagcugcauaguggcguggacguuuucuacaaacccaccgagcaaguggauacacuccuuugugacaucggggagucuagcucaaauccaacuauagaagagggacgcacccugagggucuugaagaugguggaaccuuggcuguccaguaagcccgaguuuugcaucaaaguacucaacccuuauaugccaacagugauugaagaguuagagaagcugcagcggaaacacggcgguaaucuuguuagauguccccugagccgcaacucuacccacgaaauguacugggucuccggggccucaggaaauaucgugagcucggugaacacuacgucuaagaugcuacucaauagguucacaacccgacaucggaaaccuacuuaugagaaggaugucgaccugggcgcaggcaccagaaguguuuccacagaaacggagaaaccagauaugaccauuaucgggaggcgcuugcagcgucugcaggaggaacacaaggagacuuggcauuacgaccaagaaaaccccuaccggacaugggcuuaucacggaagcuacgaggccccgucaaccgguuccgccucuagcauggugaauggcguagugaagcuccuuacuaaaccuugggaugucauuccaauggugacacagcuggcgaugaccgacacaacucccuuugggcagcagagaguuuucaaggaaaaaguggacaccaggacgccucaaccaaagcccggaacccgcauggucaugacaacuaccgcuaacugguuaugggcacuguugggcaaaaagaagaauccgcgacucugcacacgggaggaguuuaucaguaaagugagauccaacgccgcuauaggugccguauuccaggaagaacagggguggacuagcgcaucugaagccguuaaugauucaagguuuugggagcugguggacaaggaacgcgcucuacaccaagagggaaaaugugagaguugcgucuauaacaugaugggcaagagagagaagaaacuuggcgaguucgggcgggcgaaaggauccagggccauuugguacauguggcugggugcacguuuucucgaguucgaggcucugggcuucuugaacgaagaucauugguuugggcgagagaauagcuggucuggaguggagggcgaaggucugcaccgccucggguauauccuugaggaaaucgacaaaaaggauggagaccugauguacgccgaugacaccgcaggcugggauacgagaauuacagaggacgauuuacagaacgaggaacugauaaccgagcagauggccccucaucacaaaaucuuggcuaaggccauuuucaaacucacuuaucagaauaagguggucaagguucugcggcccacaccaaggggcgcggugauggacaucauuucgcgcaaagaucaaagagggucaggacagguagguaccuacggccuaaacacuuuuaccaauauggaagugcagcuuauccggcagauggaggcagaaggggucauaacacaagacgacaugcagaacccuaagggacugaaagagaggguggagaaguggcuccgagaaugcggcguugaucgucugaaaagaauggccaucagcggugacgauuguguggucaagcccuuggacgagcgcuucgggacguccuuacuguuucucaaugauaugggaaaagugcggaaggacauuccacagugggaacccaguaagggcuggaaaaacuggcaggagguaccuuucugcucucaucacuuucacaagaucuucaugaaagauggcaggagccuuguugugccauguagaaaucaagacgaacugauugggcgcgcucggaucucccagggagccgguuggucacuaagggagaccgcaugccugggcaaggcuuacgcccagauguggagucucauguauuuucaucgaagagauuugcggcuggcuucuauggccauauguagcgcagucccgacugagugguuccccacauccaggaccacuuggucaauucacgcgcaucaccaguggaugacaaccgaagacaugcuuaaaguguggaaccgcguuuggaucgaggauaauccuaacaugaucgacaagacgccagugcacagcugggaagacauucccuaccuggggaagcgugaggaucucuggugcggaucuuuaauaggccuguccaguagagccacaugggcuaaaaauauccauaccgccauuacucaaguccgaaacuugaucgguaaggaagaguauguggacuacaugccuguaaugaaaagguauagcgcaccaucggaguccgaaggggugcuguga

SEQ ID NO: 15728 - RNA, 9867 nt, Artificial Sequence
  derived and/or modified CDS sequence (opt3) from DENV-4__FJ639737__SS-prME
ucaaccaucacucugcucugccuuauucccacugugauggccuuccaccuguccacgagagacggagaaccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuuaucaauaccgaacccgaggauauugacugcugguguaaccugacuucuacaugggugauguauggaaccugcacgcagucaggggagcgccgacgugaaaagagaaguguagccuugacuccucacagcggaaugggccucgagaccagggcggaaacauggauguccucugagggugcuuggaaacaugcccagcggguggagucguggauccugcgcaauccaggguucgcacugcucgccggauuuauggcuuacaugauaggccagacuggcauccagagaaccgucuucuuuguguuaaugaugcugguugcacccucauaugggaugaggugugugggagucgguaaccgggauuucguggaaggcguaagcgggggagccuggguugaccuuguguuggagcacggcgguugcgucacaaccauggcucaggggaagccuacgcuggauuuugaacuaacuaagacaaccgccaaagagguggcgcuccugcgcacuuacuguauugaagcacuuaucaguaauauuacaaccgccacgcgaugcccaacccaaggagagcccuaucugaaggaggaacaggaccagcaguacaucuguagaagggauguggucgaccggggcuggggcaacgggugcggauuguucgguaaaggcgggguugugacaugcgcuaaguuuuccuguucuggaaaaauaacuggcaaucucguacaaauugagaaccuggaauauaccguggucgugacaguucauaauggugauacucacgccguggggaacgacaccagcaaucacggcgucacagcaaccaucacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgcuggggccgacacuagcgaagugcacuggaauuacaaagagagaauggucaccuucaaggugccccaugcgaaaaggcaggaugucacagugcucggaucucaggaaggugccaugcacuccgcacuggcuggcgccaccgagguugacucaggggauggaaaccacauguuugcuggccaucuuaaguguaaggugcggauggaaaaacugcgaaucaaggguaugagcuauacuaugugcagugggaaauucucuauugacaaggagauggccgagacacaacacggcacgaccguagucaaagugaaguacgaaggagcaggcgccccuuguaagguuccaauagagauccgcgaugugaauaaagaaaaggucguggggagaguaauuuccagcacucccuuggcugagaacacaaacucggugaccaauaucgagcucgaaccgccuuucggagacucuuauauaguuauuggugucggcaacuccgcgcugacauuacauugguuuaggaaagggucaaguaucggaaagauguucgagagcacuuaccggggcgcaaaacgcauggccauccugggugaaaccgcuugggauuuuggguccgugggcggacuauucacgucucucggcaaggccgugcaccaggucuuugggagcguuuauaccacaauguucggaggcgugucauggaugauuagaauccugauugguuuucuuguguuguggauagggacuaauaguaggaacaccuccauggcaaugacaugcaucgccguaggaggcauuacucuguuccucgguuuuaccguccaggcugacaugggcugugugguuagcuggucugggcgugagcugaagugcggaucaggcaucuucguggucgauaaugugcauacguggacagaacaauacaaauuucagcccgagaguccagcccggcuugcaagcgcgauccugaacgcucacaaggacgggguuuguggcauucgauccaccacuagauuggagaaugugauguggaaacagauaacaaacgaacucaauuauguacugugggagggcggucacgacuuaaccgucguggccggggaugugaagggaguccugacuaaaggcaagagggcacuaaccccucccguuucugaccucaaguacucguggaaaacaugggguaaggccaaaaucuucacgccagaagcucgcaacagcaccuuucugauugauggccccgacacuuccgagugcccuaaugaacggagagccuggaacucacuugagguggaggauuacggguucggaauguucacaaccaauaucuggaugaaguuuagggaaggcaguucugagguaugugaccaucgcuugaugagcgcagcuauuaaagaucagaaggccgugcacgcggacaugggguauuggaucgaauccagcaagaaccaaacauggcagauagagcgagccagccugaucgaagucaagacuugccucuggccaaagacccauacgcuguggucuaauggaguguuagagucccagaugcugauuccgaaaaguuacgcuggccccuucagccagcacaacuaucggcaagguuacgcaacacagaccguugggccuuggcaccuuggaaaguuggagaucgauuuuggcgaaugcccagguacuaccgugacaauucaggaggacugugaucaucguggccccucucucagaacuaccacagccuccgggaaacuggucacgcaguggugcuguaggucaugcaccaugccuccacuacgcuuccugggagaagacggcuguugguaugggauggagauccggccccucagugagaaggaagagaacauggugaaaagccaaguuacugcuggacagggcacaucggaaaccuuuuccaugggucugcuuugcuugacucuguucguggaggaauguuuaagaaggcgagucacacgcaagcacaugauacucgccguagugauuacccugugcgcaaucauucuugggggacugacguggauggauuugcuccgggcgcugaucaugcuaggcgacacuaugucuggcagaauagggggacagacccaucuggccaucauggcuguuuuuaagaugagcccggguuacgugcucggcgucuuccugaggaaacuuacaucacgugagaccgccuugauggugauugggauggcaaugacuacaacccugaguaucccucacgacuuaauggagcucauugauggaaucucccugggccuuauacugcuaaagauuguaacacaguuugacgauacucaaguggguacccucgcucugucuuugacguucauccgcagcacaaugucccuggucauggccuggcggaccaucauggcaguuuuauuuguggugacucucauuccacuguguagaaccucaugccuucagaaacagagccauugggucgaaaucacagcccugauuuugggggcucaagcgcuccccguguaucugaugacucuaaugaagggagccaguaggcgaucuuggccucugaaugagggcauaauggcaguuggccuuguaucccuccuggggagcgcuuugcugaaaaacgacgugcccuuagccggaccaauggucgccgguggccuccugcuugcugcauacgugaugucggggucaucugccgaucugaguuuggaaaaggcggcuuccguucagugggacgagauggccgauaucaccggaagcucuccuauuaucgaagugaagcaggacgaggauggcagcuucuccauucgggacgucgaggaaacgaauaugaucacacuccuggugaaacuagcacugauaaccguaucaggucuuuacccccucgccaucccagucacuaugacacugugguauauguggcaagugaagacccaacgcaguggggcuuugugggauguuccgagcccugcagccacucagaaagcggcuuuaucugagggaguguacagaauuaugcagaggggccuguuuggcaagacacaggucggggugggaauccacauugaagguguuuuccacaccauguggcaugugacgcggggcuccgucaucugucacgagacugggcgacucgaacccucaugggccgacgugagaaacgauaugauaaguuauggaggcgguuggcgccugggggacaaaugggacaaggaggaggauguacaagugcuugcaauugaaccaggaaagaaucccaaacauguucagaccaagccuggccuguucaaaacauugaccggcgagaucggggccgucacacuagacuuuaagccaggaacuagcgguucccccaucauuaacaggaaaggcaaggugauagggcuguacggaaauggcguggucaccaaaucuggugauuauguaucggcuaucacgcaggccgaacguauuggggagccugacuacgagguggaugaagacaucuuccggaagaagagacucacaauuauggaucugcacccgggagcaggcaaaacuaagaggauccuuccaagcauaguucgcgaggcuuuaaaacgaagacugcggacccucaucuuggcccccacaaggguggucgcggccgaaauggaggaagcacugcgcggccucccuauucguuaucagaccccagcugugaagucagagcauacugggagagagaucguugaccugaugugccacgccaccuuuacaacgcggcuucuguccaguacuagggugcccaacuacaauuugauugucauggaugaagcucacuucaccgacccuucuagcguggcagcccgcggauacaucuccacacgaguagagaugggugaagccgcugcgauauuuaugaccgcaacuccgcccggcgccacagauccauucccucaaucaaacucucccauugaggacaucgaaagagagaucccagagcggagcuggaauaccggguuugacuggauuacggauuaucagggaaaaacugugugguucguuccuaguaucaaggcuggcaacgacauagccaauugccuaaggaaguccgguaaaaaggucauucagcugagccgcaaaacauuugauaccgaauaccccaagaccaaacucacugacugggauuucguggugacaaccgacaucucugagaugggggcaaacuuuagagccggcagggucauugauccacggcguuguuuaaagccgguuauccugacagacggaccugaacgcgugauacuugcuggccccauuccaguaacucccgcgucagccgcacaacgaagagggaggaucggacggaauccugcucaggaggaugaccaguauguguucuccggugauccacugaagaacgacgaagaucaugcccacuggacggaggcaaaaaugcucuuggacaacaucuacacccccgagggcauuaucccuacacuguucgggccggaacgcgagaagacucaggccauugacggagaauuuagacucaggggcgagcaacggaaaaccuucgucgagcugaugcgaagaggugaucuuccaguguggcuaaguuauaagguugcuagcgccgggauaucguacaaagaccgcgaauggugcuuuacaggcgagaggaauaaccagauccuggaagagaauauggaaguggagauuuggacccgggagggagaaaagaagaaauugcgucccagaugguuagaugcgagggucuaugcagacccuauggcccugaaggauuucaaagaguuugcuucuggccgcaaguccaucacucucgacauccugacggaaauugccagccuucccaccuaccugucaagucgggcuaaacucgcauuggauaacauaguaaugcugcauacaacugagcgagggggcagagccuaccagcacgcucuaaaugaacugccagagucucucgagacccuuaugcugguggccuuauugggugcaaugacagcgggcaucuuccuguuuuucaugcaggggaagggaauuggcaagcucuccaugggucugaucaccauugccguugcuagcgggcuucuguggguggccgaaauccaaccucaguggauagcagcuucaaucauucucgaguuuuucuugaugguccuguuaauccccgaaccagagaaacagaggacuccucaggacaaccaacuaauuuaugugauccugacaauacucacgauuaucggccuuauugccgcaaaugaaaugggacugaucgagaagaccaaaacugauuuuggcuucuaccaggucaagacagagaccaccauauuggacguggaucugcgcccggccagugcuuggacacucuaugcgguugccacuacgauccugacccccaugcuucggcacacaauugaaaacacuagcgcaaaucucucccuggcugccaucgccaaccaggcagcuguguugauggggcugggaaaaggcuggccauuacauagaauggaccuagguguaccucugcucgccaugggguguuacucucaggugaaucccaccacacuuaccgcgagccuggucauguugcugguucacuaugcuauuaucggaccaggccuccaagccaaggcaacucgugaggcccagaaaaggacggcugcagguauaaugaagaacccuacaguggauggcauuaccgucaucgaccuggaacccaucuccuacgacccgaaguuugagaaacagcuugggcaagugauguuacugguacucugcgccggacaguugcugcuaaugcggacuaccugggcguucugugaggugcugacacucgcuacuggcccaauucuuacccugugggaagggaauccuggacgcuucuggaacacaacgaucgccguuucaaccgcaaauauauuucgaggcucuuauuuggccggugcugggcuggccuucagucucauuaagaacgcacagacucccagaaggggaacaggcaccacuggugagacacugggcgaaaaauggaagcggcaguuaaacucgcuugaucgcaaagaguuugaagaguacaagagaagcgggauccuggagguggacaggaccgaagcuaaguccgcccucaaagauggaucuaagauuaaacaugcggucucacgaggcagcuccaagauccgguggauaguggagcgugggauggucaaaccaaagggaaaggugguugaccuaggcugcgguagagggggauggaguuacuauauggccacgcugaaaaauguaaccgaagugaagggcuacacaaaaggcgggcccggacacgaggaaccuaucccgauggcaacuuaugguuggaacuuggucaagcugcauucuggcguggauguuuucuacaaacccauugagcaaguggacacccuccuuugugauaucggggagagcucauccaauccaacaauugaagagggacgcacucugagggucuugaagaugguggaaccuuggcugaguagcaagcccgaguuuugcaucaaaguacucaacccuuauaugccaaccgugauugaagaguuagagaagcugcagcggaaacacggcgguaaucuuguuagauguccccugucucgcaacuccacacacgaaauguacugggucucaggggcuagcggaaauaucgugucgucugugaacaccacaaguaagaugcuacucaauagguucacgacacgacaucggaaaccuaccuaugagaaggacgucgaucugggcgccggcacuagauccguuagcaccgaaacagagaaaccagacaugacgauaauugggaggcgcuugcagcgucugcaggaggaacacaaggagaccuggcauuacgaucaagaaaaccccuaccggacuugggcauaucacggaucauacgaggcuccguccacagguucugccagcaguauggugaauggcguagugaagcuccuuaccaaaccuugggacgucaucccaauggugacucagcuggccaugacagacaccacacccuuugggcagcagagaguuuucaaggaaaaaguggauacuaggaccccucaaccaaagcccggaacgcgcauggucaugaccacaacugcgaacugguuaugggcucuguugggcaaaaagaagaauccgcgacucugcacccgggaggaguuuaucuccaaagugagaagcaacgcagccauuggugcuguauuccaggaagaacagggguggacaucugccucagaagcaguuaaugacaguagguuuugggagcugguggauaaggaacgcgcccuacaccaagagggaaaaugugaguccugcgucuauaacaugaugggcaagagagagaagaaacuuggcgaguucgggcgggcuaaaggaagcagggcgauaugguacauguggcugggugcccguuuucucgaguucgaggcacugggcuucuugaaugaagaccauugguuugggcgagagaacucuuggucgggaguggagggcgaaggucugcaccgccucggguauauccuugaggaaauugauaaaaaggacggagaucugauguacgcugacgauacugccggcugggacaccagaaucacggaggaugacuuacagaacgaggaacugauuacagagcagauggcaccucaucacaaaaucuuggccaaggcuauauucaaacucaccuaucagaauaagguggucaagguucugcggcccacuccaaggggcgccgugauggauaucauuucacgcaaagaccaaagagggagcggacagguagguacauacggccuaaacaccuuuacuaauauggaagugcagcuuauccggcagauggaggcggaaggggucauuacccaagacgauaugcagaacccuaagggacugaaagagaggguggagaaguggcuccgagaaugcggcguugaccgucugaaaagaauggcaaucuccggugaugacuguguggucaagcccuuggaugagcgcuucgggacaaguuuacuguuucucaaugacaugggaaaagugcggaaggauauaccacagugggaacccucuaagggcuggaaaaacuggcaggagguaccuuucugcagccaucacuuucacaagauuuucaugaaagacggcaggucccuuguugugccauguagaaaucaagaugaacugaucgggcgcgcccggaucucacagggagcugguuggagucuaagggagacggccugccugggcaaggcauacgcucagauguggucucucauguauuuucaucgaagagacuugcggcuggccagcauggcuauuuguuccgccgucccgaccgagugguuccccacuucaaggacaaccuggagcauacacgcacaucaccaguggaugacuacagaagauaugcuuaaaguguggaaccgcguuuggaucgaggacaauccuaacaugauugacaagaccccagugcacucuugggaagauauccccuaccuggggaagcgugaggaccucuggugcggauccuuaauuggccugaguagcagagcgacgugggccaaaaauauccauacagcuauaacccaaguccgaaacuugaucgguaaggaagaguauguggauuacaugccuguaaugaaaagguauucggccccauccgagucugaaggggugcuguga

SEQ ID NO: 15729 - RNA, 9867 nt, Artificial Sequence
  derived and/or modified CDS sequence (opt3) from DENV-4__FJ639738__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaaucaaggguaugagcuauacuaugugcagugggaaauucucuaucgacaaggagauggccgagacacaacacggcacgaccgucgugaaaguuaaguacgaaggagcaggcgccccuuguaaggugccaauugagauacgcgaugucaauaaagaaaaggugguagggagagugaucuccagcacucccuuggcugagaacacaaacucgguuaccaauauugagcucgaaccgccuuucggagacucuuauaucgucauaggugugggcaacuccgcgcugacauuacauugguuuaggaaagggucaaguauuggaaagauguucgagagcacuuaccggggcgcaaaacgcauggccauccugggugaaaccgcuugggauuuuggguccgugggcggacuauucacgucucucggcaaggccguccaccagguuuuugggagcguguauaccacaauguucggaggcgugucauggaugaucagaauucugaucgguuuucuuguauuguggauugggacuaauaguaggaacaccuccauggcaaugacaugcauagccgucggaggcaucacucuguuccucgguuuuaccgugcaggcugacaugggcuguguugugagcuggucugggcgugagcugaagugcggaucaggcauuuucgucguggauaauguucauacguggacagaacaauacaaauuucagcccgagaguccagcccggcuugcaagcgcgauccugaacgcucacaaggacgggguguguggaauccgauccaccacuagauuggagaauguaauguggaaacagauuacaaacgaacucaauuauguccugugggagggcggucacgacuuaaccgugguggccggggaugucaagggaguucugacuaaaggcaagagggcacuaaccccucccgugucugaccucaaguacucguggaaaacaugggguaaggccaaaauauucacgccagaagcucgcaacagcaccuuucugaucgauggccccgacacuuccgagugcccuaaugaacggagagccuggaacucacuugagguagaggauuacggguucggaauguucacaaccaauauuuggaugaaguuuagggaaggcaguucugaggugugugaccaucgcuugaugagcgcagcuaucaaagaucagaaggccguccacgcggacaugggguauuggauugaauccucaaaaaaccaaacauggcagaucgagcgagccagccugauagaagugaagacuugccucuggccaaagacccauacgcuguggucuaauggaguuuuagagucccagaugcugaucccgaaaaguuacgcuggccccuucagccagcacaacuaucggcaagguuacgcaacacagaccguggggccuuggcaccuuggaaaguuggagauugauuuuggcgaaugcccagguacuaccgucacaauccaggaggacugugaucaucguggccccucucucagaacuaccacagccuccgggaaacuggugacgcaguggugcuguaggucaugcaccaugccuccacuacgcuuccugggagaagacggcuguugguaugggauggagauucggccccucagugagaaggaagagaacaugguuaaaagccaagugacugcuggacagggcacaucggaaaccuuuuccaugggucugcuuugcuugacucuguucgucgaggaauguuuaagaaggcgaguaacacgcaagcacaugauccucgccgugguuauaacccugugcgcaauuauccuugggggacugacguggauggauuugcuccgggcgcugauuaugcuaggcgacacuaugucuggcagaaucgggggacagacccaucuggccauaauggcuguguuuaagaugagcccggguuacguccucggcguguuccugaggcgucuuacaucacgcgagaccgccuugaugguaaucgggauggcaaugacuacaacccugaguauuccucacgacuuaauggagcucaucgauggaauuucccugggccuuauccugcuaaaaauagugacacaguuugacaauacucaagucgguacccucgcucugucuuugacguucauucggagcacaaugucccugguuauggccuggagaaccaucauggcaguguuauuuguggucacucucaucccacuguguaggaccucaugccuucagaagcagagccauuggguggaaauuacagcccugaucuugggggcucaagcgcuccccguuuaucugaugacucuaaugaaaggagccagucgacggucuuggccucugaacgagggcauuauggcaguaggccuugugucccuccuggggagcgcuuugcugaagaaugauguccccuuagccggaccaaugguggccgguggccuccugcuugcugcauacguuaugucggggucaucugccgaccugaguuuggaaaaagcggcuaacgugcagugggaugagauggccgacauaaccggauccagcccuaucauugaagucaagcaggaugaggacggcucuuucagcauccgcgauguggaggaaacgaauaugauuacacuccugguaaagcuagcacugaucaccgucuccggucuuuacccccucgccauaccagugacuaugacacugugguauauguggcagguuaaaacccaaagaucaggggcuuugugggacgugccgaguccugcagccacucagaaggcggcuuuaagcgagggagucuacaggaucaugcagcggggccuguuuggcaaaacacagguggggguuggaauucacauggaagguguguuccacaccauguggcaugucacgcgaggcucugugaucugucacgagacugggagacucgaacccuccugggccgauguacgcaacgacaugauuucauauggaggcgguuggaggcugggggauaagugggacaaagaggaggacgugcaaguucuugcagucgaaccaggaaagaaucccaagcaugugcagaccaaaccuggccuguucaagacaaucaccggcgagauaggggccgugacauuggauuuuaaaccaggaacuagugguagccccauuaucaaccguaagggcaaagucaucgggcuauacggaaauggcguagugaccaaguccggugacuauguuucugcuauuacgcaggccgaacggauaggggagccugauuacgagguggacgaagauaucuucagaaaaaagaggcugacaauuauggaccuccacccgggagcaggcaagacuaaacgcauccugccaucgauuguccgagaggcucuuaagagacgguuaaggacccugauccucgcccccacacgcgugguugcggccgaaauggaggaagcauugcguggccugccuauaagauaucagaccccagcugugaaaagcgagcauacugggcgggagaucgucgaucucaugugccacgccaccuuuacaacgaggcugcuuucauccacucgcgugcccaacuacaaucugauuguaauggacgaagcucacuucaccgauccuaguucuguggcagcccgaggauacaucagcacaagaguugagaugggugaagccgcugcgauuuuuaugaccgcaacuccgcccggcgccacagacccauucccucaauccaacucacccaucgaggauauagaacgggagauuccagagaggucuuggaauaccggguuugacuggaucacggacuaucagggaaagacugucugguucgugccuagcaucaaagcuggcaacgauauugccaauugcuugcgcaagagugguaagaaagugauccagcuauccagaaagacauuugacaccgaauaccccaaaaccaagcugacugauugggacuucgucguuacaaccgauauaagcgagaugggggcaaacuuuagggccggccgggugauugacccacgucgcugucucaaaccgguaaucuuaacagauggaccugaacgagugauucuggcuggccccaucccagucacucccgcgucugccgcacaaagaagggggcggauaggacgcaacccugcucaggaggacgaucaguauguguucucaggugacccacuuaagaaugaugaagaccaugcccacuggacggaggcaaagaugcugcucgauaacauuuacacccccgagggcaucaucccuacauuguucgggccggaaagagagaaaacucaggccauugacggagaauuuaggcugcggggcgagcaacgaaagaccuucguugagcucaugagacgcggugaccugccaguguggcuuuccuauaaagucgcuagugccgggaucagcuacaaggauagggaauggugcuuuacaggcgagcggaauaaccagauucuagaagagaauauggaaguagagauauggacccgugagggagaaaaaaagaagcugagacccaggugguuggacgcgcgcguguaugcagauccuauggccuuaaaagacuucaaggaguuugcuucgggccggaaaucuaucacucuggauauucucacggaaaucgccucccugcccaccuaccuuagcucacgagcuaagcuggcacucgacaacaucguuauguugcauacaacugagagagggggaagggccuaccagcacgcucugaaugaacuaccagagagucuggagacccucaugcuuguggcccuguuaggugcaaugacagcgggcauuuucuuguuuuucaugcaggggaaaggaauaggcaagcugucuaugggucucaucaccauugccgucgcuuccgggcugcuuuggguggccgaaauccaaccucaguggauugcagcuagcaucauacuggaguuuuuccucauggucuugcugauccccgaaccagagaagcagcgcacuccucaggauaaccaauuaauuuaugugauccuaacaauucugacgaucauaggccucauugccgcaaaugaaaugggacuuaucgagaaaaccaagacugacuuuggcuucuaccagguuaaaacagagaccaccauucuggauguggacuugcggccggccucagcuuggacacuguaugcgguagccacuacgauccucacccccaugcugagacacacaauagaaaacacuagugcaaaucuuagccucgcugccaucgccaaccaggcagcugugcugaugggguugggaaagggcuggccacugcaucguauggauuuaggugucccucuacuggccaugggguguuacucccagguuaaucccaccacacucaccgcgucucuugugaugcuguugguccacuaugcuauuaucggaccaggccugcaagccaaagcaacuagggaggcccagaagcggacggcugcagguauuaugaaaaacccuacaguggacggcaucaccguaauagaucucgaacccauuagcuacgacccgaaguuugagaagcagcuggggcaagugaugcuuuuaguucugugcgccggacagcucuugcugaugcgcacuaccugggcguucugugaggugcuaacacuggcuacuggcccaauccucacccuuugggaagggaauccuggacgauucuggaacacaacgaucgccgucuccaccgcaaacauuuuuagaggcucauaucuggccggugcuggguuggccuucucucugaucaaaaaugcacagacucccaggcggggaacaggcaccacuggugagacacucggcgaaaaguggaaacgccagcugaacaguuuagacagaaaggaguuugaagaguacaaaaggucggggauacuugagguggaucgaaccgaagcuaagagcgcccugaaggacggauccaaaauuaagcaugcggucucucggggcucaagcaaaauccguuggauuguggagagagggaugguuaagccaaaaggaaagguaguggaucucggcugcggucgcgggggaugguccuacuauauggccacgcuaaagaaugucaccgaagugaaaggcuacacaaagggcgggcccggacacgaggaaccuaucccgauggcaacuuaugguuggaaccugguuaaauugcauaguggcguggacgucuucuacaagcccaccgagcaaguggauacacugcucugugacauaggggagucuagcucaaauccaacuaucgaagagggaaggacccuucggguacugaaaaugguggaaccuugguuguccaguaagcccgaguuuugcauuaagguucugaacccuuauaugccaacagucaucgaagagcucgagaaauuacagagaaagcacggcgguaaucuggugcgcuguccccuuagcaggaacucuacccacgaaauguacuggguguccggggcuucaggaaauauugucagcucgguuaacacuacgucuaaaaugcugcuaaaucgauucacaacccggcauagaaagccuacuuaugagaaagauguggaccucggcgccggcaccaggaguguauccacagaaacggagaagccagauaugaccaucauugggcgccgucugcagcgguugcaggaggaacacaaagagacuuggcauuacgaccaagaaaaccccuacagaacaugggcauaucacggaagcuacgaggcuccgucaaccgguuccgccucuagcauggugaauggcgucgugaagcugcucacuaagccuugggauguuaucccaauggugacacagcuugccaugaccgacacaacucccuuugggcagcagagggucuucaaagaaaagguggacacccgcacgccucaaccaaaacccggaacccgaaugguaaugacaacuaccgcgaacuggcugugggcuuuacugggcaagaaaaagaauccgcgguugugcacaagagaggaguuuauaaguaagguuagguccaacgcagccauuggugcuguguuccaggaagagcagggguggacuagcgccucugaagcagucaaugauucacgcuuuugggagcucguggacaaagaaagagcccugcaccaagagggaaagugugagaguugcguguauaacaugaugggcaaacgggaaaagaaacuaggcgaguucgggagggcuaagggaucccgugcgaucugguacauguggcuuggugcccgauuucuggaauucgaggcacucggcuuccugaacgaagaucauugguuugggcgcgagaauagcuggucuggagucgagggcgaagguuugcacagacugggguauauccucgaggaaauugacaagaaagauggagaccuuauguacgcugaugacaccgccggcugggauacgcggauaacagaggacgaucugcagaacgaggaauuaaucaccgagcagauggcaccucaucacaagauucuggccaaagcuaucuucaaguugacuuaucagaauaaaguugugaagguacucaggcccacaccacgcggcgccgugauggacauuaucucgagaaaggaucaacgggggucaggacaggucgguaccuacggccugaacacuuuuaccaauauggaagugcagcuaauaaggcagauggaggcggaagggguuaucacacaagacgacaugcagaacccuaaaggacuuaaggagcgaguggagaaauggcugcgugaaugcggcgucgauagacucaagcgcauggcaauuagcggugacgauugugugguaaaaccccuggacgagcgguucgggacguccuuguuauuucugaaugauaugggaaagguuaggaaagacaucccacagugggaacccaguaagggcuggaagaacuggcaggaggugccuuucugcucucaucacuuucacaaaauuuucaugaaggauggcagaagccucgucgugccaugucgcaaucaagacgaacuuaucgggcgggccaggauaucccagggagcugguuggucacugcgagagaccgccugccuaggcaaagcauacgcucagauguggagucugauguauuuucauagacgggaucucagguuggccucuauggcuauuuguagcgccguuccgacugagugguuccccacaucccgcaccacuuggucaauccacgcacaucaccaguggaugacaaccgaagacaugcugaagguguggaaccgugucuggaucgaggauaauccuaacaugauugacaaaacgccagugcacagcugggaagacauacccuaccuugggaagagagaggaucuguggugcggaucucucaucggcuuauccagucgagcgacaugggccaagaauauucauaccgcuaucacucaaguaaggaaccugauugguaaagaagaguauguggacuacaugccugucaugaagcgguauagcgccccaucggaguccgaagggguuuuguga

SEQ ID NO: 15730 - RNA, 9867 nt, Artificial Sequence
  derived and/or modified CDS sequence (opt3) from DENV-4__FJ639739__SS-prME
agcaccaugacacugcucugccuuauccccacugccauggcuuuccaccuguccacgagagacggcgaaccuuugaugauuguggcgaagcaugaaagggggcggccauuacuguuuaaaaccacagagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacagcggguggagucguggauccugcgcaauccaggguucgcccugcucgcuggauuuauggcauacaugauuggccagacuggcauccagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguauagaagcccuuaucaguaauauuacaaccgcuacgcgaugcccaacccaaggagagcccuaucugaaggaggaacaggaccagcaguacaucuguagaagggauguggucgaccggggcuggggcaacgggugcggauuguucgguaaaggcgggguugugacaugcgccaaguuuuccuguucuggaaaaauuacuggcaaucucguacaaaucgagaaccuggaauauaccguggucgugacaguucauaauggugauacucacgcaguggggaacgacaccagcaaucacggcgucacagcuaccauaacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgccggggcggacacuagcgaagugcacuggaauuacaaagagagaauggucaccuucaaggugccccaugccaaaaggcaggaugucacagugcucggaucucaggaaggugcaaugcacuccgcucuggccggcgcuaccgagguugacucaggggauggaaaccacauguuugccggccaucuuaaguguaaggugcggauggaaaaacugcgaauuaaggguaugagcuauacuaugugcagugggaaauucucuaucgacaaggagauggcagagacacaacacggcacgaccguagucaaagugaaguacgaaggagccggcgcuccuuguaagguuccaaucgagauucgcgaugugaauaaagaaaaggucguggggagaguaauauccagcacucccuuggcggagaacacaaacucggugaccaauaucgagcucgaaccgccuuucggagacucuuauauuguuaucggugucggcaacuccgcacugacauuacauugguuuaggaaagggucaaguauaggaaagauguucgagagcacuuaccggggcgccaaacgcauggcuauucugggugaaaccgccugggauuuuggguccgugggcggacuauucacgucucucggcaaggcagugcaccaggucuuugggagcguuuauaccacaauguucggaggcgugucauggaugaucagaauccugauugguuuucuuguguuguggaucgggacuaauaguaggaacaccuccauggccaugacaugcauugcuguaggaggcauaacucuguuccucgguuuuaccguccaggccgacaugggcugugugguuagcuggucugggcgugagcugaagugcggaucaggcaucuucguggucgauaaugugcauacguggacagaacaauacaaauuucagcccgagaguccagcacggcuugcgagcgcuauucugaacgcccacaaggacgggguuuguggaauccgauccaccacuagauuggagaaugugauguggaaacagaucacaaacgaacucaauuauguacugugggagggcggucacgacuuaaccgucguggcaggggaugugaagggaguccugacuaaaggcaagagggcccuaaccccucccguuucugaccucaaguacucguggaaaacaugggguaaggcuaaaauuuucacgccagaagcccgcaacagcaccuuucugauagauggccccgacacuuccgagugcccuaaugaacggagagcauggaacucacuugagguggaggauuacggguucggaauguucacaaccaauaucuggaugaaguuuagggaaggcaguucugagguaugugaccaucgcuugaugagcgcugccauuaaagaucagaaggcggugcacgccgacaugggguauuggaucgaauccagcaagaaccaaacauggcagauugagcgagcuagccugaucgaagucaagacuugccucuggccaaagacccauacgcuguggucuaauggaguguuagagucccagaugcugauaccgaaaaguuacgcaggccccuucagccagcacaacuaucggcaagguuacgccacacagaccguugggccuuggcaccuuggaaaguuggagaucgauuuuggcgaaugcccagguacuaccgugacaauucaggaggacugugaucaucguggccccucucucagaacuaccacagcuuccgggaaacuggucacgcaguggugcuguaggucaugcaccaugccuccacuacgcuuccugggagaagacggcuguugguaugggauggagauccggccccucagugagaaggaagagaacauggugaaaagccaaguuacugccggacagggcacaucggaaaccuuuuccaugggucugcuuugcuugacucuguucguggaggaauguuuaagaaggcgagucacacgcaagcacaugauucucgcaguagugaucacccugugcgcgauaauucuugggggacugacguggauggauuugcuccgggcccugaucaugcuaggcgacacuaugucuggcagaauugggggacagacccaucuggcuaucauggccguuuuuaagaugagcccggguuacgugcucggcgucuuccugaggaaacuuacaucacgugagaccgcauugauggugauagggauggcuaugacuacaacccugaguaucccucacgacuuaauggagcucauugauggaaucucccugggccuuauucugcuaaagaucguaacacaguuugacaauacucaaguggguacccucgcccugucuuugacguucauacgcagcacaaugucccuggucauggcauggcggaccauuauggccguuuuauuuguggugacucucaucccacuguguagaaccucaugccuucagaaacagagccauugggucgaaaucacagcucugauuuugggggcgcaagcccuccccguguaucugaugacucuaaugaagggagcaaguaggcgaucuuggccucugaacgagggcaucauggcuguuggccuuguaucccuccuggggagcgccuugcugaaaaaugaugugcccuuagccggaccaauggucgcugguggccuccugcuugcagccuacgugaugucggggucaucugcggaccugaguuuggaaaaggcugccaacguucagugggaugagauggcagacauuaccggauccagcccuauaaucgaagugaagcaggaugaggacggcucuuucagcauucgggaugucgaggaaacgaauaugaucacacuccuggugaaacuagcccugauuaccguauccggucuuuacccccucgcuaucccagucacuaugacacugugguauauguggcaagugaagacccaacgcucaggggcauugugggacguuccgaguccugccgcgacucagaaagcugccuuaagcgagggaguguacagaauaaugcagaggggccuguuuggcaagacacaggucggggugggaauccacauggaagguguuuuccacaccauguggcaugugacgcggggcucugucauuugucacgagacugggcgacucgaacccuccugggcagaugugagaaacgacaugaucucauauggaggcgguuggcgccugggggauaaaugggacaaggaggaggacguacaagugcuugccauugaaccaggaaagaaucccaaacauguucagaccaagccuggccuguucaaaacauuggcuggcgagaucggggccgucacccuagauuuuaagccaggaacaagugguagccccauaauuaacaggaaaggcaaggugaucgggcuguacggaaauggcguggucacuaaauccggugacuauguaucugcaaucacccaggcugaacguauuggggagccugauuacgagguggacgaagauauauuccggaagaagagacucacgaucauggaccugcacccgggagccggcaaaacaaagaggauucuuccaucgaucguucgcgaggcguuaaaacgaagacugcggacucucauuuuggcccccaccaggguggucgcagcugaaauggaggaagcccugcgcggccucccuauccguuaucagacaccagcugugaagucagagcauaccgggagagagauaguugaucugaugugccacgcaacuuuuaccacacggcuucugucauccacgagggugcccaacuacaauuugaucgucauggacgaagcccacuucacugauccuaguucuguggccgcucgcggauacauuagcacccgaguagagaugggugaagcggcagccaucuuuaugacagcuaccccgcccggcgccacugacccauucccucaauccaacucacccauugaggauaucgaaagagagauaccagagcggucuuggaauacaggguuugacuggauuaccgacuaucagggaaaaacggugugguucguuccuagcaucaaggcaggcaacgauaucgccaauugccuaaggaagagugguaaaaaggucauucagcugucccgcaaaacuuuugacacagaauaccccaagaccaaacucaccgauugggacuucguggugacuacagauaucagcgagaugggggcuaacuuuagagcgggcagggucauagacccacggcguuguuuaaagccgguuauucugaccgauggaccugaacgcgugauccuugccggccccauuccaguaacacccgcaucugcugcccaacgaagagggaggaucggacggaacccugcacaggaggacgaucaguauguguucucaggugacccacugaagaaugaugaagaccaugcccacuggacugaggcuaaaaugcucuuggauaacauauacacgcccgagggcauuaucccuacccuguucgggccggaacgcgagaagacacaggccaucgacggagaauuuagacucaggggcgagcaacggaaaacuuucgucgagcugaugcgaagaggugaccuuccaguguggcuauccuauaagguugcgagugcagggauuagcuacaaagaucgcgaauggugcuuuaccggcgagaggaauaaccagauccuggaagagaauauggaaguggagauuuggacacgggagggagaaaagaagaaauugcgucccagaugguuagacgccagggucuaugcugauccuauggcccugaaggacuucaaagaguuugcuucgggccgcaagucuauaacccucgauauccugacugaaauugcaucccuucccacguaccugagcucacgggccaaacucgcuuuggacaacaucguaaugcugcauaccacagagcgagggggcagagccuaccagcacgcacuaaaugaacugccagagagucucgagacucuuaugcugguggcguuauugggugccaugaccgcuggcaucuuccuguuuuucaugcaggggaagggaauuggcaagcucucuaugggucugauaacaaucgccguugcauccgggcuucuguggguggcugaaauucaaccucaguggaucgccgcaagcauuauccucgaguuuuucuugaugguccuguuaauacccgaaccagagaaacagaggaccccucaggauaaccaacuaaucuaugugauucugacuauccucacaauuaucggccuuauagccgcuaaugaaaugggacugauugagaagacgaaaaccgacuuuggcuucuaccaggucaagacugagacaaccaucuuggauguggaccugcgcccggcgucagccuggacccucuaugcaguugcuacaacuauucugacgcccaugcuucggcacaccaucgaaaacacaagugccaaucucagccuggccgcaauagcuaaccaggccgcgguguugauggggcugggaaaaggcuggccauuacauagaauggaucuagguguaccucugcucgcuaugggguguuacucccaggugaaucccacuacccuuacagccucucuggucauguugcugguucacuaugcaaucauuggaccaggccuccaagccaaggcuacccgugaggcacagaaaaggacugccgcggguaucaugaagaacccuacgguggacggcauuacagucaucgaucuggaacccauaagcuacgacccgaaguuugagaaacagcuugggcaagugauguuacugguacucugcgcuggacaguugcugcuaaugcggaccacuugggccuucugugaggugcugacccucgcaacaggcccaauucuuacucugugggaagggaauccuggacgcuucuggaacaccacaaucgccguuuccacggcuaacaucuuucgaggcucauauuuggccggugcagggcuggcuuucucucucauuaagaaugcccagacccccagaaggggaacuggcacaaccggugagacucugggcgaaaaauggaagcggcaguuaaacagucuugaccgcaaagaguuugaagaguacaagagaucggggauccuggagguggauaggacagaagcaaagagcgcccucaaagacggauccaagauaaaacaugcagucucucgaggcucaagcaagauucgguggaucguggagcgugggauggucaaaccaaagggaaagauuguggaucuaggcugcgguagagggggaugguccuacuauauggcuacccugaaaaauguuacggaaguaaagggcuacaccaaaggcgggcccggacacgaggaaccuaucccgauggccacauaugguuggaacuuggugaagcugcauaguggcgucgacguguucuacaaacccacugagcaaguugauacccuccuuugugacauaggggagucuagcucaaauccaacaaucgaagagggacgcacucugaggguguugaagauggucgaaccuuggcuguccaguaagcccgaguuuugcauuaaagugcucaacccuuauaugccaaccguaaucgaagaguuagagaagcugcagcggaaacacggcgguaaucuugugagauguccccugagccgcaacucuacacacgaaauguacuggguuuccggggcaucaggaaauauugucagcucggugaacaccacuucuaagaugcuacucaauagguucacgacacgacaucggaaaccuaccuaugagaaggauguggaccugggcgcuggcacuagaagugucuccaccgaaacagagaaaccagauaugacgaucauugggaggcgcuugcagcgucugcaggaggaacacaaggagaccuggcauuacgaccaagaaaaccccuaccggacuugggccuaucacggaagcuacgaggccccgucaacagguuccgcgucuagcaugguuaauggcgugguaaagcuccuuaccaaaccuugggaugugaucccaauggucacucagcuggcuaugacagacaccacacccuuugggcagcagagaguguucaaggaaaaaguugacacuaggaccccucaaccaaagcccggaacgcgcauggugaugaccacaacugcaaacugguuaugggcccuguugggcaaaaagaagaauccgcgacucugcacccgggaggaguuuauaaguaaagucagauccaacgcugccauuggugcaguguuccaggaagaacagggguggacaagcgccucugaagcuguaaaugauucaagguuuugggagcugguugacaaggaacgcgcgcuacaccaagagggaaaaugugagaguugcguguauaacaugaugggcaagagagagaagaaacuuggcgaguucgggcgggccaaaggauccagggcaaucugguacauguggcugggugcucguuuucucgaguucgaggcccugggcuucuugaacgaagaucauugguuugggcgagagaauagcuggucuggagucgagggcgaaggucugcaccgccucggguauauccuugaggaaauugacaaaaaggauggagaccugauguacgcagaugacacugccggcugggauaccagaauaacggaggacgauuuacagaacgaggaacugaucacagagcagauggcuccucaucacaaaauuuuggccaaggcgaucuucaaacucaccuaucagaauaagguggugaagguccugcggcccacuccaaggggcgcaguuauggacauuaucucgcgcaaagaucaaagagggucaggacagguggguacauacggccuaaacaccuuuacuaauauggaaguacagcuuauacggcagauggaggccgaaggggugaucacccaagacgacaugcagaacccuaagggacugaaagagagggucgagaaguggcuccgagaaugcggcguggaucgucugaaaagaauggcuauuagcggugacgauuguguugugaagcccuuggacgagcgcuucgggacauccuuacuguuucucaaugauaugggaaaaguccggaaggacaucccacagugggaacccaguaagggcuggaaaaacuggcaggaggugccuuucugcucucaucacuuucacaagauuuucaugaaagauggcaggagccuuguaguuccauguagaaaucaagacgaacugaucgggcgcgcccggauaucccagggagcagguuggucacuaagggagacggcuugccugggcaaggccuacgcucagauguggagucucauguauuuucaucgaagagauuugcggcuggccucuauggcaauuuguagcgcggugccgaccgaguggcuucccacuuccaggacaaccuggucaauccacgcccaucaccaguggaugacuacagaagacaugcugaaagucuggaaccgcguguggaucgaggauaauccuaacaugauugacaagaccccaguucacagcugggaagacauacccuaccucgggaagcgugaggauuuauggugcggaucucugaucggcuuguccaguagagcuacgugggccaaaaauauucauacagcaaucacccaagugcgaaaccugauugguaaggaagaguaugucgacuacaugccugugaugaaaagguauagcgcuccaucggaguccgaagggguacucuga

SEQ ID NO: 15731 - RNA, 9867 nt, Artificial Sequence
  derived and/or modified CDS sequence (opt3) from DENV-4__JN819409__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacugccacauggguaauguauggcaccugcacgcagucuggggagcgccgacgugaaaagagaucaguggcguugacuccucacaguggaaugggccucgagaccagggcugaaacauggaugagcuccgagggugccuggaaacaugcacaacgggucgagucuuggauucugcgcaauccaggguucgcccugcucgcuggauuuauggcauacaugaucggccagacuggcauacagagaaccguguucuuuguuuuaaugaugcugguggcccccucguaugggaugaggugugucggaguggguaaccgggauuucguagaaggcguuucagggggagcuuggguggaccuugucuuggagcacggcgguugcgugacaaccauggcccaggggaagccuacgcuggauuuugaacuaacuaagacaaccgcgaaagagguggcacuccugcgcacuuacuguaucgaagcccuuauuagcaauaucacaaccgcuacgcgaugcccaacccaaggagagcccuaucugaaggaggaacaggaccagcaguacauuuguagaagggaugucguugaccggggcuggggcaacgggugcggauuguucgguaaaggcggggugguaacaugcgccaaguuuaguuguuccggaaaaaucacuggcaaucucgugcaaauagagaaccuggaauauaccgucgugguuacagugcauaauggugauacucacgcagucgggaacgacaccucuaaucacggcgugacagcuaccauuacuccucguagcccauccguagagguuaaguuaccggauuacggagaacugacgcucgacugcgagccccgcucaggcaucgacuucaacgagaugauucuuaugaagaugaaaaagaaaacauggcuggugcauaagcagugguuuuuggaucuaccucugccauggaccgccggggcggacacuagugaaguccacuggaauuacaaagagagaauggugaccuucaaggucccccaugccaaaaggcaggaugugacaguucucggaagccaggaaggugcaaugcacucugcucuggccggcgcuaccgagguggacuccggggauggaaaccacauguuugccggccaucuuaaguguaagguacggauggaaaaacugcgaaucaaggguaugucauauacuaugugcagcgggaaauucaguaucgacaaggagauggcagagacacaacacggcacgaccgucgugaaaguuaaguacgaaggagccggcgcuccuuguaaggugccaauugagauacgcgaugucaauaaagaaaaggugguagggagagugaucucuuccacucccuuggcggagaacacaaacggaguuaccaauauugagcucgaaccgccuuucggugacagcuauaucgucauaggcguggggaacucggcacugacauuacauugguuuaggaaaggaucuuccauuggcaagauguucgagucaacuuaccggggugccaaacgcauggcuauccugggggaaaccgccugggauuuuggcagugugggaggccuauucacgagccucgggaaggcaguccaccagguuuuuggauccguguauaccacaauguucggcggugugucuuggaugaucagaauucugaucggguuucuuguauuguggauuggaacuaauagcaggaacaccucaauggccaugacaugcauagcugucggcgguaucacucuguuccucggcuuuaccgugcaggccgacaugggguguguugugaguugguccggacgugagcugaagugcggcagcgggauuuucgucguggauaauguucauacguggacagaacaauacaaauuucagcccgagucuccagcacggcuugcgucagcuauccugaacgcccacaaggacggaguguguggcauccgaaguaccacuagauuggagaauguaauguggaaacagauuacaaacgaacucaauuauguccugugggagggugggcacgacuuaaccgugguggcaggagaugucaagggcguucugacuaaagguaagagggcccuaaccccucccgugagcgaccucaaguacuccuggaaaacauggggcaaggcuaaaauauucacgccagaagcccgcaacucuaccuuucugaucgaugggcccgacacuucggagugcccuaaugaacggagagcauggaacagccuugagguagaggauuacggauucggcauguucacaaccaauauuuggaugaaguuuagggaaggguccucagaggugugugaccaucgcuugaugagugcugccaucaaagaucagaaggcgguccacgccgacaugggauauuggauugaaucuagcaaaaaccaaacauggcagaucgagcgagcuucccugauagaagugaagacuugccucuggccaaagacccauacgcuguggucaaauggcguuuuagagagccagaugcugaucccgaaaucuuacgcaggucccuucucccagcacaacuaucggcaaggguacgccacacagaccgugggaccuuggcaccuuggcaaguuggagauugauuuuggugaaugcccaggcacuaccgucacaauccaggaggacugugaucaucgugggcccagucucagaacuaccacagcuagcggaaaacuggugacgcaguggugcuguaggucuugcaccaugccuccacuacgcuuccugggcgaagacggguguugguauggaauggagauucggccccucuccgagaaggaagagaacaugguuaaaucacaagugacugccggccaggguacaagugaaaccuuuagcauggggcugcuuugcuugacucuguucgucgaggaauguuuaagaaggcgaguaacacgcaagcacaugauccucgcagugauaauuacccugugcgcgaucauucuuggaggccugacguggauggauuugcuccgggcccugaucaugcuaggcgacacuaugucggggagaauaggaggucagacccaucuggcuaucauggccguuuuuaagauguccccgggcuacgugcucggggucuuccugaggaaacuuacaucucgugagaccgcauugauggugauuggaauggcuaugacuacaacccugagcaucccucacgacuuaauggagcucauugauggcaucucacugggucuuauacugcuaaagauuguaacacaguuugacaauacucaaguggggacccucgcccugaguuugacguucauccgcuccacaaugucucuggucauggcauggcggaccaucauggccguuuuauuuguggugacucucauuccacuguguagaaccagcugccuucagaaacagucccauugggucgaaaucacagcucugauuuugggagcgcaagcccuccccguguaucugaugacucuaaugaagggcgcaucaaggcgaagcuggccucugaacgagggcauaauggcuguugggcuuguaagucuccugggaucugccuugcugaaaaaugaugugcccuuagccgguccaauggucgcuggcgggcuccugcuugcagccuacgugauguccggaagcucggcggaccugucauuggaaaaggcugccaacguucagugggaugagauggcagacaucaccggcucuaguccuauuaucgaagugaagcaggaugaggacgguuccuucagcauucgggaugucgaggaaacgaauaugaucacacuccuggugaaacuagcccugauaaccguaucugggcuuuacccccucgcuaucccagucacuaugacacugugguauauguggcaggugaagacccaacgcagcggagcauugugggacguuccguccccugccgcgacucagaaagcugccuuaucagagggcguguacagaauuaugcagaggggccuguuugggaagacacaggucggaguggguauccacauggaaggcguuuuccacaccauguggcaugugacgcgggggagugucauuugucacgagacuggacgacucgaacccagcugggcagaugugagaaacgacaugaucucuuauggcgguggguggcgccugggagauaaaugggacaaggaggaggacguacaagugcuugccauagaaccaggcaagaaucccaaacauguucagaccaagccuggccuguucaaaacauugaccggggagauuggagcugucacacuagauuuuaagccagguacuuccggcucacccaucaucaacaggaaagggaaggugauuggacuguacggcaaugguguggucaccaaaaguggggacuauguaagcgccauaacgcaggcagaacguaucggagagccugauuacgagguggacgaagauauuuuccggaagaagagacucacaaucauggaccugcacccgggcgcuggcaaaacuaagaggauucuuccauccaucguucgcgaggccuuaaaacgaagacugcggacccucauauuggcgcccacaaggguggucgccgcagaaauggaggaagcucugcgcgggcucccuauccguuaucagaccccagccgugaagucugagcauacuggaagagagauuguugaucugaugugccacgcuaccuuuacaacgcggcuucugucgagcacuagggugcccaacuacaauuugaucgucauggacgaagcacacuucaccgauccuucauccguggccgcccgcgguuacauuaguacacgaguagagaugggcgaagcugcggcaaucuuuaugaccgccacuccgcccggggcuacagacccauucccucaaucuaacagccccauagaggauauugaaagagagaucccagagcgguccuggaauaccggauuugacuggaucacggacuaucagggcaaaacugugugguucguuccuucaauuaaggccgguaacgauaucgcaaauugccuaaggaagucugggaaaaaggucauacagcugagccgcaaaacauuugacaccgaauaccccaagaccaaacucacugauugggacuucguggugacaaccgauauuagugagaugggcgccaacuuuagagcuggaagggucaucgacccacggcguuguuuaaagccgguuauucugacagauggcccugaacgcgugauccuugcggggcccauaccaguaacucccgccuccgcagcucaacgaagaggaaggauuggucggaacccugcccaggaggacgaucaguauguguucagcggcgacccacugaagaaugaugaagaccaugcacacuggacggaggccaaaaugcucuuggauaacaucuacacccccgaggggaucauuccuacacuguucggaccggaacgcgagaagacucaggcuaucgacggcgaauuuagacucaggggugagcaacggaaaaccuucgucgagcugaugcgaagaggggaccuuccaguguggcuaucuuauaagguugccucagcgggcauuuccuacaaagaucgcgaauggugcuuuacaggagagaggaauaaccagauacuggaagagaauauggaaguggagaucuggacccgggagggcgaaaagaagaaauugcgucccagaugguuagacgcaagggucuaugccgauccuauggcucugaaggacuucaaagaguuugccagugggcgcaagagcauuacucucgauauccugacggaaaucgcuucgcuucccaccuaccugucuucccgggcaaaacucgccuuggacaacauuguaaugcugcauacaacugagcgaggagguagagcuuaccagcacgcccuaaaugaacugccagagagccucgagacccuuaugcugguggcauuauugggcgcgaugacagccgggauauuccuguuuuucaugcagggaaagggcaucgguaagcucucaauggggcugauuaccaucgcuguugccaguggccuucuguggguggcagaaauucaaccucaguggaucgcugccucuauaauccucgaguuuuucuugaugguccuguuaauucccgaaccagagaaacagaggacuccucaggauaaccaacuaaucuaugugauucugacaauccucacgauaauuggacuuaucgcagccaaugaaaugggccugauugagaagaccaaaacugacuuuggguucuaccaggucaagacagagaccaccaucuuggauguggaccugcgcccggcuuccgcguggacacucuaugccguugcaacuacgauacugacccccaugcuucggcacacaaucgaaaacacuagcgcuaaucucucacuggccgccauugcaaaccaggcugccguguugaugggacugggcaaagguuggccauuacauagaauggaucuagggguaccucugcucgcgaugggauguuacagucaggugaaucccaccacacuuaccgcuagccuggucauguugcugguucacuaugccaucauuggcccaggucuccaagcaaaggccacucgugaggcucagaaaaggacggcagccggcaucaugaagaacccuacaguggacgggauaaccgucauugaucuggaacccaucuccuacgacccgaaguuugagaaacagcuuggacaagugauguuacugguacucugcgcgggccaguugcugcuaaugcggacuaccugggcuuucugugaggugcugacacucgccacugggccaauccuuacccugugggaaggaaauccuggccgcuucuggaacacaacgauugcaguuucuaccgccaacaucuuucgagguagcuauuuggcuggggccggacuggcauucucccucauaaagaaugcucagacucccagaaggggcacagguaccacuggcgagacacugggggaaaaauggaagcggcaguuaaacucacuugaccgcaaagaguuugaagaguacaagagaucuggaauucuggagguggauaggaccgaagccaagagugcgcucaaagacggcucgaagaucaaacaugccgucagccgaggguccucuaagauucgguggaucguggagcguggaauggucaaaccaaagggcaaggugguugaucuagguugcgggagaggaggcuggucauacuauauggcaacgcugaaaaauguaaccgaagugaagggcuacacaaaagggggacccggucacgaggaaccuauaccgauggcuacuuauggcuggaacuuggucaagcugcauagcgggguggacguuuucuacaaacccaccgagcaaguggauacacuccuuugugacaucggagaguccaguucuaauccaacuauugaagagggccgcacccugagggucuugaagaugguggaaccuuggcugagcucaaagcccgaguuuugcaucaaaguacucaacccuuauaugccaacagugauugaagaguuagagaagcugcagcggaaacacggugggaaucuuguuagauguccccugucccgcaacaguacccacgaaauguacugggucagcggagccucuggcaauaucguguccucagugaacacuacgagcaagaugcuacucaauagguucacaacccgacaucggaaaccuacuuaugagaaggaugucgaccugggcgcagggaccagaucgguuucuacagaaacggagaaaccagauaugaccauuaucggaaggcgcuugcagcgucugcaggaggaacacaaggagacuuggcauuacgaccaagaaaaccccuaccggacaugggcuuaucacgguaguuacgaggccccguccaccggcagcgccucauccauggugaaugggguagugaagcuccuuacuaaaccuugggaugucauaccaauggugacacagcuggcgaugaccgacacaacucccuuuggacagcagagaguuuucaaggaaaaaguggacaccaggacgccucaaccaaagcccggcacccgcauggucaugacaacuaccgcuaacugguuaugggcacuguuggguaaaaagaagaauccgcgacucugcacaaaagaggaguuuauuucuaaggugcggagcaacgccgcuaucggggccguauuccaggaagagcagggauggacuagugcauccgaagccguuaaugauagcagauuuugggagcugguggacaaagaaagggcucuacaccaagagggcaagugugagucuugcgucuauaacaugaugggcaaacgcgaaaagaagcuuggggaguucggaagagcgaaagguucacgggccaucugguacauguggcugggcgcaagguuucucgaauucgaggcucugggguucuugaacgaagaucauugguuuggacgugagaauaguugguccggcguggagggugaagggcugcaccgacucggauauauucuugaggaaauagacaagaaagauggcgaccugauguacgccgaugacaccgcaggcugggauacgcgcaucacagaggacgauuuacagaacgaggaacugauuaccgagcagauggccccucaucacaagaucuuggcuaaagccauuuucaagcucacuuaucagaauaagguggucaaaguucugagacccacaccacggggggcggugauggacaucauaagcaggaaggaucaacgcggaucuggucagguaggcaccuacgggcuaaacacuuuuaccaauauggaagugcagcuuaucagacagauggaggcagaaggagucauuacacaagacgacaugcagaacccuaaaggccugaaggagcggguggagaaauggcucagggaaugcgguguugaucgacugaagcguauggccaucucgggggacgauuguguggucaaacccuuggacgagagauucggaacgucauuacuguuucucaaugauaugggcaaggugcgcaaggacauuccacagugggaacccagcaaaggcuggaagaacuggcaggagguaccuuucugcucccaucacuuucacaaaaucuucaugaaggaugggcggagucuuguugugccauguaggaaucaagacgaacugauaggaagagcucgcauuucucagggugccggcuggagccuacgggagaccgcaugccuggggaaagcuuacgcccagauguggucccucauguauuuucauaggcgagauuugagacuggcuucaauggccaucuguagugcagucccgacugagugguuccccacaucucggaccacuuggagcauccacgcgcaucaccaguggaugacaaccgaagacaugcuuaagguguggaacaggguuuggauugaggauaauccuaacaugacggacaagacaccaauacacuccugggaagacauccccuaccugggaaaacgcgaggaucucuggugcggcucauuaauuggucugagcucucgugccaccugggcuaagaauauccauacugccauuacccaagugagaaacuugaucgggaaagaagaguaugucgacuacaugccugugaugaagcgauauuccgcaccaagugagagcgaaggaguacuguga

SEQ ID NO: 15732 - RNA, 9867 nt, Artificial Sequence
  derived and/or modified CDS sequence (opt3) from DENV-4__FJ639742__SS-prME
ucaaccaugacacugcucugccuuauccccacugccauggcuuuccaccuguccacgagagacggagaaccuuugaugauuguggcaaagcaugaaagggggcggccauuacuguuuaaaaccacagagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacaacggguggagucguggauccugcgcaauccaggguucgcccugcucgcuggauuuauggcauacauggucggccagacuggcauucagagaaccguguucuuuguuuuaaugaugcugguggcccccucauaugggaugaggugugucggaguggguaaccgggauuucguagaaggcguuagcgggggagcuuggguggaccuugucuuggagcacggcgguugcgugacaaccauggcccaggggaagccuacgcuggauuuugaacuaacuaagacaaccgcgaaagagguggcacuccugcgcacuuacuguaucgaagcccuuauaaguaauaucacaaccgcuacgcgaugcccaacccaaggagagcccuaucugaaggaggaacaggaccagcaguacauuuguagaagggaugucguugaccggggcuggggcaacgggugcggauuguucgguaaaggcggggugguaacaugcgccaaguuuuccuguucuggaaaaaucacuggcaaucucgugcaaauugagaaccuggaauauaccgucgugguuacagugcauaauggugauacucacgcagucgggaacgacaccagcaaucacggcgugacagcuaccaucacuccucguuccccaucaguagagguuaaguuaccggauuacggagaacugacgcucgacugcgagccccgcaguggcauagacuucaacgagaugauucuuaugaagaugaaaaagaaaacauggcuggugcauaagcagugguuuuuggaucuaccucugccauggaccgccggggcggacacuagcgaaguccacuggaauuacaaagagagaauggugaccuucaaggucccccaugccaaaaggcaggaugugacaguucucggaucucaggaaggugcaaugcacuccgcucuggccggcgcuaccgagguggacucaggggauggaaaccacauguuugccggccaucuuaaguguaagguacggauggaaaaacugcgaaucaaggguaugagcuauacuaugugcagugggaaauucucuauugacaaggagauggcagagacacaacacggcacgaccgucgugaaaguuaaguacgaaggagccggcgcuccuuguaaggugccaaucgagauccgcgaugucaauaaagaaaaggugguagggagagugauuuccagcacucccuuggcggagaacacaaacucgguuaccaauauagagcucgaaccgccuuucggagacucuuauaucgucauuggugugggcaacuccgcacugacauuacauugguuuaggaaagggucaaguaucggaaagauguucgagagcacuuaccggggcgccaaacgcauggcuauacugggugaaaccgccugggauuuuggguccgugggcggacuauucacgucucucggcaaggcaguccaccagguuuuugggagcguguauaccacaauguucggaggcgugucauggaugauuagaauccugaucgguuuucuuguauuguggauugggacuaauaguaggaacaccuccauggccaugacaugcaucgcugucggaggcauuacucuguuccucgguuuuaccgugcaggccgacaugggcuguguugugagcuggucugggcgugagcugaagugcggaucaggcauauucgucguggauaauguucauacguggacagaacaauacaaauuucagcccgagaguccagcacggcuugcgagcgcuauccugaacgcccacaaggacgggguguguggcauucgauccaccacuagauuggagaauguaauguggaaacagaucacaaacgaacucaauuauguccugugggagggcggucacgacuuaaccgugguggcaggggaugucaagggaguucugacuaaaggcaagagggcccuaaccccucccgugucugaccucaaguacucguggaaaacaugggguaaggcuaaaaucuucacgccagaagcccgcaacagcaccuuucugauugauggccccgacacuuccgagugcccuaaugaacggagagcauggaacucacuugagguagaggauuacggguucggaauguucacaaccaauauauggaugaaguuuagggaaggcaguucugaggugugugaccaucgcuugaugagcgcugccaucaaagaucagaaggcgguccacgccgacaugggguauuggauugaauccagcaagaaccaaacauggcagaucgagcgagcuagccugauugaagugaagacuugccucuggccaaagacccauacgcuguggucuaauggaguuuuagagucccagaugcugaucccgaaaaguuacgcaggccccuucagccagcacaacuaucggcaagguuacgccacacagaccguggggccuuggcaccuuggaaaguuggagauagauuuuggcgaaugcccagguacuaccgucacaauccaggaggacugugaucaucguggccccucucucagaacuaccacagcuuccgggaaacuggugacgcaguggugcuguaggucaugcaccaugccuccacuacgcuuccugggagaagacggcuguugguaugggauggagauucggccccucagugagaaggaagagaacaugguuaaaagccaagugacugccggacagggcacaucggaaaccuuuuccaugggucugcuuugcuugacucuguucgucgaggaauguuuaagaaggcgaguaacacgcaagcacaugauccucgcagugguuauuacccugugcgcgaucauacuugggggacugacguggauggauuugcuccgggcccugauuaugcuaggcgacacuaugucuggcagaaucgggggacagacccaucuggcuauuauggccguguuuaagaugagcccggguuacguccucggcguguuccugaggaaacuuacaucacgugagaccgcauugaugguaaucgggauggcuaugacuacaacccugaguauaccucacgacuuaauggagcucaucgauggaauuucccugggccuuauccugcuaaagauugugacacaguuugacaauacucaagucgguacccucgcccugucuuugacguucauccgcagcacaaugucccugguuauggcauggcggaccauaauggccguguuauuuguggucacucucauuccacuguguagaaccucaugccuucagaaacagagccauuggguggaaaucacagcucugaucuugggggcgcaagcccuccccguuuaucugaugacucuaaugaagggagcaaguaggcgaucuuggccucugaacgagggcauuauggcuguaggccuugugucccuccuggggagcgccuugcugaaaaaugauguccccuuagccggaccaaugguggcugguggccuccugcuugcagccuacguuaugucggggucaucugcggaccugaguuuggaaaaggcugccuccgugcagugggaugagauggcagacaucaccggaagcucuccuauuauagaagucaagcaggaugaggacggcagcuucuccauccgggauguggaggaaacgaacaugauuacacuccugguaaaacuagcccugaucaccgucucaggucuuuacccccucgcuauuccagugacuaugacacugugguauauguggcagguuaagacccaacgcaguggggcauugugggacgugccgagcccugccgcgacucagaaagcugccuuaucugagggagucuacagaaucaugcagaggggccuguuuggcaagacacagguggggguuggaauacacauggaagguguguuccacaccauguggcaugucacgcggggcuccgugaucugucacgagacugggcgacucgaacccucaugggcagauguaagaaaugacaugauuaguuauggaggcgguuggcgccugggggauaaaugggacaaggaggaggacgugcaaguucuugccaucgaaccaggaaagaaccccaaacauguccagaccaagccuggccuguucaaaacauugaccggcgagauuggggcugugacacuagauuuuaagccaggaacuagcgguucccccaucauaaauaggaaaggcaaggugauugggcuguacggaaacggcgucguaaccaaaucuggugacuaugugucggccaucacgcaggcagaacguaucggggagccugauuacgagguugacgaagauauuuuccggaagaagagacucacaauaauggaccugcacccgggagcuggcaaaacuaagaggauccuuccaagcauugugcgcgaggccuuaaaacgaagacugcggacccucaucuuggcgcccacaagggucguggccgcagaaauggaggaagcucugcgcggccucccuauucguuaucagaccccagccguuaagucagagcauacugggagagagaucguggaucugaugugccacgcuaccuuuacaacgcggcuucuguccaguacuaggguccccaauuacaacuugauagugauggacgaagcacacuucaccgauccuucuagcguagccgcccgcggauacaucuccacacgaguggagaugggugaagcugcggcaauuuuuaugaccgccacuccgcccggcgcuacagacccauucccucaaucaaauucucccaucgaggauauugaaagagagaucccagagcggagcuggaacaccggguuugacuggauaacggacuaucagggaaaaacuguuugguucgucccuaguauuaaggccggcaaugauaucgcaaacugccuaaggaaguccgguaaaaaggugauccagcugagccgcaaaacauuugacaccgaauaccccaagaccaaacucacugauugggacuucguggucacaaccgauauuucugagaugggggccaauuuuagagcuggcaggguuaucgacccacggcguuguuuaaagccggugauacugacagauggaccugaacgcguaauucuugcgggccccaucccagugacucccgccucagcagcucaacgaagagggaggauuggacggaacccugcccaggaggacgaucaguaugucuucuccggugacccacugaagaacgaugaagaccaugcacacuggacggaggccaaaaugcucuuggauaauaucuacacccccgagggcauaauuccuacacuguucgggccggaacgcgagaagacucaggcuaucgacggagaauuuagacucaggggcgagcaacggaaaaccuucguggagcugaugcgaagaggugaccuuccaguuuggcuaaguuauaagguggccagcgcggggaucucguacaaagaucgcgaauggugcuuuacaggcgagaggaacaaucagauucuggaagagaacauggaagucgagaucuggacccgggagggagaaaagaagaaauugcgucccagaugguuagacgcaaggguauaugccgauccuauggcucugaaggacuucaaagaguuugccucuggccgcaaguccauuacucucgauauacugacggaaaucgcuagccuucccaccuaccugucaagucgggcaaaacucgccuuggacaauauugugaugcugcauacaacugagcgagggggcagagcuuaccagcacgcccuaaacgaacugccagagucucucgagacccuuaugcugguugcauuauugggugcgaugacagccggcaucuuccuguuuuucaugcaggggaagggaaucggcaagcucuccaugggucugauuaccauagcuguggccagcgggcuucugugggucgcagaaauccaaccucaguggauugcugccucaaucauucucgaguuuuucuugauggugcuguuaauccccgaaccagagaaacagaggacuccucaggauaaucaacuaauauaugucauccugacaauucucacgaucauuggccuuaucgcagccaacgaaaugggacugauagagaagaccaaaacugacuuuggcuucuaccaggugaagacagagaccaccauuuuggauguugaccugcgcccggcuagugcguggacacucuaugccguggcaacuacgauccugacccccaugcuucggcacacaauugaaaauacuagcgcuaaccucucccuggccgccaucgcaaaucaggcugccguauugauggggcugggaaaaggcuggccauuacauagaauggaucuaggugugccucugcucgcgaugggguguuacucucaggucaaccccaccacacuuaccgcuagccugguuauguugcuggugcacuaugccauaaucggaccaggccuccaagcaaaggccacucgugaggcucagaaaaggacggcagccgguauuaugaagaauccuacagucgacggcaucaccgugauugaucuggaacccaucuccuacgacccgaaguuugagaaacagcuugggcaaguaauguuacuggugcucugcgcgggacaguugcugcuaaugcggacuaccugggcuuucugugagguucugacacucgccacuggcccaauacuuacccugugggaagggaacccuggacgcuucuggaauacaacgauugcagugucaaccgccaacaucuuucgaggcucuuauuuggcuggugccgggcuggcauucagucucaucaagaacgcucagacucccagaaggggaacaggcaccacuggugagacacugggcgaaaaauggaagcggcaguuaaauucgcuugaccgcaaagaguuugaagaguacaagagaagcgggauucuggaggucgauaggaccgaagccaaguccgcgcucaaagacggaucuaagaucaaacaugccgugucacgaggcagcuccaagauacgguggauugucgagcgugggauggugaaaccaaagggaaagguuguagaucuaggcugcgguagagggggauggaguuacuauauggcaacgcugaaaaacgugaccgaagucaagggcuacacaaaaggcgggcccggacacgaggaaccuaucccgauggcuacuuaugguuggaauuuggugaagcugcauucuggcguugacguguucuacaaacccaccgagcaagucgauacacuccuuugugacauuggggagagcucauccaacccaacuaucgaagagggacgcacccugaggguguugaagaugguagaaccuuggcugaguagcaagcccgaguuuugcauaaaagugcucaauccuuauaugccaacaguuaucgaagaguuagagaagcugcagcggaaacacggcgguaaccuugucagauguccccugucucgcaauuccacccacgaaauguacugggugucaggggccagcggaaacauugugucgucugucaauacuacgaguaagaugcuacucaacagguucacaacccgacaucggaaaccuacuuaugagaaggauguugaccugggcgcaggcaccagauccgugagcacagaaacggagaaaccagauaugaccaucauugggaggcgcuugcagcgucugcaggaggaacacaaggagacuuggcauuacgaccaagaaaaucccuaccggacaugggcuuaucacggaucauacgaggccccguccaccgguucugccagcaguaugguaaacggcguggucaagcuccuuacuaaaccuugggaugugaucccaaugguuacacagcuggcgaugaccgacacaacucccuuugggcagcagagaguguucaaggaaaaagucgacaccaggacgccucaaccaaagcccggaacccgcauggugaugacaacuaccgcuaauugguuaugggcacuguugggcaaaaagaagaacccgcgacucugcacacgggaggaguuuauuuccaaaguaagaagcaaugccgcuaucggugccguuuuccaggaagaacagggguggacuucugcaucagaagccgugaacgauaguagguuuugggagcuggucgacaaggaacgcgcucuacaccaagagggaaaaugugaguccugcguguauaauaugaugggcaagagagagaagaaacuuggcgaguucgggcgggcgaaaggaagcagggccauaugguacauguggcugggugcacguuuucucgaguucgaggcucugggcuucuugaacgaagaucauugguuugggcgagagaacucuuggucgggaguggagggcgaaggucugcaccgccucggguauauucuugaggaaaucgacaaaaaggauggagaccugauguacgccgaugacaccgcaggcugggauacgagaaucacagaggacgauuuacagaaugaggaacugauuaccgagcagauggccccucaucacaaaauauuggcuaaggccaucuucaaacucacuuaucagaacaaggucguuaaggugcugcggcccacaccaaggggcgcgguaauggacauuaucucacgcaaagaucaaagagggagcggacagguggguaccuacggccuaaauacuuuuaccaacauggaaguccagcuuauucggcagauggaggcagaaggggugaucacacaagacgacaugcagaauccuaagggacugaaagagaggguugagaaguggcuccgagaaugcggcguggaucgucugaaaagaauggccauauccggugacgauugugucgugaagcccuuggacgagcgcuucgggacgaguuuacuguuucucaacgauaugggaaaaguacggaaggacaucccacagugggaacccucuaagggcuggaaaaauuggcaggagguuccuuucugcagccaucacuuucacaagauuuucaugaaagauggcaggucccuuguggucccauguagaaaccaagacgaacugaucgggcgcgcucggauuucacagggagccgguuggagucuaagggagaccgcaugccugggcaaggcuuacgcccagauguggucucucauguauuuucaucgaagagauuugcggcuggcuagcauggccaucuguuccgcagugccgacugagugguuccccacaucaaggaccacuuggagcauacacgcgcaucaccaguggaugacaaccgaagacaugcuuaaaguuuggaaucgcguguggauugaggauaacccuaauaugaucgacaagacgccaguccacucuugggaagacauccccuaccuggggaagcgugaggaucucuggugcggauccuuaauuggccugaguagcagagccacaugggcuaaaaacauacauaccgccaucacucaagugcgaaauuugauugguaaggaagaguauguagacuacaugccugugaugaaaagguauucggcaccauccgagucugaagggguccuguga

SEQ ID NO: 15733 - RNA, 9867 nt, Artificial Sequence
  derived and/or modified CDS sequence (opt3) from DENV-4__FJ639745__SS-prME
agcaccaugacacugcucugccuuauccccacugccauggcuuuccaccuguccacgagagacggcgagccuuugaugauuguggcaaagcaugaaagggggcggccauuacuguuuaaaaccacagagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggcaccugcacgcagucaggggagcgccgacgugaaaagagaaguguagcguugacuccucacagcggaaugggccucgagaccagggcugaaacauggauguccucugagggugccuggaaacaugcacaacggguggagucguggauccugcgcaauccaggguucgcccugcucgcuggauuuauggcauacaugauuggccagacuggcauccagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguauagaagcccuuaucaguaauauuacaaccgcuacgcgaugcccaacccaaggagagcccuaucugaaggaggaacaggaccagcaguacaucuguagaagggauguggucgaccggggcuggggcaacgggugcggauuguucgguaaaggcgggguugugacaugcgccaaguuuuccuguucuggaaaaauuacuggcaaucucguacaaaucgagaaccuggaauauaccguggucgugacaguucauaauggugauacucacgcaguggggaacgacaccagcaaucacggcgucacagcuaccauaacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgccggggcggacacuagcgaagugcacuggaauuacaaagagagaauggucaccuucaaggugccccaugccaaaaggcaggaugucacagugcucggaucucaggaaggugcaaugcacuccgcucuggccggcgcuaccgagguugacucaggggauggaaaccacauguuugccggccaucuuaaguguaaggugcggauggaaaaacugcgaauuaaggguaugagcuauacuaugugcagugggaaauucucuaucgacaaggagauggcagagacacaacacggcacgaccguagucaaagugaaguacgaaggagccggcgcuccuuguaagguuccaaucgagauucgcgaugugaauaaagaaaaggucguggggagaguaauauccagcacucccuuggcggagaacacaaacucggugaccaauaucgagcucgaaccgccuuucggagacucuuauauuguuaucggugucggcaacuccgcacugacauuacauugguuuaggaaagggucaaguauaggaaagauguucgagagcacuuaccggggcgccaaacgcauggcuauucugggugaaaccgccugggauuuuggguccgugggcggacuauucacgucucucggcaaggcagugcaccaggucuuugggagcguuuauaccacaauguucggaggcgugucauggaugaucagaauccugauuggucuuuuggugcuguggaucgggacuaauaguaggaacaccuccauggccaugacaugcauugcuguaggaggcauaacucucuuucuggguuucaccguccaggccgacaugggcugugugguuagcuggucugggcgugagcuuaagugcggaucaggcaucuuuguggucgauaaugugcauacguggacagaacaauacaaauuccagcccgagaguccagcacggcuggcgagcgcuauuuugaacgcccacaaggacgggguuuguggaauccgauccaccacuagacucgagaaugugauguggaaacagaucacaaacgaacugaauuauguauuaugggagggcggucacgaccugaccgucguggcaggggaugugaagggaguccuaacuaaaggcaagagggcccucaccccucccguuucugaccugaaguacucguggaaaacaugggguaaggcuaaaauuuuuacgccagaagcccgcaacagcaccuuccuuauagauggccccgacacuuccgagugcccuaaugaacggagagcauggaacucauuggagguggaggauuacggguuuggaauguucacaaccaauaucuggaugaaguucagggaaggcaguucugagguaugugaccaucgccugaugagcgcugccauuaaagaucagaaggcggugcacgccgacaugggguauuggaucgaauccucaaaaaaccaaacauggcagauugagcgagcuagccucaucgaagucaagacuugccuguggccaaagacccauacguuauggucuaauggagugcuggagucccagaugcuuauaccgaaaaguuacgcaggccccuuuagccagcacaacuaucggcaagguuacgccacacagaccguugggccuuggcacuugggaaagcucgagaucgauuucggcgaaugcccagguacuaccgugacaauucaggaggacugugaucaucguggccccucucugagaacuaccacagcuuccgggaaacuagucacgcaguggugcuguaggucaugcaccaugccuccacugcgcuuucucggagaagacggcuguugguaugggauggagauccggccccugagugagaaggaagagaacauggugaaaagccaaguuacugccggacagggcacaucggaaaccuucuccaugggucuuuugugccugacuuuauuuguggaggaaugucucagaaggcgagucacacgcaagcacaugauucuggcaguagugaucacccuuugcgcgauaauucuggggggauugacguggauggaucuccugcgggcccuaaucaugcugggcgacacuaugucuggcagaauugggggacagacccaucucgcuaucauggccguuuucaagaugagcccggguuacgugcugggcgucuuucuuaggaaauugacaucacgugagaccgcacugauggugauagggauggcuaugacuacaaccuuaaguaucccucacgaccucauggagcugauugauggaaucucccuuggccugauucuacucaagaucguaacacaguucgacaauacucaaguggguacccuggccuugucucugacguuuauacgcagcacaauguccuuagucauggcauggcggaccauuauggccguucucuucguggugacucugaucccacuuuguagaaccucaugccugcagaaacagagccauugggucgaaaucacagcuuugauucucggggcgcaagcccugcccguguaucuaaugacucugaugaagggagcaaguaggcgaucuuggccucuuaacgagggcaucauggcuguuggccucguaucccuguuggggagcgcccuguuaaaaaaugaugugccccucgccggaccaauggucgcugguggccugcuucuggcagccuacgugaugucggggucaucugcggacuugagucucgaaaaggcugccaacguucagugggaugagauggcagacauuaccggauccagcccuauaaucgaagugaagcaggaugaggacggcucuuuuagcauucgggaugucgaggaaacgaauaugaucacacugcuagugaaacuggcccuuauuaccguauccggucucuacccccuggcuaucccagucacuaugacauugugguauauguggcaggugaagacccaacgcucaggggcauuaugggacguuccgaguccugccgcgacucagaaagcugcccugagcgagggaguguacagaauaaugcagaggggccucuucggcaagacacaggucggggugggaauccacauggaagguguuuuucacaccauguggcaugugacgcggggcucugucauuugucacgagacugggcgacuggaacccuccugggcagaugugagaaacgacaugaucucauauggaggcgguuggcgccuuggggauaaaugggacaaggaggaggacguacaagugcuggccauugaaccaggaaagaaucccaaacauguucagaccaagccuggcuuguucaaaacacuaaccggcgagaucggggcugucacacuggauuucaagccaggaacuagugguagccccauaauuaacaggaaaggcaaggugaucgggcucuacggaaauggcguggucaccaaauccggugacuauguaucugccaucacgcaggcagaacguauuggggagccugauuacgagguggacgaagauauauuucggaagaagagacugacaaucauggaccuucacccgggagcuggcaaaacuaagaggauuuuaccaucgaucguucgcgaggcccugaaacgaagacuccggaccuugauucuggcgcccacaaggguggucgccgcagaaauggaggaagcucuccgcggccugccuauccguuaucagaccccagccgugaagagcgagcauacugggagagagauaguugaucuuaugugccacgcuaccuucacaacgcggcuguugucauccacuagggugcccaacuacaaucuaaucgucauggacgaagcacacuuuaccgauccuaguucuguggccgcccgcggauacauuagcacacgaguagagaugggugaagcugcggcaaucuucaugaccgccacuccgcccggcgcuacagacccauuuccucaauccaacucacccauugaggauaucgaaagagagauaccagagcggucuuggaauaccggguucgacuggauuacggacuaucagggaaaaacugugugguuuguuccuagcaucaaggccggcaacgauaucgcaaauugccugaggaagagugguaaaaaggucauucagcucucccgcaaaacauucgacaccgaauaccccaagaccaaauuaacugauugggacuuuguggugacaaccgauaucagcgagaugggggccaacuucagagcuggcagggucauagacccacggcguugucugaagccgguuauucuuacagauggaccugaacgcgugauccuggcgggccccauuccaguaacucccgccucugcagcucaacgaagagggaggaucggacggaacccugcccaggaggacgaucaguauguguuuucaggugacccacucaagaaugaugaagaccaugcacacuggacggaggccaaaauguugcuggauaacauauacacccccgagggcauuaucccuacacucuucgggccggaacgcgagaagacucaggcuaucgacggagaauucagacugaggggcgagcaacggaaaaccuuugucgagcuuaugcgaagaggugaccuaccaguguggcuguccuauaagguugccagugcggggauuagcuacaaagaucgcgaauggugcuucacaggcgagaggaauaaccagaucuuggaagagaauauggaaguggagauuuggacccgggagggagaaaagaagaaauuacgucccagauggcuggacgcaagggucuaugccgauccuauggcucucaaggacuuuaaagaguucgccucgggccgcaagucuauaacucuggauauccuuacggaaauugcuucccugcccaccuaccucagcucacgggcaaaauuggcccuggacaacaucguaaugcuacauacaacugagcgagggggaagagcuuaccagcacgcccugaaugaacucccagagagucuugagacccugauguuaguggcauugcugggugcgaugacagccggcaucuuucucuucuuuaugcaggggaagggaauuggcaagcugucuaugggucuuauaaccaucgcuguugccuccgggcugcucuggguggcagaaauucaaccucaguggaucgcugccagcauuaucuuggaguucuuucugauggucuuacuaauacccgaaccagagaaacagaggacuccucaggauaaccaacugaucuaugugauucucacaauccuuacgauuaucggccugauagcagccaaugaaaugggauugauugagaagaccaaaacugacuucggcuuuuaccaggucaagacagagaccaccauccuggauguggaccuccgcccggcuucagcguggacacuguaugccguugcaacuacgauucuuacccccaugcuccggcacacaaucgaaaacacuagugcuaaucugagcuuggccgccauagcaaaccaggcugccgugcugaugggguuaggaaaaggcuggccacuacauagaauggaucuggguguaccucuccuugcgaugggguguuacucccaggugaaucccaccacacugaccgcuucuuuggucaugcugcucguucacuaugccaucauuggaccaggccugcaagcaaaggccacucgugaggcucagaaaaggacggcagccgguaucaugaagaacccuacaguggacggcauuaccgucaucgaucuugaacccauaagcuacgacccgaaguucgagaaacaguuagggcaagugaugcugcucguauugugcgcgggacagcugcuacugaugcggacuaccugggcuuuuugugaggugcucacacuugccacuggcccaauucugaccuugugggaagggaauccuggacgcuucuggaacacaacgaucgcaguuuccaccgccaacaucuuccgaggcucauaucuggcuggugccgggcucgcauuuucucugauuaagaaugcucagacucccagaaggggaacaggcaccacuggugagacauuaggcgaaaaauggaagcggcagcuuaacagucuggaccgcaaagaguucgaagaguacaagagaucggggauccucgagguggauaggaccgaagccaagagcgcgcuaaaagacggauccaagauaaaacaugccgucucucgaggcucaagcaagauucgguggaucguggagcgugggauggucaaaccaaagggaaaggugguugaucugggcugcgguagagggggaugguccuacuauauggcaacguugaaaaauguaaccgaagugaagggcuacacaaaaggcgggcccggacacgaggaaccuauuccgauggcuacuuaugguuggaaccuggucaagcuccauaguggcguggacguuuuuuacaaacccaccgagcaaguggauacacuucugugugacaucggggagucuagcucaaauccaacuauagaagagggacgcaccuugaggguccugaagaugguggaaccuuggcucuccaguaagcccgaguucugcaucaaaguauuaaacccuuauaugccaacagugauugaagagcuggagaagcuucagcggaaacacggcgguaaucugguuagauguccccuaagccgcaacucuacccacgaaauguacugggucuccggggccucaggaaauaucgugagcucggugaacacuacgucuaagaugcuccugaauagguuuacaacccgacaucggaaaccuacuuaugagaaggaugucgacuugggcgcaggcaccagaaguguuuccacagaaacggagaaaccagauaugaccauuaucgggaggcgccugcagcgucuccaggaggaacacaaggagacuuggcauuacgaccaagaaaaccccuaccggacaugggcuuaucacggaagcuacgaggccccgucaaccgguuccgccucuagcauggugaauggcguagugaagcuucugacuaaaccuugggaugucauuccaauggugacacaguuagcgaugaccgacacaacucccuucgggcagcagagaguuuuuaaggaaaaaguggacaccaggacgccucaaccaaagcccggaacccgcauggucaugacaacuaccgcuaacuggcugugggcauugcucggcaaaaagaagaauccgcgacugugcacacgggaggaguucaucaguaaagugagauccaacgccgcuauaggugccguauuucaggaagagcagggguggacuagcgcaucugaagccguuaaugauucaagguucugggagcuaguggacaaggaacgcgcucuucaccaagagggaaaaugugagaguugcgucuauaacaugaugggcaagagagaaaaaaagcugggcgaguuugggcgggcgaagggauccagggccauuugguacauguggcucggugcacguuuccuggaauuugaggcuuugggcuuccugaacgaagaucauugguucgggcgagagaauagcuggucuggaguggagggcgaaggucuccaccgccuuggguauauccuggaggaaaucgacaaaaaggauggagacuuaauguacgccgaugacaccgcaggcugggauacgagaauuacagaggacgaucugcagaacgaggaauugauaaccgagcagauggccccucaucacaaaauccucgcuaaggccauuuuuaaacugacuuaucagaauaagguggucaagguucuacggcccacaccaaggggcgcggugauggacaucauuucgcgcaaagaucaaagagggucaggacagguagguaccuacggccuuaacacuuucaccaauauggaagugcagcugauccggcagauggaggcagaaggggucauaacacaagacgacaugcagaacccuaagggacucaaagagaggguggagaaguggcugcgagaaugcggcguugaucguuugaaaagaauggccaucagcggugacgauuguguggucaagcccuuagacgagcgcuuugcuacgucccugcucuuccuuaaugauauggggaaagugcggaaggacauuccacagugggaacccaguaagggauggaaaaacuggcaggagguaccuuuuugcucucaucacuuccacaagaucuuuaugaaagauggcaggagccugguugugccauguagaaaucaagacgaacuaauuggccgcgcccggaucucccagggggcaggauggucacugagggagaccgcuugccucgguaaggccuacgcucagauguggaguuugauguauuuccaucgaagagaucugcggcuugccucuauggcaauauguagcgcggucccgacugagugguuucccacauccaggaccacuuggucaauucacgcccaucaccaguggaugacaaccgaagacaugcugaaaguguggaaccgcguuuggaucgaggauaauccuaacaugaucgacaagacgccagugcacagcugggaagacauucccuaccucggcaagcgugaggauuuauggugcgggucucugauaggauuguccaguagagcuacaugggccaaaaauauccauaccgcaauuacucaaguccgaaaccugaucggcaaggaagaguauguggacuacaugccuguaaugaaaagguauagcgcuccaucggaguccgaaggugugcucuga

SEQ ID NO: 15734 - RNA, 9867 nt, Artificial Sequence
  derived and/or modified CDS sequence (opt3) from DENV-4__FJ850095__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggaggacugugaucaucguggccccagcuugagaaccacaacggcuucugggaaacucgucacccaguggugcuguagguccugcacuaugccuccacugcgcuuucuaggagaagacggcuguugguaugggauggagauucggccccugucagagaaggaagagaacauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaucuguugcgggcccucauuaugcugggcgacaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgauggaauuagucucggccugauccuucugaagauaguaacucaguucgacaauacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaacgagggcauuauggcuguuggccugguaucucuucucggguccgcccuguugaaaaaugaugugccccuggccggaccaauggucgcugguggcuuacuccuggcagccuacgugaugagcgggucgucagcggaccuuucucuggaaaaggcugccaacguucagugggaugagauggcagacauaacgggaaguuccccuaucauugaagugaagcaggaugaggacggcagcuuuucuauccgggaugucgaggaaacaaauaugauuaccuugcucgugaaacuggcccuaaucacuguaagcggucuguacccccuugcuauaccagucacaaugacccucugguauauguggcaggugaagacucaacgcuccggggcacugugggacguuccgucaccugccgcgacacagaaagcugccuugagugagggaguguacagaaucaugcagaggggcuuauucggcaagacccaggucggggugggaauucacauggaagguguuuuccacacgauguggcaugugacucggggcagcgucaucugucacgagaccgggcgacuggaacccucuugggcagaugugagaaacgacaugauuuccuauggaggcgguuggcgccucggggauaaaugggacaaggaggaggacguacaagugcuggccaucgaaccaggaaagaaucccaaacauguucagacaaagccuggccuuuuuaaaacccugacaggcgagauaggggcugucacuuuggauuucaagccaggaaccucagguagucccauuaucaacaggaaaggcaaggugaucgggcuauacggaaauggcguggucacgaaaagcggugacuauguauccgccauuacacaggcagaacguauaggggagccugauuacgagguggacgaagauaucuuucggaagaagagacugacuauuauggaccuccacccgggagcuggcaaaaccaagaggauccugccaucuauuguucgcgaggcccuuaaacgaagauuacggacacugauccucgcgcccaccaggguggucgccgcagaaauggaggaagcuuugcgcggccugccuauacguuaucagacuccagccgugaagucggagcauaccgggagagagaucguugaucucaugugccacgcuacauucacgacucggcugcuuagcucaaccagggugcccaacuacaaucugauugucauggacgaagcacacuuuacagauccuuccaguguggccgcccgcggauacaucucuacccgaguagagaugggugaagcugcggcaauuuucaugacugccacaccgcccggcgcuaccgacccauuuccucaaagcaacucccccaucgaggauauagaaagagagauuccagagcggucauggaauacgggguucgacuggaucacugacuaucagggaaaaacagugugguuuguuccuucuaucaaggccggcaacgauauugcaaauugcuugaggaagagcgguaaaaaggucauccagcuaagucgcaaaaccuucgacaccgaauaccccaagacuaaacugacagauugggacuuuguggugaccacagauauauccgagaugggggccaacuucagagcuggcagggucauugacccacggcguugucucaagccgguuaucuuaacugauggaccugaacgcgugauucuggcgggccccaucccaguaacgcccgccagcgcagcucaacgaagagggaggauaggacggaacccugcccaggaggacgaucaguauguguucucuggugacccacuuaagaaugaugaagaccaugcacacuggaccgaggccaaaaugcugcucgauaacauuuacacacccgagggcaucaucccuacuuuguuugggccggaacgcgagaagacccaggcuauugacggagaauucagacugaggggcgagcaacggaaaacauuugucgagcucaugcgaagaggugaccugccaguguggcuuucauauaagguugccuccgcggggaucaguuacaaagaucgcgaauggugcuucaccggcgagaggaauaaccagauucuagaagagaauauggaaguggagauauggacucgggagggagaaaagaagaaacugcgucccaagugguuggacgcaagagucuaugccgauccuauggcuuuaaaagacuuuaaggaguucgccagcggcaggaaaucgaucacgcuggauauucucaccgaaaucgcuucucugcccacauaccuuuccagccgcgcaaagcuggcccucgacaacaucguaauguugcauacuaccgagcgggggggacgagcuuaccagcacgcccugaaugaacuaccagagucacuggagacacucaugcuuguggcacuguuaggugcgaugaccgccggcauuuuuuuguucuuuaugcaggggaagggaauaggcaaacugaguaugggucucaucacuauugcuguugccucugggcugcuuuggguggcagaaauccaaccucaguggauugcugccuccaucauacuggaguucuuucucauggucuugcugauccccgaaccagagaagcagagaacaccucaggauaaccaauuaauuuaugugauccuaacgauucugaccaucauaggccucauugcagccaaugaaaugggacuuaucgagaaaacuaagacagacuucggcuuuuaccaggucaaaaccgagaccacaauucuggauguggacuugaggccggcuagcgcguggacucuguaugccguugcaacgaccauccucacacccaugcugcgccacacuauagaaaacaccucagcuaaucuuagucucgccgccaucgcaaaccaggcugccgugcugaugggguugggaaagggcuggccacugcaucggauggauuuagguguaccucuacuggcgaugggguguuacagccaggugaaucccacaacccucacugcuucccuugucaugcuguugguucacuaugccauuaucggaccaggccugcaagcaaaagccacgagagaggcucagaagcguacagcagccgguauuaugaagaacccuaccguggacggcaucacugucauagaucucgaacccauuucuuacgacccgaaauucgagaagcagcuggggcaagugaugcuuuuaguacugugcgcgggacagcucuugcugaugaggaccacaugggcuuucugugaggugcuaacucuggccaccggcccaauccucacacuuugggaagggaauccuggacgguuuuggaacacgaccaucgcaguuagcacugccaacauuuuccgcggcuccuaucuggcuggugccggguuggcauuuucacugaucaaaaaugcucagacaccccgaagaggaaccggcacuacaggugagacccucggcgaaaaguggaaaaggcagcugaacucuuuagaccggaaggaguucgaagaguacaagcgcagugggauacuugagguggauagaacggaagccaaaucggcgcugaaggacggaagcaaaauuaagcaugccgucuccaggggcucuucaaaaauccgauggauuguggagcgggggauggucaagccaaagggaaaagugguugaucucggcugcggucgugggggauggagcuacuauauggcaacccuaaagaauguaacagaagugaaaggcuacacuaagggcgggcccggacacgaggaaccuaucccgauggcuaccuaugguuggaaccuggucaaauugcauuccggcguggacguuuuuuacaagcccacagagcaaguggauacucugcucugugacauaggggagaguucuagcaauccaaccaucgaagagggaagaacacuucgcguccugaagaugguggaaccuugguugucauccaaacccgaguucugcauuaagguacugaacccuuauaugccaaccgugaucgaagagcucgagaaauuacagaggaagcacggcgguaaucugguucgguguccccuuaguagaaacagcacucacgaaauguacugggucucuggggccuccggaaauauugugucaagcgugaacacgacaucgaaaaugcugcuaaaucgcuuuaccacuaggcaucgaaagccuaccuaugagaaagaugucgaccucggcgcaggcacacggucuguuaguacggaaaccgagaagccagauaugacuaucauugggagaaggcugcagcgcuugcaggaggaacacaaggagacauggcauuacgaccaagaaaaccccuaccguaccugggcuuaucacggauccuacgaggccccgagcacugguucagccuccucuauggugaauggcguagugaaacugcucacaaagccuugggaugucaucccaauggugacccagcuugcgaugacagacacuacccccuucgggcagcagcggguuuuuaaagaaaagguggacacgagaaccccucaaccaaaacccggaacaaggauggucaugacuaccacagcuaacuggcugugggcauuacugggcaagaagaaaaauccgcgcuugugcacucgagaggaguucauaagcaaggugcggaguaacgccgcuauuggugccguauuucaggaagagcagggguggaccuccgcaagcgaagccguuaaugauucuagauucugggagcucguggacaaagaaagggcucugcaccaagagggaaagugugagucaugcgucuauaacaugaugggcaaacgcgaaaagaagcuaggcgaguuugggagagcgaaaggaagucgggccaucugguacauguggcuuggugcaagguuccuggaauucgaggcucucggcuuucugaacgaagaucauugguucgggcgugagaauuccuggagcggaguggagggcgaagguuugcaccgacugggguauauccucgaggaaauugacaagaaagauggagaccuuauguacgccgaugacacggcaggcugggauacacgcauaaccgaggacgaucugcagaacgaggaauuaaucacugagcagauggccccucaucacaagauucuggcuaaagccaucuuuaaguugacauaucagaauaagguggucaaaguucucagacccaccccacggggcgcggugauggacauuaucucuaggaaggaucaacgcgggucgggacagguagguacuuacggccugaacaccuucacaaauauggaagugcagcuaauaagacagauggaggcagaaggggucaucacgcaagacgacaugcagaacccuaaaggacuuaaggagcggguggagaaauggcugagggaaugcggcguugaucgacucaagcguauggccauuucaggugacgauuguguggucaaaccccuggacgagagauuugggaccagcuuguuauuccugaaugauaugggaaaggugcgcaaggacaucccacagugggaacccuccaaaggcuggaagaacuggcaggagguaccuuuuugcagucaucacuuccacaaaauuuuuaugaaggauggccggucucucguugugccauguaggaaucaagacgaacuuaucgggagagcucgcauaagccagggagccgguuggucccugcgggagacugcaugccuaggcaaagcuuacgcccagauguggucacugauguauuuccauaggcgagaucucagauuggcuaguauggccauuuguucugcagucccgacagagugguuucccaccagccggacuacaugguccauccacgcgcaucaccaguggaugaccacggaagacaugcugaagguguggaacaggguuuggaucgaggauaauccuaacaugauugacaagacaccagugcacucaugggaagacauacccuaccuugggaaacgcgaggaucuguggugcggaagccucaucggcuuaucuucccgugccaccugggcuaagaauauucauacugccaucacccaagucagaaaccugauugguaaagaagaguauguggacuacaugccuguaaugaagcgauauagugcaccaagcgagucggaagggguguuguga

SEQ ID NO: 15735 - RNA, 9867 nt, Artificial Sequence
  derived and/or modified CDS sequence (opt3) from DENV-4__FJ639748__SS-prME
agcaccaugacacugcucugccuuauccccacugccauggcuuuccaccuguccacgagagacggcgagccuuugaugauuguggcaaagcaugaaagggggcggccauuacuguuuaaaaccacagagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggcaccugcacgcagucaggggagcgccgacgugaaaagagaaguguagcguugacuccucacagcggaaugggccucgagaccagggcugaaacauggauguccucugagggugccuggaaacaugcacaacggguggagucguggauccugcgcaauccaggguucgcccugcucgcuggauuuauggcauacaugauuggccagacuggcauccagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguauagaagcccuuaucaguaauauuacaaccgcuacgcgaugcccaacccaaggagagcccuaucugaaggaggaacaggaccagcaguacaucuguagaagggauguggucgaccggggcuggggcaacgggugcggauuguucgguaaaggcgggguugugacaugcgccaaguuuuccuguucuggaaaaauuacuggcaaucucguacaaaucgagaaccuggaauauaccguggucgugacaguucauaauggugauacucacgcaguggggaacgacaccagcaaucacggcgucacagcuaccauaacuccucguuccccaucaguggagguacaguuaccggauuacggagaacugacgcucgacugcgagccccgcaguggcauugacuucaacgagaugauccuuaugaagaugaagaaaaagacauggcugguucauaaacagugguuuuuggaucuaccucugccauggaccgccggggcggacacuagcgaagugcacuggaauuacaaggagagaauggucaccuucaaagugccccaugccaagaggcaggaugucacagugcucggaucucaagaaggugcaaugcacuccgcucuggccggcgcuaccgagguugacucaggggauggaaaccacauguuugccggccaucuuaaauguaaggugcggauggaaaagcugcgaauuaaagguaugagcuauacuaugugcagugggaaguucucuaucgacaaagagauggcagagacacagcacggcacgaccguagucaaggugaaauacgaaggagccggcgcuccuuguaagguuccaaucgagauucgcgaugugaauaaggaaaaagucguggggagaguaauauccagcacucccuuggcggagaacacaaacucggugaccaauaucgagcucgaaccgccuuucggagacucuuauauuguuaucggugucggcaacuccgcacugacauuacauugguuuaggaaggggucaaguauaggaaaaauguucgagagcacuuaccggggcgccaagcgcauggcuauucugggugaaaccgccugggauuuuggguccgugggcggacuauucacgucucucggcaaagcagugcaccaggucuuugggagcguuuauaccacaauguucggaggcgugucauggaugaucagaauccugauuggucuuuuggugcuguggaucgggacuaauaguaggaacaccuccauggccaugacaugcauugcuguaggaggcauaacucucuuucuggguuucaccguccaagccgacgugggcuguguugugagcuggucugggcgugagcuuaagugcggaucaggcaucuuugucguggauaauguucauacguggacagaacaguacaaguuccagcccgagaguccagcacggcuggcgagcgcuauuuugaacgcccacaaagacgggguguguggaauccgauccaccacuagacucgagaauguaauguggaagcagaucacaaacgaacugaauuaugucuuaugggagggcggucacgaccugaccgugguggcaggggaugucaaaggaguucuaacuaagggcaaaagggcccucaccccucccgugucugaccugaaguacucguggaagacaugggguaaagcuaagauuuuuacgccagaagcccgcaacagcaccuuccuuauagauggccccgacacuuccgagugcccuaaugaacggagagcauggaacucauuggagguagaggauuacggguuuggaauguucacaaccaauaucuggaugaaauucagggaaggcaguucugaggugugugaccaucgccugaugagcgcugccauuaaggaucaaaaagcgguccacgccgacaugggguauuggaucgaauccucaaagaaccagacauggcagauugagcgagcuagccucaucgaagugaaaacuugccuguggccaaagacccauacguuauggucuaauggaguucuggagucccagaugcuuauaccgaagaguuacgcaggccccuuuagccaacacaacuaucggcaggguuacgccacacagaccguggggccuuggcacuugggaaaacucgagaucgauuucggcgaaugcccagguacuaccgucacaauucaggaggacugugaucaucguggccccucucugagaacuaccacagcuuccgggaagcuagugacgcaauggugcuguaggucaugcaccaugccuccacugcgcuuucucggagaagacggcuguugguaugggauggagauccggccccugagugagaaagaagagaacaugguuaagagccaggugacugccggacagggcacaucggaaaccuucuccaugggucuuuugugccugacuuuauuugucgaggaaugucucagaaggcgaguaacacgcaaacacaugauucuggcagugguuaucacccuuugcgcgauaauucuggggggauugacguggauggaucuccugcgggcccuaaucaugcugggcgacacuaugucuggcagaauugggggacagacccaucucgcuaucauggccguguucaagaugagcccggguuacguccugggcguguuucuuaggaaguugacaucacgugagaccgcacugaugguaauagggauggcuaugacuacaaccuuaaguaucccucacgaccucauggagcugauugauggaaucucccuuggccugauucuacucaaaaucgugacacaauucgacaauacucaggucgguacccuggccuugucucugacguuuauacgcagcacaauguccuuaguuauggcauggcggaccauuauggccgugcucuucguggucacucugaucccacuuuguagaaccucaugccugcagaagcaaagccauuggguggaaaucacagcuuugauucucggggcgcaggcccugcccguuuaucuaaugacucugaugaaaggagcaaguaggcgaucuuggccucuuaacgagggcaucauggcuguaggccucgugucccuguuggggagcgcccuguuaaagaaugaugucccccucgccggaccaaugguggcugguggccugcuucuggcagccuacguuaugucggggucaucugcggacuugagucucgaaaaagcugccaacgugcagugggaugagauggcagacauuaccggauccagcccuauaaucgaagucaagcaggaugaggacggcucuuuuagcauucgggauguggaggaaacgaauaugaucacacugcuaguaaagcuggcccuuauuaccgucuccggucucuacccccuggcuaucccagugacuaugacauugugguauauguggcaaguuaaaacccagcgcucaggggcauuaugggacgugccgaguccugccgcgacucagaaggcugcccugagcgagggagucuacagaauaaugcagaggggccucuucggcaaaacacaaguggggguuggaauccacauggaagguguguuucacaccauguggcaugucacgcggggcucugugauuugucacgagacugggcgacuggaacccuccugggcagauguaagaaacgacaugaucucauauggaggcgguuggcgccuuggggauaagugggacaaagaggaggacgugcagguucuggccauugaaccaggaaagaaucccaagcauguccagaccaaaccuggcuuguucaagacacuaaccggcgagaucggggcugugacacuggauuucaaaccaggaacuagugguagccccauaauuaacaggaagggcaaagugaucgggcucuacggaaauggcgucguaaccaaguccggugacuaugugucugccaucacgcaggcagaacguauuggggagccugauuacgagguugacgaagauauauuucggaaaaagagacugacaaucauggaccuucacccgggagcuggcaagacuaaaaggauuuuaccaucgaucgugcgcgaggcccugaagcgaagacuccggaccuugauucuggcgcccacaagggucguggccgcagaaauggaggaagcucuccgcggccugccuauccguuaucaaaccccagccguuaaaagcgagcauacugggagagagauaguggaucuuaugugccacgcuaccuucacaacgcggcuguugucauccacuaggguccccaacuacaaucuaaucgugauggacgaagcacacuuuaccgauccuaguucuguagccgcccgcggauacauuagcacacgaguggagaugggugaagcugcggcaaucuucaugaccgccacuccgcccggcgcuacagacccauuuccucaguccaacucacccauugaggauaucgaaagagagauaccagagcggucuuggaauaccggguucgacuggauuacggacuaucagggaaagacuguuugguuugucccuagcaucaaagccggcaacgauaucgcaaauugccugaggaagagugguaagaaagugauucaacucucccgcaagacauucgacaccgaauaccccaaaaccaaguuaacugauugggacuuuguggucacaaccgauaucagcgagaugggggccaacuucagagcuggcaggguuauagacccacggcguugucugaaaccggugauucuuacagauggaccugaacgcguaauccuggcgggccccauuccagugacucccgccucugcagcucagcgaagagggaggaucggacggaacccugcccaggaggacgaucaguaugucuuuucaggugacccacucaagaaugaugaagaccaugcacacuggacggaggccaagauguugcuggauaacauauacacccccgagggcauuaucccuacacucuucgggccggaacgcgagaaaacucaagcuaucgacggagaauucagacugaggggcgagcagcggaagaccuuuguggagcuuaugcgaagaggugaccuaccaguuuggcuguccuauaaaguggccagugcggggauuagcuacaaggaucgcgaauggugcuucacaggcgagaggaauaaccagaucuuggaagagaauauggaagucgagauuuggacccgggagggagaaaaaaagaaguuacgucccagauggcuggacgcaaggguauaugccgauccuauggcucucaaagacuuuaaggaguucgccucgggccgcaaaucuauaacucuggauauccuuacggaaauugcuucccugcccaccuaccucagcucacgggcaaaguuggcccuggacaacaucgugaugcuacauacaacugagcgagggggaagagcuuaccagcacgcccugaaugaacucccagagagucuugagacccugauguuaguugcauugcugggugcgaugacagccggcaucuuucucuucuuuaugcaagggaaaggaauuggcaagcugucuaugggucuuauaaccaucgcuguggccuccgggcugcucugggucgcagaaauucagccucaguggaucgcugccagcauuaucuuggaguucuuucugaugguguuacuaauacccgaaccagagaagcagaggacuccucaagauaaccagcugaucuaugucauucucacaauccuuacgauuaucggccugauagcagccaaugaaaugggauugauugagaaaaccaagacugacuucggcuuuuaccaggugaaaacagagaccaccauccuggauguugaccuccgcccggcuucagcguggacacuguaugccguggcaacuacgauucuuacccccaugcuccggcacacaaucgaaaacacuagugcuaaucugagcuuggccgccauagcaaaccaggcugccguacugaugggguuaggaaagggcuggccacuacauagaauggaucugggugugccucuccuugcgaugggguguuacucccaagucaaucccaccacacugaccgcuucuuugguuaugcugcucgugcacuaugccaucauuggaccaggccugcaggcaaaagccacucgugaggcucagaagaggacggcagccgguaucaugaaaaacccuacagucgacggcauuaccgugaucgaucuugaacccauaagcuacgacccgaaguucgagaagcaauuagggcagguaaugcugcucguguugugcgcgggacagcugcuacugaugcggacuaccugggcuuuuugugagguucucacacuugccacuggcccaauucugaccuugugggaagggaauccuggacgcuucuggaacacaacgaucgcaguguccaccgccaacaucuuccgaggcucauaucuggcuggugccgggcucgcauuuucucugauuaaaaaugcucagacucccagaaggggaacaggcaccacuggugagacauuaggcgaaaaguggaaacggcaacuuaacagucuggaccgcaaggaguucgaagaguacaaaagaucggggauccucgaggucgauaggaccgaagccaagagcgcgcuaaaggacggauccaaaauaaagcaugccgugucucgaggcucaagcaaaauucgguggaucgucgagcgugggauggugaagccaaaaggaaagguuguagaucugggcugcgguagagggggaugguccuacuauauggcaacguugaagaaugugaccgaagucaaaggcuacacaaagggcgggcccggacacgaggaaccuauuccgauggcuacuuaugguuggaaccuggugaaacuccauaguggcguugacguguuuuacaagcccaccgagcaggucgauacacuucugugugacaucggggagucuagcucaaauccaacuauagaagagggacgcaccuugagggugcugaaaaugguagaaccuuggcucuccaguaagcccgaguucugcaucaagguguuaaacccuuauaugccaacaguuauugaagagcuggagaaacuucagcggaagcacggcgguaaucuggucagauguccccuaagccgcaacucuacccacgaaauguacuggguguccggggccucaggaaauaucgugagcucggucaacacuacgucuaaaaugcuccugaauagguuuacaacccgacaucggaagccuacuuaugagaaagauguugacuugggcgcaggcaccagaaguguguccacagaaacggagaagccagauaugaccauuaucgggaggcgccugcagcgucuccaagaggaacacaaagagacuuggcauuacgaccaggaaaaccccuaccggacaugggcuuaucacggaagcuacgaggccccgucaaccgguuccgccucuagcaugguaaauggcguggucaagcuucugacuaagccuugggaugugauuccaaugguuacacaguuagcgaugaccgacacaacucccuucgggcagcaaagaguguuuaaagaaaaggucgacaccaggacgccucagaguaaaccaggaacccgcauggugaugacaacuaccgcuaacuggcugugggcauugcucggcaagaaaaagaauccccgacugugcacacgggaggaguucaucuccaagguaagaagcaacgccgcuauaggugccguuuuucaggaagagcaaggguggacuucugcaucagaagccgugaaugauaguagguucugggagcuagucgacaaagaacgcgcucuucaccaggagggaaagugugaguccugcguguauaacaugaugggcaaaagagaaaagaaacugggcgaguuugggcgggcgaagggaagcagggccauuugguacauguggcucggugcacguuuccuggaauuugaggcuuugggcuuccugaacgaagaucauugguucgggcgagagaauucuuggucgggaguggagggcgaaggucuccaccgccuuggguauauccuggaggaaaucgacaagaaagauggagacuuaauguacgccgaugacaccgcaggcugggauacgagaauuacagaggacgaucugcagaacgaggaauugauaaccgagcagauggccccgcaucacaagauccucgcuaaagccauuuuuaagcugacuuaucaaaauaaagucguuaaggugcuacggccuacacccaggggcgcgguaauggacaucauuucacgcaaggaucagagagggagcggacagguggguaccuacggccuuaacacuuucaccaauauggaaguccagcugauccggcaaauggaggcagaaggggugauaacacaggacgacaugcagaacccaaaaggacucaaggagaggguugagaaauggcugcgagaaugcggcguggaucguuugaagagaauggccaucuccggugacgauugugucgugaaaccuuuagacgagcgcuuugcuacgagucugcucuuccuuaaugauauggggaagguacggaaagacauuccccagugggaaccaucuaagggauggaagaacuggcaagagguucccuuuugcagccaucacuuccacaaaaucuuuaugaaggauggcaggucccugguggucccuuguagaaaucaggacgaacuaauuggccgcgcccggaucucacagggggcaggauggagucugagggagaccgcuugccucgguaaagccuacgcucagauguggucuuugauguauuuccaucgaagagaucugcggcuugccagcauggcaauauguuccgcggugccaacugagugguuuccgacaucaaggaccacuuggagcauucacgcccaucaccaauggaugacaaccgaagacaugcugaagguuuggaaccgcguguggaucgaggauaaucccaacaugaucgacaaaacgccuguccacucuugggaagacauuccauaccucggcaagcgugaggauuuauggugcgggucccugauaggauugaguagcagagcuacaugggccaagaauauccauaccgcaauuacucaggugcgaaaccugaucggcaaagaagaguauguagacuacaugcccgugaugaagagguauucggcuccuuccgagaaugaagguguccucuga

SEQ ID NO: 15736 - RNA, 9867 nt, Artificial Sequence
  derived and/or modified CDS sequence (opt3) from DENV-4__FJ639764__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaacuaacaaguguacccuaaucgcaauggaucucggugaaaugugcgaggacacaguuaccuacaaauguccgcugcuugugaauacugaacccgaggauauugacugcugguguaaccugacaucuaccuggguaauguauggcacgugcacucagucaggggagcgccgacgugaaaagagaaguguggccuugaccccucacagcggaaugggccucgagacaagggcggaaacuuggauguccucugagggugcuuggaaacaugcccaacgggucgagucguggauccugcgcaauccaggguucgcacugcucgccggauuuauggcuuacaugauuggccagaccggcauccagagaacaguguucuuuguuuuaaugaugcugguggcacccucauaugggaugaggugugucggaguggguaaccgggauuucguagaaggcguuagcgggggagccuggguggaccuugucuuggagcacggcgguugcgugaccacgauggcucaggggaagccuacucuggauuuugaacuaacaaagaccacugccaaagagguggcgcuccugcgcacauacuguauagaagcacuuaucaguaauauuaccacggccacccgaugcccaacacaaggagagcccuaucugaaggaggaacaggaccagcaguacaucuguagaagggaugucguugaccggggcuggggcaacgggugcggauuguucgguaaaggcggggugguaacuugcgcuaaguuuuccuguucuggaaaaauuaccggcaaucucgugcaaaucgagaaccuggaauauacagucgugguuacugugcauaauggugauacccacgccgucgggaacgacacaagcaaucacggcgugaccgcaacuauaacgccucguuccccaucaguagagguuaaguuaccggauuacggagaacugacacucgacugcgagccccgcaguggcauugacuucaacgagaugauccuuaugaagaugaaaaagaaaaccuggcuggugcauaagcagugguuuuuggaucuaccucugccauggacugcuggggccgacaccagcgaaguccacuggaauuacaaagagagaauggugacauucaaggucccccaugcgaaaaggcaggaugugaccguucucggaucucaggaaggugccaugcacuccgcacuggcuggcgccacugagguggacucaggggauggaaaccacauguuugcuggccaucuuaaguguaagguacggauggaaaaacugcgaauuaaggguaugagcuauacaaugugcagugggaaauucucuaucgacaaggagauggccgagacgcaacacggcaccacugucgugaaaguuaaguacgaaggagcaggcgccccuuguaaggugccaaucgagauucgcgaugucaauaaagaaaaggugguagggagagugauauccagcacacccuuggcugagaacaccaacucgguuacaaauaucgagcucgaaccgccuuucggagacucuuauauugucaucggugugggcaacuccgcgcugacuuuacauugguuuaggaaagggucaaguauaggaaagauguucgagagcaccuaccggggcgcaaaacgcauggccauucugggugaaacggcuugggauuuuggguccgugggcggacuauucaccucucucggcaaggccguccaccagguuuuugggagcguguauacaacuauguucggaggcgugucauggaugaucagaauccugauugguuuucuuguauuguggaucgggaccaauaguaggaacacauccauggcaaugacuugcauugccgucggaggcauaacccuguuccucgguuuuacggugcaggcugacaugggcuguguugugagcuggucugggcgugagcugaagugcggaucaggcaucuucgucguggauaauguucauacauggauugaacaauacaaauuucagcccgagaguccagcccggcuugcaagcgcgauccugaacgcucacaaggacgggguguguggaauccgauccaccacuagauuggagaauguaauguggaaacagauuacaaacgaacucaauuauguccugugggagggcggucacgacuuaaccgugguggccggggaugucaagggaguucugacuaaaggcaagaggacccuaacaccucccgugucugaccucaaguacucguggaaaacgugggguaaggcaaaaauauucaccccagaagcccgcaacagcacuuuucugaucgauggccccgacacauccgagugcccuaaugaacggagagcuuggaacucacuugagguagaggauuacggguucggaauguucaccacaaauauuuggaugaaguuuagggaaggcaguucugaggugugugaccaucgcuugaugagcgccgcaaucaaagaucagaaggcuguccacgccgacaugggguauuggauugaauccucaaaaaaccaaacuuggcagaucgagcgagcgagccugauagaagugaagaccugccucuggccaaagacgcauacacuguggucuaauggaguuuuagagucccagaugcugaucccgaaaaguuacgccggccccuucagccagcacaacuaucggcaagguuacgcuacccagacuguggggccuuggcaccuuggaaaguuggagauugauuuuggcgaaugcccagguaccacagucacuauccaggaggacugugaucaucguggccccucucucagaaccacaacggcauccgggaaacuggugacccaguggugcuguaggucaugcacuaugccuccacuacgcuuccugggagaagacggcuguugguaugggauggagauucggccccucagugagaaggaagagaacaugguuaaaagccaagugacagccggacagggcaccucggaaacuuuuuccaugggucugcuuugcuugacacuguucgucgaggaauguuuaagaaggcgaguaacccgcaagcacaugauccucgcugugguuauaacgcugugcgccauuauccuugggggacugacuuggauggauuugcuccgggcacugauuaugcuaggcgacaccaugucuggcagaaucgggggacagacacaucuggcgauaauggccguguuuaagaugagcccggguuacguccucggcguguuccugaggcgucuuaccucacgcgagacugcuuugaugguaaucgggauggccaugacaaccacacugaguauuccucacgacuuaauggagcucaucgauggaauuucccugggccuuauccugcuaaaaauagugacucaguuugacaauacccaagucgguacgcucgcacugucuuugacauucauucggagcaccaugucccugguuauggcuuggagaacuaucauggccguguuauuuguggucacccucaucccacuguguaggacaucaugccuucagaagcagagccauuggguggaaauuacugcacugaucuugggggcccaagcucuccccguuuaucugaugacccuaaugaaaggagcgagucgacggucuuggccucugaacgagggcauuauggccguaggccuugugucccuccuggggagcgcauugcugaagaaugauguccccuuagcuggaccaaugguggccgguggccuccugcuugccgcuuacguuaugucggggucaucugcagaccugaguuuggaaaaagccgcgaacgugcagugggaugagauggcugacauaacgggauccagcccuaucauugaagucaagcaggaugaggacggcucuuucagcauccgcgauguggaggaaacaaauaugauuacccuccugguaaagcuagcccugaucacugucuccggucuuuacccccucgcaauaccagugacaaugacccugugguauauguggcagguuaaaacucaaagaucaggggccuugugggacgugccgaguccugcugcaacacagaaggccgcguuaagcgagggagucuacaggaucaugcagcggggccuguuuggcaaaacccagguggggguuggaauucacauggaagguguguuccacacgauguggcaugucacucgaggcucugugaucugucacgagaccgggagacucgaacccuccugggcugauguacgcaacgacaugauuucauauggaggcgguuggaggcugggggauaagugggacaaagaggaggacgugcaaguucuugccgucgaaccaggaaagaaucccaagcaugugcagacaaaaccuggccuguucaagaccaucacaggcgagauaggggcagugacuuuggauuuuaaaccaggaaccagugguagccccauuaucaaccguaagggcaaagucaucgggcuauacggaaauggcguagugacgaaguccggugacuauguuucugccauuacacaggcugaacggauaggggagccugauuacgagguggacgaagauaucuucagaaaaaagaggcugacuauuauggaccuccacccgggagccggcaagaccaaacgcauccugccaucgauuguccgagaggcacuuaagagacgguuaaggacacugauccucgcucccacccgcgugguugccgcggaaauggaggaagccuugcguggccugccuauaagauaucagacuccagcagugaaaagcgagcauaccgggcgggagaucgucgaucucaugugccacgcuacauuuacgacuaggcugcuuucauccacccgcgugcccaacuacaaucugauuguaauggacgaagcccacuucacagauccuaguucuguggcugcacgaggauacaucagcaccagaguugagaugggugaagccgccgcuauuuuuaugacugcgacaccgcccggcgcaaccgacccauucccucaauccaacucacccaucgaggauauagaacgggagauuccagagaggucuuggaauacgggguuugacuggaucacugacuaucagggaaagacagucugguucgugccuagcaucaaagccggcaacgauauugcuaauugcuugcgcaagagugguaagaaagugauccagcuauccagaaagaccuuugacaccgaauaccccaaaacuaagcugacagauugggacuucgucguuaccacagauauaagcgagaugggggccaacuuuagggcaggccgggugauugacccacgucgcugucucaaaccgguaaucuuaacugauggaccugaacgagugauucuggccggccccaucccagucacgcccgcuucugcggcccaaagaagggggcggauaggacgcaacccugcacaggaggacgaucaguauguguucucaggugacccacuuaagaaugaugaagaccaugcucacuggaccgaggccaagaugcugcucgauaacauuuacacacccgagggcaucaucccuacuuuguucgggccggaaagagagaaaacccaggcaauugacggagaauuuaggcugcggggcgagcaacgaaagacauucguugagcucaugagacgcggugaccugccaguguggcuuuccuauaaagucgccagugcugggaucagcuacaaggauagggaauggugcuuuaccggcgagcggaauaaccagauucuagaagagaauauggaaguagagauauggacucgugagggagaaaaaaagaagcugagacccaggugguuggacgcccgcguguaugcggauccuauggcauuaaaagacuucaaggaguuugccucgggccggaaaucuaucacgcuggauauucucaccgaaaucgcuucccugcccacauaccuuagcucacgagccaagcuggcucucgacaacaucguuauguugcauacuaccgagagagggggaagggcauaccagcacgcccugaaugaacuaccagagagucuggagacacucaugcuuguggcucuguuaggugccaugaccgcaggcauuuucuuguuuuucaugcaggggaaaggaauaggcaagcugucuaugggucucaucacuauugcggucgccuccgggcugcuuuggguggcugaaauccaaccucaguggauugccgcaagcaucauacuggaguuuuuccucauggucuugcugauccccgaaccagagaagcagcgcacaccucaggauaaccaauuaauuuaugugauccuaacgauucugaccaucauaggccucauugcugccaaugaaaugggacuuaucgagaaaacuaagacagacuuuggcuucuaccagguuaaaaccgagaccacaauucuggauguggacuugcggccggcaucagccuggacucuguaugcuguagcgacgaccauccucacacccaugcugagacacacuauagaaaacaccagugccaaucuuagccucgcagcuaucgccaaccaggccgcagugcugaugggguugggaaagggcuggccacugcaucguauggauuuaggugucccucuacuggcuaugggguguuacucccagguuaaucccacaacccucacugccucucuugugaugcuguugguccacuaugcgauuaucggaccaggccugcaagcuaaagccacgagggaggcacagaagcggacagccgcugguauuaugaaaaacccuaccguggacggcaucacuguaauagaucucgaacccauuagcuacgacccgaaguuugagaagcagcuggggcaagugaugcuuuuaguucugugcgcaggacagcucuugcugaugcgcaccacaugggccuucugugaggugcuaacucuggcgaccggcccaauccucacacuuugggaagggaauccuggacgauucuggaacacgaccaucgcugucuccacugccaacauuuuuagaggcucauaucuggcaggugccggguuggcuuucucucugaucaaaaaugcccagacacccaggcggggaaccggcacuacaggugagacccucggcgaaaaguggaaacgccagcugaacaguuuagacagaaaggaguuugaagaguacaaaaggucggggauacuugagguggaucgaacggaagcaaagagcgcucugaaggacggauccaaaauuaagcaugccgucucucggggcucaagcaaaauccguuggauuguggagagagggaugguuaagccaaaaggaaagguaguggaucucggcugcggucgcgggggaugguccuacuauauggcgacccuaaagaaugucacagaagugaaaggcuacacuaagggcgggcccggacacgaggaaccuaucccgauggccaccuaugguuggaaccugguuaaauugcauaguggcguggacgucuucuacaagcccacagagcaaguggauacucugcucugugacauaggggagucuagcucaaauccaaccaucgaagagggaaggacacuucggguacugaaaaugguggaaccuugguuguccaguaagcccgaguuuugcauuaagguucugaacccuuauaugccaaccgucaucgaagagcucgagaaauuacagagaaagcacggcgguaaucuggugcgcuguccccuuagcaggaacucuacucacgaaauguacuggguguccggggcaucaggaaauauugucagcucgguuaacacgacaucuaaaaugcugcuaaaucgauucaccacucggcauagaaagccuaccuaugagaaagauguggaccucggcgcuggcacaaggaguguauccacggaaaccgagaagccagauaugacuaucauugggcgccgucugcagcgguugcaggaggaacacaaagagacauggcauuacgaccaagaaaaccccuacagaaccugggccuaucacggaagcuacgaggcaccgucaacugguuccgcuucuagcauggugaauggcgucgugaagcugcucacaaagccuugggauguuaucccaauggugacccagcuugccaugacagacacuacccccuuugggcagcagagggucuucaaagaaaagguggacacgcgcaccccucaaccaaaacccggaacacgaaugguaaugacuaccacagccaacuggcugugggcguuacugggcaagaaaaagaauccgcgguugugcacuagagaggaguuuauaaguaagguuagguccaacgcugcaauuggugccguguuccaggaagagcagggguggaccagcgcuucugaagccgucaaugauucacgcuuuugggagcucguggacaaagaaagagcacugcaccaagagggaaagugugagaguugcguguauaacaugaugggcaaacgggaaaagaaacuaggcgaguucgggagggccaagggaucccgugcuaucugguacauguggcuuggugcgcgauuucuggaauucgaggcccucggcuuccugaacgaagaucauugguuugggcgcgagaauagcuggucuggagucgagggcgaagguuugcacagacugggguauauccucgaggaaauugacaagaaagauggagaccuuauguacgcagaugacacggcuggcugggauacacggauaaccgaggacgaucugcagaacgaggaauuaaucacugagcagauggccccucaucacaagauucuggcaaaagccaucuucaaguugacauaucagaauaaaguugugaagguacucaggcccaccccacgcggcgcugugauggacauuaucucgagaaaggaucaacgggggucaggacaggucgguacuuacggccugaacaccuuuacaaauauggaagugcagcuaauaaggcagauggaggccgaagggguuaucacgcaagacgacaugcagaacccuaaaggacuuaaggagcgaguggagaaauggcugcgugaaugcggcgucgauagacucaagcgcauggcgauuagcggugacgauugugugguaaaaccccuggacgagcgguucgggaccuccuuguuauuucugaaugauaugggaaagguuaggaaagacaucccacagugggaacccaguaagggcuggaagaacuggcaggaggugccuuucugcucucaucacuuucacaaaauuuucaugaaggauggcagaagccucgucgugccaugucgcaaucaagacgaacuuaucgggcgggcaaggauaucccagggagccgguuggucacugcgagagacugcuugccuaggcaaagccuacgcacagauguggagucugauguauuuucauagacgggaucucagguuggcuucuauggccauuuguagcgcuguuccgacagagugguuccccaccucccgcacuacauggucaauccacgcccaucaccaguggaugaccacggaagacaugcugaagguguggaaccgugucuggaucgaggauaauccuaacaugauugacaaaacaccagugcacagcugggaagacauacccuaccuugggaagagagaggaucuguggugcggaucucucaucggcuuauccagucgagcaaccugggcgaagaauauucauacugccaucacccaaguaaggaaccugauugguaaagaagaguauguggacuacaugccugucaugaagcgguauagcgcuccaucggaguccgaagggguuuuguga

SEQ ID NO: 15737 - RNA, 9867 nt, Artificial Sequence
  derived and/or modified CDS sequence (opt3) from DENV-4__FJ639773__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaacgacugcgcaucaaagguaugagcuauacaaugugcagugggaaguucucuaucgacaaagagauggcugagacgcaacacggcaccacugucgugaagguuaaauacgaaggagccggcgcaccuuguaaggugccaauugagauaagagaugucaauaaggaaaaagugguagggagggugaucuccgccacacccuuggcugagaacaccaacagcguuacaaauauugagcucgaaccgccuuucggagacucguauaucgucauaggugugggcaacucugcgcugacuuuacauugguuucggaagggguccucaauuggaaaaauguucgagaguaccuaccgcggcgcaaagagaauggccauccugggugaaacggcuugggauuuugggagcgugggcggacuauucaccucccucggcaaagccguccaccagguuuuugggucuguguauacaacuauguucggaggcgugagcuggaugaucaggauucugaucgguuuucuuguauuguggauugggaccaauucacguaacacaaguauggcaaugacuugcauagccgucggaggcaucacccuguuccucgguuuuacggugcaggcugacaugggcuguguuguguccuggagcgggcgggagcugaagugcggaucuggcauuuucgucguggauaauguucauacauggaccgaacaauacaaguuucagcccgagucaccagcccgacuugcaagugcgauccugaacgcucacaaagacgggguguguggaaucagaagcacuacaagguuggagaauguaauguggaagcagauuaccaacgaacucaauuauguccugugggagggcggucacgacuuaacugugguggccggggaugucaaaggaguucugaccaagggcaaacgcgcacuaacaccucccgccuccgaccucaaguacucuuggaagacgugggguaaagcuaagauauucaccccagaagcccggaacucgacuuuucugaucgauggccccgacacaagcgagugcccuaaugaaagaagggcauggaacuccuucgagguggaggauuacggguucggaauguuuaccacaaauauuuggaugaaauuccgcgaaggcucaagugagguaugugaccaucgacuuaugucugcugccaucaaggaucagaaagcggugcacgccgacaugggguauuggauugaaagcuccaagaaccaaacuuggcagaucgagcgggcuucauugauagaagucaaaaccugccuguggccaaagacgcauacacucuggagcaauggagugcuggagucucagauguuaaucccgaaguccuacgcaggccccuuuagucagcacaacuaucgucaagguuacgccacccagacuguugggccuuggcaccugggaaaacuugagauugauuucggcgaaugcccagguaccacagugacuauccaggaggacugugaucauagaggccccagcuugaggaccacaacggcuucugggaagcucgucacccaguggugcugucgcuccugcacuaugccuccacugcgguuucuaggagaagacggcuguugguaugggauggagauuagaccccugucagagaaagaagagaacauggugaagagucaaguuacagccggacagggcaccagcgaaacuuucucgaugggucuccugugccuuacauuguuuguggaggaaugucugaggcgacgcgucacccggaaacacaugaucuuagcaguagugauaacgcucugcgcgauuauccuggggggacuuacuuggauggaucuguugagagcccucauuaugcugggcgacaccauguccggcaggaucgggggacagacacaucuagcuauaauggccguuuucaagaugucuccggguuacgugcugggcgucuuucuccguaagcugaccagccgcgagacugcacuuauggugaucgggauggcuaugacaaccacauugucaauuccucacgaccugauggaguuaaucgauggaauuagucucggccugauccuucugaaaauaguaacucaguucgacaauacccaaguggguacgcuagcccucucccugacauuuauucggucuaccaugagcuuggucauggcauggagaacuaucauggccguucuguucguggugaccuuaaucccacucuguaggacauccugccugcagaagcagucacauugggucgaaauuacugcucuuauccugggggcgcaagccuugcccguguaucucaugacccugaugaaaggagcaagccgacggaguuggccucuaaacgagggcauuauggcuguuggccugguaucucuucucggguccgcccuguugaagaaugaugugccccuggccggaccaauggucgcugguggcuuacuccuggcagccuacgugaugagcgggucgucagcggaccuuucucuggaaaaagcugccaacguucagugggaugagauggcagacauaacgggaaguuccccuaucauugaagugaagcaggaugaggacggcagcuuuucuauccgcgaugucgaggaaacaaauaugauuaccuugcucgugaagcuggcccuaaucacuguaagcggucuguacccccuugcuauaccagucacaaugacccucugguauauguggcaggugaaaacucaaagauccggggcacugugggacguuccgucaccugccacaacccagaaggcggcuuugagugagggaguguacaggaucaugcagcggggcuuauucggcaaaacgcaggucggggugggaauucacauggaagguguuuuccacacuauguggcaugugacccgaggcagcgucaucugucacgagacagggagacuggaacccucuugggccgaugugcgcaacgacaugauuuccuauggaggcgguuggaggcucggggauaagugggacaaagaggaggacguacaagugcuggcaaucgaaccaggaaagaaucccaagcauguucagaccaaaccuggccuuuuuaagacacugacuggcgagauaggggccgucaccuuggauuucaaaccaggaacgucagguagucccauuaucaaccguaagggcaaagugaucgggcuauacggaaauggcguggucacaaagagcggugacuauguauccgcuauuacucaggccgaacggauaggggagccugauuacgagguggacgaagauaucuuuagaaaaaagaggcugaccauuauggaccuccacccgggagcaggcaagacaaaacgcauccugccaucuauuguucgagaggcucuuaagagacgguuaaggacccugauccucgcccccacucgcguggucgcggccgaaauggaggaagcauugcguggccugccuauaagauaucagaccccagcugugaaaucggagcauacagggcgggagaucguugaucucaugugccacgccacguucacuaccaggcugcuuagcucaacacgcgugcccaacuacaaucugauugucauggacgaagcucacuuuaccgauccuuccaguguggcagcccgaggauacaucucuacuagaguagagaugggugaagccgcugcgauuuucaugacagcaaccccgcccggcgccacggacccauuuccucaaagcaacucccccaucgaggauauagaacgggagauuccagagaggucauggaauacuggguucgacuggaucacagacuaucagggaaagaccgugugguuuguuccuucuaucaaagcuggcaacgauauugccaauugcuugcgcaagagcgguaagaaagucauccagcuaaguagaaagaccuucgacacugaauaccccaaaacaaagcugaccgauugggacuuuguggugacaacugauauauccgagaugggggcaaacuucagggccggccgggucauugacccacgucgcugucucaaaccgguuaucuuaacggauggaccugaacgagugauucuggcuggccccaucccaguaacccccgcgagcgccgcacaaagaagggggcggauaggacgcaacccugcucaggaggacgaucaguauguguucucuggugacccacuuaagaaugaugaagaccaugcccacuggacagaggcaaagaugcugcucgauaacauuuacacucccgagggcaucaucccuaccuuguuugggccggaaagagagaaaacacaggccauugacggagaauucaggcugcggggcgagcaacgaaagaccuuugucgagcucaugagacgcggugaccugccaguguggcuuucauauaaaguugcuuccgccgggaucaguuacaaggauagggaauggugcuucacuggcgagcggaauaaccagauucuagaagagaauauggaaguggagauauggacgcgugagggagaaaaaaagaagcugagacccaaaugguuggacgcgagggucuaugcagauccuauggccuuaaaggacuuuaaagaguucgcuagcggccgcaagucgaucacccuggauauucucacagaaaucgccucucugcccacuuaccuuuccagccgggcuaaacuggcacucgacaacaucguaauguugcauaccacagagcgagggggaagagccuaccagcacgcucugaaugaacuaccagagucacuggagacccucaugcuuguggcccuguuaggugcaaugacugcgggcauuuuuuuguucuuuaugcaggggaagggaauaggcaagcugaguaugggucucaucacaauugccguugcuucugggcugcuuuggguggccgaaauccaaccucaguggauugcagcuuccaucauacuggaguucuuucucauggucuugcugauccccgaaccagagaaacagaggacgccucaggauaaccaauuaauuuaugugauccuaaccauucugacuaucauaggccucauugccgcaaaugaaaugggacuuaucgagaagacaaaaaccgacuucggcuuuuaccaggagaagaccgaaacaacuauucuggaugucgacuugcgcccggccagcgcuuggacgcuguaugcgguggccaccacaauccucacucccaugcugcggcacaccauagagaacacaucagcaaaucuuagucucgcugccaucgccaaccaggcagcuguucugaugggguugggaaaaggcuggccacugcauagaauggauuuaggugugccucuacuggccaugggguguuacagccagguaaaucccaccacucucacggcgucccuugugaugcuguugguccacuaugcuauuaucggaccaggccugcaagccaaggcaacacgugaagcccagaaaaggaccgcugcagguauuaugaagaacccuacuguugacggcaucaccgugauagaucucgagcccauuucuuacgacccgaaguucgagaaacagcuggggcaagucaugcuuuuagugcugugcgccggacagcucuugcugaugcggacaacuugggcguucugugaaguacuaacccuggcuacaggcccaauccucacgcuuugggaggggaauccuggacgcuuuuggaacaccacuaucgccgugagcacagcaaacauuuuccgaggcuccuaucuggccggugcuggguuggccuuuucacugaucaagaaugcacagacccccagaaggggaacuggcacaaccggugaaacgcucggcgagaaauggaagcggcagcugaacucuuuagaccgcaaagaauucgaggaguacaagagaagugggauacuugaaguugauaggaccgaggcuaagucggcccugaaagacggaagcaagauuaaacaugcggugucccgaggcucuucaaagauccgguggauugucgaacgugggauggugaaaccaaagggaaaggucguggaucucggcugcgguagagggggauggagcuacuauauggccacacuaaaaaauguuacugagguaaagggcuacaccaaaggcgggcccggacacgaagagccuaucccgauggcaacauaugguuggaaccuggugaaguugcauuccggcgucgacguguuuuacaaacccacugagcaaguugauacccugcucugugacauaggggaaaguucuagcaauccaacaaucgaggaaggacgcacccuuagggugcugaagauggucgagccuugguugucauccaagcccgaauucugcauuaaagugcugaacccuuauaugccaacuguaaucgaggagcucgaaaaguuacagcggaaacacggcgguaaucuggugagauguccccuuagucgcaacagcacgcacgagauguacuggguuucuggggcuuccggaaauauugucucaagcgugaacacaaccucgaagaugcugcuaaauagguuuacuacccgacaucggaaaccuacauaugaaaaggauguggaccucggcgccggcacgagaucugucaguaccgagacugagaaaccagauaugacaaucauugggaggcgccugcagcguuugcaggaagagcacaaggaaaccuggcauuacgaccaagagaaccccuaccggacuugggcauaucacggauccuacgaagcuccgagcacagguucagccuccucuaugguuaauggcgugguaaagcugcucaccaaaccuugggaugugaucccaauggucacacagcuugccaugacugacaccacgcccuucgggcagcagagaguguuuaaggagaaaguugacaccaggacaccucaaccaaagcccggaacucgcauggugaugaccacaacugcgaacuggcugugggcuuuacugggcaaaaagaagaauccgcgauugugcacccgggaggaauucauaagcaaagucagaaguaacgcagccauuggugcuguguuucaggaggaacagggguggacguccgccagcgaggcaguaaaugauucuagguucugggaacucguugacaaggagcgcgcccugcaccaagagggaaaaugugaaucaugcguguauaacaugaugggcaagagagagaaaaagcuaggcgaauuugggcgggcuaagggaaguagggcgaucugguacauguggcuuggugcccguuuccuggaguucgaagcacucggcuuucugaacgaggaucauugguucgggcgagagaauuccuggagcggagucgaaggcgaggguuugcaccgccugggguauauccucgaagagauugacaaaaaggauggagaccuuauguacgcugaugacacagccggcugggauaccagaauaacugaggacgaucugcagaacgaagaguuaaucacagaacagauggcaccucaucacaaaauucuggccaaggcuaucuuuaaauugaccuaucagaauaagguggugaagguccuccggcccacuccaaggggcgccguuauggacauuaucucucgcaaagaucaaagagggucgggacagguggguaccuacggccugaacacauucacgaauauggagguacagcuaauacggcagauggaagcggagggggugaucacccaagacgacaugcagaacccuaagggacuuaaagagagggucgaaaaguggcugcgagagugcggcguggaucgucucaaaagaauggcaauuucaggugacgauuguguugugaagccccuggacgaacgcuuugggacuagcuuguuauuccugaaugauaugggaaaaguccggaaggacaucccacagugggagcccuccaagggcuggaaaaacuggcaggaagugccuuuuugcagucaucacuuccacaagauuuuuaugaaagauggcaggucucucguaguuccauguagaaaucaagacgagcuuaucgggcgcgcccggauaagccagggagcugguuggucccugagggagacagccugccuaggcaaggcauacgcucagauguggucacugauguauuuccaucgaagagaucuccgguuggccaguauggcuauuuguucugccgugccgaccgaaugguuucccacuagcaggacaaccugguccauccacgcacaucaccaguggaugacgacagaggacaugcugaaagucuggaaccgcguguggaucgaagauaauccuaacaugauugacaagaccccaguucacucaugggaggacauacccuaccuugggaagcgugaagaucuguggugcggaagccucaucggcuuaucuuccagagcgacuugggccaaaaauauucauaccgcuaucacacaagugcgaaaccugauugguaaggaggaguaugucgacuacaugccugugaugaaaagguauagugccccaagcgaaucggaggggguauuguga

SEQ ID NO: 15738 - RNA, 9867 nt, Artificial Sequence
  derived and/or modified CDS sequence (opt3) from DENV-4__FJ882580__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaagagugguagggagggugaucuccgccacacccuuggcugagaacaccaacagcguuacaaauauugagcucgaaccgccuuucggagacucguauaucgucauaggugugggcaacucugcgcugacuuuacauugguuucggaagggguccucaauuggaaaaauguucgagaguaccuaccgcggcgcaaagagaauggccauccugggugaaacggcuugggauuuugggagcgugggcggacuauucaccucccucggcaaagccguccaccagguuuuugggucuguguauacaacuauguucggaggcgugagcuggaugaucaggauucugaucgguuuucuuguauuguggauugggaccaauucacguaacacaaguauggcaaugacuugcauagccgucggaggcaucacccuguuccucgguuuuacggugcaggcugacaugggcuguguuguguccuggagcgggcgggagcugaagugcggaucuggcauuuucgucguggauaauguucauacauggaccgaacaauacaaguuucagcccgagucaccagcccgacuugcaagugcgauccugaacgcucacaaagacgggguguguggaaucagaagcacuacaagguuggagaauguaauguggaagcagauuaccaacgaacucaauuauguccugugggagggcggucacgacuuaacuauaguggccggggaugugaaaggaguccugaccaagggcaaacgcgcacuaacaccucccgccuccgaccucaaguacucuuggaagacgugggguaaagcuaagaucuucaccccagaagcccggaacucgacuuuucugauugauggccccgacacaagcgagugcccuaaugaaagaagggcauggaacuccuucgagguugaggauuacggguucggaauguuuaccacaaauaucuggaugaaauuccgcgaaggcucaagugaggugugugaccaucgacuuaugucugcugccauuaaggaucagaaagcgguacacgccgacaugggguauuggaucgaaagcuccaagaaccaaacuuggcagauagagcgggcuucauugaucgaagugaaaaccugccuguggccaaagacgcauacacucuggagcaauggaguccuggagucucagauguuaauuccgaaguccuacgcaggccccuuuagucagcacaacuaucgucaagguuacgccacccagacuguggggccuuggcaccugggaaaacuugagaucgauuucggcgaaugcccagguaccacaguuacuauucaggagaacugugaccauagaggccccagcuugaggaccacaacggcuucugggaagcucgugacccaguggugcugucgcuccugcacuaugccuccacugcgguuucuaggagaagauggcuguugguaugggauggagaucagaccccugucagagaaagaagagaauauggucaagagucaagugacagccggacagggcaccagcgaaacuuucucgaugggucuccugugccuuacauuguuuguugaggaaugucugaggcgacgcgugacccggaaacacaugauauuagcagucguaauuacgcucugcgcgaucauucuggggggacuuacuuggauggaccuguugagagcccucaucaugcugggcgauaccauguccggcaggauagggggacagacacaucuagcuaucauggccguguucaagaugucuccggguuacguucugggcguguuucuccguaagcugaccagccgcgagacugcacuuauggucauugggauggcuaugacaaccacauugucaaucccucacgaccugauggaguuaauugacggaaucagucucggccugauacuucugaaaauugugacucaguucgauaacacccaaguagguacgcuagcccucucccugacauuuauccggucuaccaugagcuuggugauggcauggagaacuaucauggccguccuguucguugugaccuuaauuccacucuguaggacauccugccugcagaagcagucacauuggguggaaaucacugcucuuauucugggggcgcaagccuugcccgucuaucucaugacccugaugaaaggagcaagccgacggaguuggccucuaaaugagggcauaauggcugugggccugguuucucuucucggguccgcccuguugaagaacgacguaccccuggccggaccaaugguggcugguggcuuacuccuggcagccuacgucaugagcgggucgucagcggaucuuucucuggaaaaagcugccaaugugcagugggacgagauggcagauaucacgggaaguuccccuauuaucgaaguuaagcaggacgaggauggcagcuuuucuauucgcgacguggaggaaacaaacaugaucaccuugcucgucaagcuggcccuaauaacugugagcggucuguacccccuugcuaucccaauuacaaugacccucugguauauguggcagguaaaaacucaaagauccggggcacugugggaugucccgucaccugccgcgacacagaaggcugccuugagugagggaguguacaggaucaugcagcggggcuuauucggcaaaacccagguuggggugggaauucacauggaaggugucuuccacacgauguggcaugugacucgaggcagcguuaucugucacgagaccgggagacuggaacccucuugggcagacgugcgcaaugauaugauauccuauggaggcgguuggaggcucggggacaagugggauaaagaggaggacguccaagugcuggccauugaaccaggaaagaaccccaagcauguacagacaaaaccuggccuuuuuaagacccugacaggcgagaucggggcugugacuuuggacuucaaaccaggaaccucagguagucccaucauuaaucguaagggcaaaguuauagggcuauacggaaacggcgucgugacgaagagcggugauuauguguccgccaucacacaggcagaacggauuggggagccugacuacgaggucgaugaagacaucuuuagaaaaaagaggcugacuauuauggaucuccacccgggagcuggcaagaccaaacgcauccugccaucuauaguacgagaggcccuuaagagacgguuaaggacacugauccucgcgcccacccgcgugguugccgcagaaauggaggaagcuuugcguggccugccuauuagauaucagacuccagccgugaaaucggagcauaccgggcgggagaucgucgaccucaugugccacgcuacauucacgacuaggcugcuuagcucaacccgcgugcccaauuacaaccugauuguuauggaugaagcacacuuuacagacccuuccaguguggccgcccgaggauacaucucuaccagagucgagaugggugaagcugcggcaauauucaugacugccacaccgcccggcgcuaccgauccauuuccucaaagcaauucccccauugaggacaucgaacgggagaucccagagaggucauggaacacgggguucgauuggauuacugacuaucagggaaagacagugugguuuguaccuucuaucaaagccggcaaugacauagcaaacugcuugcgcaagagcgguaagaaagugauucagcuaaguagaaagaccuucgauaccgaauaccccaaaacuaagcugacagacugggauuuuguugucaccacagacaucuccgagaugggggccaacuucagggcuggccgggugauugauccacgucgcugucucaaaccggugaucuuaacugacggaccugaacgagucauacuggcgggccccauuccaguuacgcccgccagcgcagcucaaagaagggggcggaucggacgcaauccugcccaggaggaugaccaguauguguucucuggugauccacuuaagaacgacgaagaucaugcacacuggaccgaggccaagaugcugcucgacaauaucuacacacccgagggcauuaucccuacuuuguuugggccggaaagagagaaaacccaggcuauugauggagaauucaggcugcggggcgagcaacgaaagacauuuguagagcucaugagacgcggugaccugccaguguggcuuucauauaaagucgccuccgcggggauaaguuacaaggacagggaauggugcuucaccggcgagcggaacaaucagauccuagaagagaacauggaaguggagauuuggacucgugagggagaaaaaaagaagcugagacccaaaugguuggaugcaaggguuuaugccgacccuauggcuuuaaaggauuuuaaagaguucgccagcggccgcaagucgaucacgcuggacauccucaccgaaauugcuucucugcccacauaccuuuccagccgggcaaaacuggcccucgauaauauagugauguugcauacuaccgagcgagggggaagagcuuaccagcacgcccugaacgaacuaccagagucacuggagacacucaugcuugucgcacuguuaggugcgaugaccgccggcaucuuuuuguucuuuaugcaggggaagggaauuggcaagcugaguaugggucucaucacuauugcuguagccucugggcugcuuuggguggcagaaauccaaccucaguggauagcugccuccaucauucuggaguucuuucucaugguuuugcugauccccgaaccagagaaacagaggacaccucaggacaaucaauuaauuuaugugauccuaacgauacugaccauuaucggccucauugcagccaacgaaaugggacuuaucgagaagacuaaaacagauuucggcuuuuaccaggucaagaccgagaccacaauacuggacguggauuugcgcccggcuagcgcguggacucuguaugccgucgcaacgaccauccucacacccaugcugcggcacacuauugaaaauaccucagcuaaccuuagucucgccgccaucgcaaaucaggcugccgugcugaugggguugggaaaaggcuggccacugcauagaauggacuuagguguuccucuacuggcgaugggguguuacagccaggugaaccccacaacccucacugcuucccuuguaaugcuguuggugcacuaugccauuaucggaccaggccugcaagcaaaggccacgcgugaggcucagaaaaggacagcagccgguauaaugaagaauccuaccgucgauggcauuacuguuaucgaccucgaacccaucucuuacgauccgaaguucgagaaacagcuggggcaagugaugcuuuuaguccugugcgcgggacagcucuugcugaugcggaccacaugggcuuucugugaggugcuaacucuggccaccggcccaauucucacacuuugggaagggaacccuggacgcuuuuggaacacgaccaucgcaguaagcacugccaauauauuccgaggcuccuaucuggcuggugccggguuggcauuuucacugauuaagaacgcucagacacccagaaggggaaccggcacuacaggugagacccucggcgaaaaauggaagcggcagcugaauucuuuagaccgcaaagaguucgaagaguacaagagaagugggauccuugagguggacaggacggaagccaagucggcgcugaaagauggaagcaagauuaaacaugccguuucccgaggcucuucaaagauccgguggauaguggagcgugggauggucaaaccaaagggaaagguggucgaccucggcugcgguagagggggauggagcuacuauauggcaacccuaaaaaacgugacagaaguuaagggcuacacuaaaggcgggcccggacacgaggaaccuaucccgauggcuaccuaugguuggaaucugguaaaguugcauuccggcguggaugucuuuuacaaacccacagagcaaguggacacucugcucugugauauuggggagaguucuagcaacccaaccaucgaagagggacgcacacuuaggguucugaagaugguggaaccuugguugucauccaagcccgaguucugcauuaaaguccugaauccuuauaugccaaccgugaucgaagagcucgagaaguuacagcggaaacacggcgguaaccugguaagauguccccuuagucgcaauagcacucacgaaauguacugggugucuggggccuccggaaacauuguuucaagcgucaauacgacaucgaagaugcugcuaaacagguuuaccacucgacaucggaaaccuaccuaugagaaggacguggaucucggcgcaggcacaagaucugugaguacggaaaccgagaaaccagacaugacuaucauagggaggcgccugcagcguuugcaggaggaacacaaggagacauggcauuacgaucaagaaaaucccuaccggaccugggcuuaucacggauccuacgaggccccgagcacugguucagccuccucuauggucaacggcguugugaagcugcucacaaaaccuugggacguaauuccaauggugacccagcuugcgaugacagauacuacccccuucgggcagcagagagucuuuaaggaaaaaguggacacgaggaccccucaaccaaagcccggaacacgcaugguuaugacuaccacagcuaauuggcugugggcauuacugggcaaaaagaagaacccgcgauugugcacucgggaggaguucaucagcaaagugagaaguaaugccgcuaucggugccgucuuucaggaagagcagggguggaccuccgcaagcgaagccgugaacgacucuagguucugggagcucguagauaaggaacgcgcucugcaccaagagggaaaaugugagucaugcguuuauaacaugaugggcaagagagaaaaaaagcuaggcgaguuugggcgggcgaagggaaguagggccauuugguacauguggcuuggugcacguuuccuggaauucgaggcucucggcuuucugaaugaagaccauugguucgggcgagagaacuccuggagcggaguggagggcgaagguuugcaccgccugggguauauacucgaggaaaucgauaaaaaggacggagaucuuauguacgccgacgauacggcaggcugggacacaagaauuaccgaggaugaccugcagaaugaggaauuaaucacugagcagauggccccucaucacaaaauucuggcuaaggccaucuuuaaauugacauaucagaacaaggucgugaaggugcuccggcccaccccaaggggcgcggucauggauauaaucucucgcaaagaccaaagagggucgggacagguugguacuuacggccugaauaccuucacaaacauggaagugcagcuaauucggcagauggaggcagaagggguaaucacgcaagaugacaugcagaauccuaagggacuuaaagagaggguggagaaguggcugcgagaaugcggcgucgaccgucucaaaagaauggccauuucaggugaugacugugugguuaagccccuggaugagcgcuuugggaccagcuuguuauuccugaacgacaugggaaaagugcggaaggauaucccacagugggaacccuccaagggcuggaaaaauuggcaggaggucccuuuuugcagucaucacuuccacaagauauuuaugaaagacggcaggucucucgugguaccauguagaaaccaagaugaacuuauugggcgcgcucggaucagccagggagccgguuggucccugagggagacugcaugccuaggcaaggcuuacgcccagauguggucacugauguauuuccaucgaagagaccuccgguuggcuaguauggccaucuguucugcaguuccgacagagugguuucccaccagcaggacuacaugguccauucacgcgcaucaccaguggaugaccacggaagauaugcugaaaguguggaaucgcgucuggauagaggacaacccuaauaugaucgauaagacaccagugcacucaugggaagacauucccuaccuugggaagcgugaggaccuguggugcggaagccucaucggcuuaucuuccagagccaccugggcuaaaaacauucauacugccaucacccaaguucgaaaucugauagguaaggaagaguauguggauuacaugccugucaugaaaagguauagugcaccaagcgagucggaagggguguuguga

SEQ ID NO: 15739 - RNA, 9867 nt, Artificial Sequence
  derived and/or modified CDS sequence (opt3) from DENV-4__FJ882581__SS-prME
agcaccauaacccugcucugccuuauucccacugugauggccuuccaccuguccacgcgggacggcgaaccuuugaugauagucgcuaagcaugaaagggggcggccauuacuguuuaaaaccaccgaaggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggaaugggcgugagcugaagugcggaagcggcauuuucgucguggauaacguucauacauggaccgaacaauacaaauuucagcccgagucuccagcccggcuugcaucagcgauccugaaugcucacaaggacgggguguguggaauccgaaguacuacaagauuggagaacguaauguggaaacagauuaccaaugaacucaacuauguccugugggagggcggucacgacuuaacugugguggccggggaugucaagggaguucugaccaaaggcaagagggcacuaacaccucccgccagcgaccucaaguacuccuggaaaacgugggguaaggcuaaaauauucaccccagaagcccgcaauucuacuuuucugaucgauggccccgacacaucggagugcccuaacgaacggagagcauggaauagcuucgagguggaggauuacggguucggaauguuuaccacaaacauuuggaugaaguucagggaaggcuccucagagguaugugaccaucgccuuaugagugcugccaucaaagaucagaaggcggugcacgccgacaugggguauuggauugaaucuagcaaaaaucaaacuuggcagaucgagcgagcuuccuugauagaagucaagaccugccuguggccaaagacgcauacacucuggucaaacggagugcuggagagccagauguuaaucccgaaaucuuacgcaggccccuuuucccagcacaacuaucggcaagguuacgccacccagacuguugggccuuggcaccugggaaaacuugagauugauuucggcgaaugcccagguaccacagugacuauccaggagaauugugaccaucguggccccaguuugagaaccacaacggcuagcgggaaacucgucacccaguggugcuguaggucuugcacuaugccuccacugcgcuuucuaggagaagauggcuguugguaugggauggagauucggccccuguccgagaaggaagagaacauggugaaaucacaaguuacagccggacagggcaccagugaaacuuucagcaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccaugucgggcagaaucgggggacagacacaucuagcuauaauggccguuuucaagauguccccggguuacgugcugggcgucuuucucaggaaacugaccucucgugagacugcacuuauggugaucgggauggcuaugacaaccacauugagcauuccucacgaccugauggaguuaaucgacggaauuucacucggccugauccuucugaagauaguaacucaguucgauaauacccaaguggguacgcuagcccucagucugacauuuauucgcuccaccaugucuuuggucauggcauggcggacuaucauggccguucuguucguggugaccuuaaucccacucuguagaacaagcugccugcagaaacagucccauugggucgaaauuacugcucuuauccugggggcgcaagccuugcccguguaucucaugacccugaugaagggagcaucaaggcgaagcuggccucuaaacgagggcauuauggcuguuggccugguaagucuucucgggucugcccuguugaaaaaugacgugccccuggccggaccaauggucgcugguggcuuacuccuggcagccuacgugauguccgggagcucggcggaucuuucacuggaaaaggcugccaacguucagugggacgagauggcagauauaacgggaucuaguccuaucauugaagugaagcaggacgaggauggcuccuuuagcauccgggacgucgaggaaacaaauaugauuaccuugcucgugaaacuggcccuaaucacuguaucuggucuguacccccuugcuauaccaaucacaaugacccucugguauauguggcaggucaagacucaacgcagcggggcacugugggaugugccguccccugccgcgacacagaaagcugccuugucagagggaguuuacagaauuaugcagaggggcuuauucggcaagacccaggugggggucggaauccacauggaagguguguuccacacgauguggcauguuacucggggcagugugauuugucacgagaccgggcgacuggaacccagcugggcagacgucagaaacgauaugaucucuuauggaggcgguuggcgccucggggacaaaugggauaaggaggaggacgugcaaguacuggccauagaaccaggaaagaaucccaaacaugugcagacaaagccuggccuuuuuaaaacccugacaggcgagauuggggcuguuacuuuggacuucaagccaggaaccuccgguucacccaucaucaacaggaaaggcaaggucauugggcuauacggaaauggcguggugacgaaaaguggugauuaugucagcgccauaacacaggcagaacguaucggggagccugacuacgagguagaugaagacauuuuucggaagaagagacugacuaucauggaucuccacccgggagcuggcaaaaccaagaggauucugccauccaucgugcgcgaggcccuuaaacgaagauuacggacacugauacucgcgcccaccaggguuguggccgcagaaauggaggaggcuuugcgcggccugccuauccguuaucagacuccagccgucaagucugagcauaccgggagagagauuguggaccucaugugccacgcuacauucacgacucggcugcuuucgagcaccaggguucccaacuacaaucugaucgugauggaugaagcacacuuuacagacccuucauccgucgccgcccgcggauacauuaguacccgaguggagaugggugaagcugcggcaaucuucaugacugccacaccgcccggcgcuaccgauccauuuccucaaucuaacagccccauagaggacauugaaagagagaucccagagcgguccuggaauacgggguucgauuggaucacugacuaucagggaaaaacaguaugguuugugccuucaauuaaggccggcaacgacaucgcaaacugcuugaggaagucugguaaaaagguuauacagcuaagccgcaaaaccuucgauaccgaauaccccaagacuaaacugacagacugggauuuugucgugaccacagacauuagugagaugggggccaauuucagagcuggcagggugaucgauccacggcguugucucaagccggucauuuuaacugacggaccugaacgcguuauccuggcgggccccauaccagugacgcccgccuccgcagcucaacgaagagggaggauuggacggaaccuugcccaggaggaugaccaguauguauucagcggugauccucugaagaaugacgaagaucaugcacacuggaccgaggccaaaaugcucuuggacaacaucuacacaccagagggcaucauucccacucuguuugggccugaacgcgagaagacccaggcuaucgauggagaguucagacucaggggcgagcaacggaaaacauuuguggagcugaugcgaagaggugaccuuccggucuggcuaucuuauaagguggccucagcggggauuuccuacaaagaccgcgaauggugcuucaccggcgagaggaauaaccagauacuggaagagaauauggaaguugagaucuggacucgggagggagaaaagaagaaauugcguccaaagugguuagaugcaagaguguaugccgaccccauggcucugaaagauuuuaaggaguucgccaguggcaggaaaagcauuacgcucgacauccugaccgaaaucgcuucgcuuccuacauaccugucuucccgcgcaaagcucgccuuggauaacauugucaugcugcauacuaccgagagagggggacgagcuuaccagcacgcccuaaaugaacugcccgagagccucgagacacuuaugcugguagcauuauugggugcgaugaccgccggcauauuucuguucuuuaugcaggggaagggaaucggcaaacucucaaugggucugauuacuaucgcuguggccagugggcuucuguggguugcagaaauucaaccacaguggaucgcugccucuauaauccucgaguucuuuuugauggugcuguuaauuccugaacccgagaagcagagaacaccacaggacaaccaacuaaucuaugucauucugacgauccucaccauaauuggccuuaucgcagccaaugaaaugggacugauugagaaaacuaagacagauuucggcuuuuaccaggugaaaaccgagaccacaaucuuggacgucgaucugaggccugcuuccgcguggacucucuaugccguggcaacgaccauacugacaccgaugcuucgccacacuaucgaaaacaccagcgcuaaucucucacuggccgccauugcaaaccaggcugccguuuugauggggcugggaaagggcuggcccuuacaucggauggaccuaggugugccacugcucgcgaugggguguuacagucagguaaauccuacaacccuuacugcuagccuggugauguugcugguccacuaugccaucauuggacccggccuccaagcaaaagccacgagagaggcucagaagcguacagcagccgguaucaugaagaacccaaccguugauggcauaacugugauugaccuggaaccuaucuccuacgaucccaaauucgagaagcagcuugggcaagucauguuacuggugcucugcgcgggacaguugcugcuaaugaggaccacaugggcuuucugugagguacugacucucgccaccggcccgauccuuacacugugggaagggaacccaggacgguuuuggaauacgaccauugcagugucuacugccaacaucuuccgcggcagcuauuuggcuggugccgggcuggcauuuucccucaucaagaaugcucagacaccucgaagaggaaccggcacuacaggugagacccugggcgaaaaguggaaaaggcaguuaaacucacuugaccggaaggaguucgaagaguacaagcgcucugggauucuggagguugacagaacggaagccaaaagugcgcucaaggauggaucgaaaaucaagcaugccgugagcaggggcuccucuaaaauucgauggaucgucgagcgggggauggugaagcccaagggaaaagucguggaccuaggcugcggucgugggggauggucauacuauauggcaacccugaagaauguuacagaaguaaaaggcuacacuaagggcgggccaggacacgaggaacccauaccuauggcuaccuaugguuggaacuuggugaaacugcauagcggcgucgauguguuuuacaagccgacagagcaaguugacacucuccuuugugauaucggggaguccaguucuaaucccaccauugaagagggaagaacacugcgcguguugaagauggucgaaccauggcugagcucaaaaccugaguucugcaucaaggugcucaaccccuauaugccuaccguaauugaagaguuagagaaacugcagaggaagcacggcgguaaucuugugcgguguccacuguccagaaacaguacucacgaaauguacuggguuagcggggccucuggaaauaucgucuccucagugaacacgacaagcaaaaugcuacucaaucgcuuuaccacuaggcaucgaaagcccaccuaugagaaagacguggaucugggcgcaggcacacggucggucucuacggaaaccgagaagccugacaugacuauuaucgggagaagguugcagcgccugcaggaggaacacaaggagacauggcauuacgaucaagaaaacccauaccguaccugggcuuaucacggaaguuacgaggcccccuccacugguagcgccucauccaugguuaauggcgugguaaaacuccuuacaaagccgugggacgugauaccuauggucacccagcuggcgaugacagauacuaccccauucgggcagcagcggguguuuaaagaaaagguugacacgagaacaccccaaccuaaaccaggaacaaggauggugaugacuaccacagcuaacugguuaugggcacuguugggcaagaagaaaaauccccgccucugcacucgagaggaguucauuucuaagguccggagcaacgccgcuaucggugccguguuucaggaagaacagggguggaccagugcauccgaagccguaaacgacagcagauucugggagcugguugauaaagaaagggcucuacaccaagagggaaagugugagucuugcguguauaauaugaugggcaaacgcgaaaagaaacuuggcgaguuugggagagcgaaaggaucacgggccaucugguacauguggcugggugcaagguuccucgaguucgaggcucugggcuuuuugaacgaagaccauugguucgggcgugagaauaguugguccggagucgagggcgaaggucugcaccgacucggguauauucuugaggaaauagauaagaaagacggagaucugauguacgccgacgauacggcaggcugggacacacgcaucaccgaggaugacuuacagaacgaggaacugauuacugagcagauggccccgcaucacaagaucuuggcuaaagccauuuuuaagcucacauaucagaauaagguggugaaaguccugagaccuacaccccggggcgcgguuauggauaucauaagcaggaaggaccaacgcgggucuggacagguggguacuuacggccuaaacaccuucacaaauauggaaguacagcuuaucagacagauggaggcagaaggggugauuacgcaagaugacaugcagaacccaaaaggacugaaggagcgggucgagaaauggcucagggaaugcggcguggaccgacugaagcguauggccaucucgggugaugacuguguugugaaaccuuuggaugagagauuugggaccucauuacuguuccucaaugacaugggaaagguccgcaaggauauuccccagugggaaccaagcaaaggcuggaagaacuggcaggaggugcccuuuugcucccaucacuuccacaaaaucuuuaugaaggacggccggagucuuguaguuccuuguaggaaucaagaugaacugauagggagagcucgcauuucucagggagccgguuggagccuacgggagacugcaugccugggcaaggcuuacgcccagauguggucccucauguauuuccauaggcgagacuugagacuggcuucaauggccaucuguagugcagugccaacagagugguuuccgaccucucggacuacauggagcauccacgcgcaucaccaguggaugaccacggaagauaugcuuaaggucuggaacaggguguggauugaggacaaucccaacaugauagauaagacaccuguucacuccugggaagacaucccauaccuggggaaacgcgaggaccucuggugcggaucauuaauuggccugagcucucgugccaccugggcuaagaauauccauacugccauuacccaagugagaaacuugaucgguaaagaagaguaugucgauuacaugcccgugaugaagcgauauuccgcaccuagugagagcgaagggguacuguga

SEQ ID NO: 15740 - RNA, 9867 nt, Artificial Sequence
  derived and/or modified CDS sequence (opt3) from DENV-4__FJ882582__SS-prME
agcaccauaacccugcucugccuuauucccacugugauggccuuccaccuguccacgcgggacggcgaaccuuugaugauagucgcuaagcaugaaagggggcggccauuacuguuuaaaaccaccgaaggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggaaugggcgugagcugaagugcggaagcggcauuuucgucguggauaacguucauacauggaccgaacaauacaaauuucagcccgagucuccagcccggcuugcaucagcgauccugaaugcucacaaggacgggguguguggaauccgaaguacuacaagauuggagaacguaauguggaaacagauuaccaaugaacucaacuauguccugugggagggcggucacgacuuaacugugguggccggggaugucaagggaguucugaccaaaggcaagagggcacuaacaccucccgccagcgaccucaaguacuccuggaaaacgugggguaaggcuaaaauauucaccccagaagcccgcaauucuacuuuucugaucgauggccccgacacaucggagugcccuaacgaacggagagcauggaauagcuucgagguggaggauuacggguucggaauguuuaccacaaacauuuggaugaaguucagggaaggcuccucagagguaugugaccaucgccuuaugagugcugccaucaaagaucagaaggcggugcacgccgacaugggguauuggauugaaucuagcaaaaaucaaacuuggcagaucgagcgagcuuccuugauagaagucaagaccugccuguggccaaagacgcauacacucuggucaaacggagugcuggagagccagauguuaaucccgaaaucuuacgcaggccccuuuucccagcacaacuaucggcaagguuacgccacccagacuguugggccuuggcaccugggaaaacuugagauugauuucggcgaaugcccagguaccacagugacuauccaggagaauugugaccaucguggccccaguuugagaaccacaacggcuagcgggaaacucgucacccaguggugcuguaggucuugcacuaugccuccacugcgcuuucuaggagaagauggcuguugguaugggauggagauucggccccuguccgagaaggaagagaacauggugaaaucacaaguuacagccggacagggcaccagugaaacuuucagcaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccaugucgggcagaaucgggggacagacacaucuagcuauaauggccguuuucaagauguccccggguuacgugcugggcgucuuucucaggaaacugaccucucgugagacugcacuuauggugaucgggauggcuaugacaaccacauugagcauuccucacgaccugauggaguuaaucgacggaauuucacucggccugauccuucugaagauaguaacucaguucgauaauacccaaguggguacgcuagcccucagucugacauuuauucgcuccaccaugucuuuggucauggcauggcggacuaucauggccguucuguucguggugaccuuaaucccacucuguagaacaagcugccugcagaaacagucccauugggucgaaauuacugcucuuauccugggggcgcaagccuugcccguguaucucaugacccugaugaagggagcaucaaggcgaagcuggccucuaaacgagggcauuauggcuguuggccugguaagucuucucgggucugcccuguugaaaaaugacgugccccuggccggaccaauggucgcugguggcuuacuccuggcagccuacgugauguccgggagcucggcggaucuuucacuggaaaaggcugccaacguucagugggacgagauggcagauauaacgggaucuaguccuaucauugaagugaagcaggacgaggauggcuccuuuagcauccgggacgucgaggaaacaaauaugauuaccuugcucgugaaacuggcccuaaucacuguaucuggucuguacccccuugcuauaccaaucacaaugacccucugguauauguggcaggucaagacucaacgcagcggggcacugugggaugugccguccccugccgcgacacagaaagcugccuugucagagggaguuuacagaauuaugcagaggggcuuauucggcaagacccaggugggggucggaauccacauggaagguguguuccacacgauguggcauguuacucggggcagugugauuugucacgagaccgggcgacuggaacccagcugggcagacgucagaaacgauaugaucucuuauggaggcgguuggcgccucggggacaaaugggauaaggaggaggacgugcaaguacuggccauagaaccaggaaagaaucccaaacaugugcagacaaagccuggccuuuuuaaaacccugacaggcgagauuggggcuguuacuuuggacuucaagccaggaaccuccgguucacccaucaucaacaggaaaggcaaggucauugggcuauacggaaauggcguggugacgaaaaguggugauuaugucagcgccauaacacaggcagaacguaucggggagccugacuacgagguagaugaagacauuuuucggaagaagagacugacuaucauggaucuccacccgggagcuggcaaaaccaagaggauucugccauccaucgugcgcgaggcccuuaaacgaagauuacggacacugauacucgcgcccaccaggguuguggccgcagaaauggaggaggcuuugcgcggccugccuauccguuaucagacuccagccgucaagucugagcauaccgggagagagauuguggaccucaugugccacgcuacauucacgacucggcugcuuucgagcaccaggguucccaacuacaaucugaucgugauggaugaagcacacuuuacagacccuucauccgucgccgcccgcggauacauuaguacccgaguggagaugggugaagcugcggcaaucuucaugacugccacaccgcccggcgcuaccgauccauuuccucaaucuaacagccccauagaggacauugaaagagagaucccagagcgguccuggaauacgggguucgauuggaucacugacuaucagggaaaaacaguaugguuugugccuucaauuaaggccggcaacgacaucgcaaacugcuugaggaagucugguaaaaagguuauacagcuaagccgcaaaaccuucgauaccgaauaccccaagacuaaacugacagacugggauuuugucgugaccacagacauuagugagaugggggccaauuucagagcuggcagggugaucgauccacggcguugucucaagccggucauuuuaacugacggaccugaacgcguuauccuggcgggccccauaccagugacgcccgccuccgcagcucaacgaagagggaggauuggacggaaccuugcccaggaggaugaccaguauguauucagcggugauccucugaagaaugacgaagaucaugcacacuggaccgaggccaaaaugcucuuggacaacaucuacacaccagagggcaucauucccacucuguuugggccugaacgcgagaagacccaggcuaucgauggagaguucagacucaggggcgagcaacggaaaacauuuguggagcugaugcgaagaggugaccuuccggucuggcuaucuuauaagguggccucagcggggauuuccuacaaagaccgcgaauggugcuucaccggcgagaggaauaaccagauacuggaagagaauauggaaguugagaucuggacucgggagggagaaaagaagaaauugcguccaaagugguuagaugcaagaguguaugccgaccccauggcucugaaagauuuuaaggaguucgccaguggcaggaaaagcauuacgcucgacauccugaccgaaaucgcuucgcuuccuacauaccugucuucccgcgcaaagcucgccuuggauaacauugucaugcugcauacuaccgagagagggggacgagcuuaccagcacgcccuaaaugaacugcccgagagccucgagacacuuaugcugguagcauuauugggugcgaugaccgccggcauauuucuguucuuuaugcaggggaagggaaucggcaaacucucaaugggucugauuacuaucgcuguggccagugggcuucuguggguugcagaaauucaaccacaguggaucgcugccucuauaauccucgaguucuuuuugauggugcuguuaauuccugaacccgagaagcagagaacaccacaggacaaccaacuaaucuaugucauucugacgauccucaccauaauuggccuuaucgcagccaaugaaaugggacugauugagaaaacuaagacagauuucggcuuuuaccaggugaaaaccgagaccacaaucuuggacgucgaucugaggccugcuuccgcguggacucucuaugccguggcaacgaccauacugacaccgaugcuucgccacacuaucgaaaacaccagcgcuaaucucucacuggccgccauugcaaaccaggcugccguuuugauggggcugggaaagggcuggcccuuacaucggauggaccuaggugugccacugcucgcgaugggguguuacagucagguaaauccuacaacccuuacugcuagccuggugauguugcugguccacuaugccaucauuggacccggccuccaagcaaaagccacgagagaggcucagaagcguacagcagccgguaucaugaagaacccaaccguugauggcauaacugugauugaccuggaaccuaucuccuacgaucccaaauucgagaagcagcuugggcaagucauguuacuggugcucugcgcgggacaguugcugcuaaugaggaccacaugggcuuucugugagguacugacucucgccaccggcccgauccuuacacugugggaagggaacccaggacgguuuuggaauacgaccauugcagugucuacugccaacaucuuccgcggcagcuauuuggcuggugccgggcuggcauuuucccucaucaagaaugcucagacaccucgaagaggaaccggcacuacaggugagacccugggcgaaaaguggaaaaggcaguuaaacucacuugaccggaaggaguucgaagaguacaagcgcucugggauucuggagguugacagaacggaagccaaaagugcgcucaaggauggaucgaaaaucaagcaugccgugagcaggggcuccucuaaaauucgauggaucgucgagcgggggauggugaagcccaagggaaaagucguggaccuaggcugcggucgugggggauggucauacuauauggcaacccugaagaauguuacagaaguaaaaggcuacacuaagggcgggccaggacacgaggaacccauaccuauggcuaccuaugguuggaacuuggugaaacugcauagcggcgucgauguguuuuacaagccgacagagcaaguugacacucuccuuugugauaucggggaguccaguucuaaucccaccauugaagagggaagaacacugcgcguguugaagauggucgaaccauggcugagcucaaaaccugaguucugcaucaaggugcucaaccccuauaugccuaccguaauugaagaguuagagaaacugcagaggaagcacggcgguaaucuugugcgguguccacuguccagaaacaguacucacgaaauguacuggguuagcggggccucuggaaauaucgucuccucagugaacacgacaagcaaaaugcuacucaaucgcuuuaccacuaggcaucgaaagcccaccuaugagaaagacguggaucugggcgcaggcacacggucggucucuacggaaaccgagaagccugacaugacuauuaucgggagaagguugcagcgccugcaggaggaacacaaggagacauggcauuacgaucaagaaaacccauaccguaccugggcuuaucacggaaguuacgaggcccccuccacugguagcgccucauccaugguuaauggcgugguaaaacuccuuacaaagccgugggacgugauaccuauggucacccagcuggcgaugacagauacuaccccauucgggcagcagcggguguuuaaagaaaagguugacacgagaacaccccaaccuaaaccaggaacaaggauggugaugacuaccacagcuaacugguuaugggcacuguugggcaagaagaaaaauccccgccucugcacucgagaggaguucauuucuaagguccggagcaacgccgcuaucggugccguguuucaggaagaacagggguggaccagugcauccgaagccguaaacgacagcagauucugggagcugguugauaaagaaagggcucuacaccaagagggaaagugugagucuugcguguauaauaugaugggcaaacgcgaaaagaaacuuggcgaguuugggagagcgaaaggaucacgggccaucugguacauguggcugggugcaagguuccucgaguucgaggcucugggcuuuuugaacgaagaccauugguucgggcgugagaauaguugguccggagucgagggcgaaggucugcaccgacucggguauauucuugaggaaauagauaagaaagacggagaucugauguacgccgacgauacggcaggcugggacacacgcaucaccgaggaugacuuacagaacgaggaacugauuacugagcagauggccccgcaucacaagaucuuggcuaaagccauuuuuaagcucacauaucagaauaagguggugaaaguccugagaccuacaccccggggcgcgguuauggauaucauaagcaggaaggaccaacgcgggucuggacagguggguacuuacggccuaaacaccuucacaaauauggaaguacagcuuaucagacagauggaggcagaaggggugauuacgcaagaugacaugcagaacccaaaaggacugaaggagcgggucgagaaauggcucagggaaugcggcguggaccgacugaagcguauggccaucucgggugaugacuguguugugaaaccuuuggaugagagauuugggaccucauuacuguuccucaaugacaugggaaagguccgcaaggauauuccccagugggaaccaagcaaaggcuggaagaacuggcaggaggugcccuuuugcucccaucacuuccacaaaaucuuuaugaaggacggccggagucuuguaguuccuuguaggaaucaagaugaacugauagggagagcucgcauuucucagggagccgguuggagccuacgggagacugcaugccugggcaaggcuuacgcccagauguggucccucauguauuuccauaggcgagacuugagacuggcuucaauggccaucuguagugcagugccaacagagugguuuccgaccucucggacuacauggagcauccacgcgcaucaccaguggaugaccacggaagauaugcuuaaggucuggaacaggguguggauugaggacaaucccaacaugauagauaagacaccuguucacuccugggaagacaucccauaccuggggaaacgcgaggaccucuggugcggaucauuaauuggccugagcucucgugccaccugggcuaagaauauccauacugccauuacccaagugagaaacuugaucgguaaagaagaguaugcagauuacaugcccgucaugaagcgauauuccgcuccuagugagagcgaaggggugcuguga

SEQ ID NO: 15741 - RNA, 9867 nt, Artificial Sequence
  derived and/or modified CDS sequence (opt3) from DENV-4__FJ882584__SS-prME
ucaaccauaacacugcucugccuuauucccacugugauggccuuccaccuguccacgcgggacggcgagccuuugaugauagucgcuaaacaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccacuggggcugacaccucugaaguccacuggaauuacaaagagagaauggugacauucaaggucccccaugccaaaaggcaggaugugaccguucugggaucccaggaaggugcgaugcacucagcccucgcaggcgcuacugagguggacagcggggauggaaaccacauguuugccggccaucugaaguguaagguacggauggaaaaacuucgaaucaaggguaugaguuauacaaugugcucugggaaauucuccaucgacaaggagauggcugagacgcaacacggcaccacugucgugaaaguuaaguacgaaggagccggcgcaccuuguaaggugccaauugagauacgcgaugucaauaaagaaaaggugguagggagagugaucagcgccacaccccuggcugagaacaccaacucgguuacaaauauugaguuggaaccgccuuucggagacucuuauaucgucauaggugugggcaacuccgcgcucacucugcauugguuuaggaaagggucaaguauuggaaagauguucgagagcaccuaccggggcgcaaaacgcauggccaucuuaggugaaacggcuugggauuuuggguccgugggcggacuguucaccucucuaggcaaggccguccaccagguuuuugggagcguguauacaacuauguucggaggcgugucauggaugaucaggauucucaucgguuuucugguacuuuggauugggaccaauaguagaaacacauccauggcaaugacuugcauagccgucggaggcaucaccuuguuccuggguuuuacggugcaggcugacaugggcuguguugugagcuggucugggcgugagcucaagugcggaucaggcauuuucgucguggauaauguucauacauggaccgaacaauacaaauuucagcccgagaguccagcccggcuggcaagcgcgauccuuaacgcucacaaggacgggguguguggaauccgauccacuacaagacuggagaauguaauguggaaacagauuaccaacgaauugaauuauguccucugggagggcggucacgaccugacugugguggccggggaugucaagggaguuuuaaccaaaggcaagagggcacugacaccucccgccucugaccuaaaguacucguggaaaacgugggguaaggcuaaaauauucaccccagaagcccgcaacagcacuuuucucaucgauggccccgacacauccgagugcccuaaugaacggagagcauggaacucauucgagguggaggauuacggguucggaauguuuaccacaaauauuuggaugaaguucagggaaggcaguucugagguaugugaccaucgccugaugagcgcugccaucaaagaucagaaggcggugcacgccgacaugggguauuggauugaauccagcaagaaccaaacuuggcagaucgagcgagcuagccuuauagaagucaagaccugcuuguggccaaagacgcauacacuguggucuaauggagugcucgagucccagaugcugaucccgaaaaguuacgcaggccccuuuagccagcacaacuaucggcaagguuacgccacccagacuguugggccuuggcacuuaggaaagcuggagauugauuucggcgaaugcccagguaccacagugacuauccaggagaacugugaccaucguggccccucucuuagaaccacaacggcuuccgggaaauuggucacccaguggugcuguaggucaugcacuaugccuccacuccgcuuucugggagaagauggcuguugguaugggauggagauucggccccuaagugagaaggaagagaauauggugaaaagccaaguuacagccggacagggcaccucggaaacuuucuccaugggucugcucugccugacacuuuuuguggaggaauguuugagaaggcgagucacccgcaagcacaugauccuggcaguagugauaacguuaugcgcgauuauccucgggggacugacuuggauggaccuucugcgggccuugauuaugcucggcgauaccaugucuggcagaaucgggggacagacacaucuggcuauaauggccguuuucaagaugagcccggguuacgugcuaggcgucuuucugaggaaacucaccucacgugagacugcacugauggugaucgggauggcuaugacaaccacacuuaguauuccucacgacuugauggagcugaucgacggaauuuccuuaggccucauccugcuuaagauaguaacucaguucgauaacacccaaguggguacgcuggcccuaucucucacauuuauucgcagcaccaugucccuggucauggcauggcggacuaucauggccguuuuguucguggugacccugaucccauuauguagaacaucaugccuccagaaacagagccauugggucgaaauuacugcucugauccuuggggcgcaagcccugcccguguauuugaugacccucaugaagggagcaaguaggcgaucuuggccucugaaugagggcauuauggcuguuggccuaguaucccugcuugggagcgcccuccugaaaaacgacgugcccuuggccggaccaauggucgcugguggccuguuacucgcagccuacgugaugucggggucaucugcggaucugagucuugaaaaggcugccaauguucagugggacgagauggcagauauaacgggauccagcccuaucauugaagugaagcaggacgaggauggcucuuuuagcauccgggacgucgaggaaacaaacaugauuacccuguuggugaaacucgcccugaucacuguauccggucuauacccccuggcuauaccaaucacaaugacccuuugguauauguggcaggucaagacucaacgcucaggggcacucugggaugugccgaguccugccgcgacacagaaagcugcccugagcgagggaguuuacagaauuaugcagaggggcuuguucggcaagacccaggugggggucggaauccacauggaagguguguuccacacgauguggcauguuacucggggcucugugauuugucacgagaccgggcgauuagaacccuccugggcagacgucagaaaugauaugaucucauauggaggcgguuggcgccugggggacaaaugggauaaggaggaggacgugcaaguacucgccauagaaccaggaaagaaccccaaacaugugcagacaaagccuggccuguuuaaaacccuuacaggcgagauuggggcuguuacucuggacuucaagccaggaaccagugguagccccaucaucaauaggaaaggcaaggucauuggguuguacggaaacggcguggugacgaaauccggugauuaugucucugccauaacacaggcagaacguaucggggagccugacuacgagguagaugaagacauuuuucggaagaagagacuaacuaucauggaucugcacccgggagcuggcaaaaccaagaggauucucccaucgaucgugcgcgaggcccugaaacgaagacuucggacauuaauacuggcgcccaccaggguuguggccgcagaaauggaggaagcucuccgcggcuugccuauccguuaucagacuccagccgucaagagcgagcauaccgggagagagauuguggaccugaugugccacgcuacauucacgacucggcuccugucauccaccaggguucccaauuacaaccuuaucgugauggaugaagcacacuuuacagacccuaguucugucgccgcccgcggauacauuagcacccgaguggagaugggugaagcugcggcaaucuucaugacugccacaccgcccggcgcuaccgauccauuuccucaauccaauucacccauagaggacauugaaagagagaucccagagcggucuuggaacacgggguucgauuggaucacugacuaucagggaaaaacaguaugguuugugccuagcauuaaggccggcaaugacaucgcaaacugccugaggaagagugguaaaaagguuauacaguugucccgcaaaaccuucgauaccgaauaccccaagacuaaacuaacagacugggauuuugucgugaccacagacauuagcgagaugggggccaacuucagagcuggcagggugaucgauccacggcguugucugaagccggucauucucacugacggaccugaacgcguuaucuuagcgggccccauaccagugacgcccgccucugcagcucaacgaagagggaggauuggacggaauccugcccaggaggaugaccaguauguauucucaggugauccacugaagaacgacgaagaucaugcacacuggaccgaggccaaaaugcuucuggacaauaucuacacacccgagggcaucauuccuacucucuuugggccggaacgcgagaagacccaggcuaucgauggagaguucagauugaggggcgagcaacggaaaacauuuguggagcugaugcgaagaggugaccucccagucuggcuguccuauaagguggccagugcggggauuagcuacaaagaccgcgaauggugcuucaccggcgagaggaacaaucagauacuugaagagaacauggaaguugagaucuggacucgggagggagaaaagaagaaacuacgucccaaguggcuggaugcaagaguguaugccgacccuauggcuuugaaagauuuuaaggaguucgccucgggcaggaaaucuauuacguuagacauccugaccgaaaucgcuucccuccccacauaccugagcucacgcgcaaaacuugcccuggauaauauugucaugcuccauacuaccgagagagggggccgagcuuaccagcacgccuugaacgaacugccagagagucuagagacacugaugcucguagcacuucugggugcgaugaccgccggcauauuuuuauucuuuaugcaggggaagggaaucggcaaauugucuaugggucugauuacuaucgcuguggccuccgggcuccuguggguugcagaaauucaaccucaguggaucgcugccagcauaauccuugaguucuuucugauggugcucuugauucccgaaccagagaagcagagaacaccucaggacaaucaacugaucuaugucauuuuaacgauccuaaccauaauuggccugaucgcagccaacgaaaugggacucauugagaaaacuaagacagauuucggcuuuuaccaggugaaaaccgagaccacaauccuugacgucgaucugaggccggcuucagcguggacuuuguaugccguggcaacgaccauacugacacccaugcuccgccacacuaucgaaaauaccagugcuaaccugagccuugccgccauugcaaaucaggcugccguucucauggggcugggaaagggcuggccauugcaucggauggaccugggugugccuuuacuagcgaugggguguuacucccagguaaaccccacaacccugacugcuucucucgugaugcuucugguccacuaugccaucauuggaccaggcuugcaagcaaaagccacgagagaggcucagaagcguacagcagccgguaucaugaagaauccuaccguugauggcauaacugugauugaccuggaacccaucagcuacgauccgaaauucgagaagcagcucgggcaagucaugcugcuuguguuaugcgcgggacagcugcucuugaugaggaccacaugggcuuucugugagguacugacucuagccaccggcccaauccugacacucugggaagggaacccuggacgguuuuggaacacgaccauugcaguguccacugccaauaucuuccgcggcucauaucuugcuggugccgggcuggcauuuucuuugaucaaaaacgcucagacaccccgaagaggaaccggcacuacaggugagacccugggcgaaaaguggaaaaggcagcucaauagucuggaccggaaggaguucgaagaguacaagcgcucggggauuuuagagguugacagaacggaagccaaaagcgcgcuuaaggauggauccaaaaucaagcaugccgugucuaggggcucaagcaaaauucgauggaucgucgagcgggggauggugaagccaaagggaaaagucguggaccugggcugcggucgugggggaugguccuacuauauggcaacccucaagaacguuacagaaguaaaaggcuacacuaagggcgggcccggacacgaggaaccuauaccgauggcuaccuaugguuggaaucuagugaaacugcauaguggcgucgauguguuuuacaagcccacagagcaaguugacacuuugcugugugauaucggggagucuagcucaaacccaaccauugaagagggaagaacacuccgcgugcuuaagauggucgaaccuuggcuguccaguaaacccgaguucugcaucaagguguugaauccuuauaugccaaccguaauugaagaacuggagaaacuccagaggaagcacggcgguaacuuagugcgguguccccugagcagaaauucuacucacgaaauguacuggguuuccggggccucaggaaacaucgucagcucggugaauacgacaucuaaaaugcuucugaaccgcuuuaccacuaggcaucgaaagccuaccuaugagaaagacguggaucuaggcgcaggcacacggagugucuccacggaaaccgagaagccagacaugacuauuaucgggagaaggcuccagcgccugcaggaggaacacaaggagacauggcauuacgaucaagaaaaucccuaccguaccugggcuuaucacggaagcuacgaggccccgucaacugguuccgccucuagcaugguuaacggcgugguaaaauugcugacaaagccuugggacgugauaccaauggucacccagcucgcgaugacagauacuacccccuucgggcagcagcggguguuuaaagaaaagguugacacgagaaccccucaaccaaaacccggaacaaggauggugaugacuaccacagcuaauuggcuuugggcacuguuaggcaagaagaaaaacccgcgccugugcacucgagaggaguucauuaguaagguccgguccaaugccgcuaucggugccguguuucaggaagaacagggguggaccagcgcaucugaagccguaaacgacucaagauucugggaguugguugauaaagaaagggcucuccaccaagagggaaagugugagaguugcguguauaacaugaugggcaaacgcgaaaagaagcugggcgaguuugggagagcgaaaggaucccgggccaucugguacauguggcuaggugcaagguuccuugaguucgaggcucugggcuuucucaaugaagaccauugguucgggcgugagaacagcuggucuggagucgagggcgaaggucugcaccgauugggguauauucuggaggaaauagauaagaaagacggagaucucauguacgccgacgauacggcaggcugggacacacgcaucaccgaggaugaccuucagaaugaggaacugauuacugagcagauggccccucaucacaagaucuuagcuaaagccauuuuuaagcugacauaucagaacaagguggugaaagucuugagacccaccccacggggcgcgguuauggauaucauaucgaggaaggaccaacgcgggucaggacagguggguacuuacggccucaauaccuucacaaacauggaaguacagcugaucagacagauggaggcagaaggggugauuacgcaagaugacaugcagaauccuaaaggacuaaaggagcgggucgagaaauggcuuagggaaugcggcguggaccgacugaagcguauggccaucagcggugaugacuguguugugaaaccccucgaugagagauuugggaccucccuguuguucuuaaacgacaugggaaagguccgcaaggauauuccacagugggaacccaguaaaggcuggaagaauuggcaggaggugccuuuuugcucucaucacuuccacaaaaucuuuaugaaggacggccggagccugguaguuccauguaggaaccaagaugaacucauagggagagcucgcauuucccagggagccgguuggucacuucgggagacugcaugccugggcaaggcuuacgcccagauguggagucuaauguauuuccauaggcgagaccugagacucgcuucuauggccaucuguagcgcagugccgacagagugguuucccaccucccggacuacauggucaauccacgcgcaucaccaguggaugaccacggaagauauguugaaggucuggaauaggguguggauugaggacaacccuaauaugauagauaagacaccaguucacagcugggaagacauccccuaccuggggaaacgcgaggaccuuuggugcggaucucugauuggccucuccagucgugccaccugggcuaagaacauccauacugccauuacccaagugagaaauuuaaucgguaaagaagaguaugucgauuacaugccugugaugaagcgauauagcgcaccaucggaguccgaagggguacuguga

SEQ ID NO: 15742 - RNA, 9867 nt, Artificial Sequence
  derived and/or modified CDS sequence (opt3) from DENV-4__FJ882585__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgacuauucuggggggacuuaccuggauggaccuguugcgggcccucaucaugcugggcgauacaauguccggcagaauugggggacagacccaucuagcuaucauggccguuuucaagaugucuccggguuacgugcugggcgucuuucucaggaaacugacuagccgugagacagcacuuauggugauagggauggcuaugaccacaacuuugucaaucccucacgaccugauggaguuaauugacggaaucagucucggccugauucuucugaagaucguaacccaguucgauaacacgcaaguggguacacuagcccucucccugaccuuuauacgcucuacuaugagcuuggucauggcauggcggaccauuauggccguucuguucguggugacauuaaucccacucuguagaacuuccugccugcagaaacagucacauugggucgaaaucaccgcucuuauucugggggcgcaagccuugcccguguaucucaugacgcugaugaagggagcaagcaggcgaaguuggccucuaaaugagggcaucauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagccauuacaggaaguuccccuauaaucgaagugaagcaggaugaggacggcagcuuuucuauucgggaugucgaggaaaccaacaugaucacuuugcucgugaaacuggcucuaauuacaguaagcggucuguacccccuugcaaucccaauaaccaugacucucugguauauguggcaggucaagacacaacgcuccggggcccugugggacgugccgucaccugcggcuacccagaaagccgcauugagugagggaguuuacagaaucaugcagaggggcuuauucggcaagacgcaggugggggucggaauucacauggaagguguguuccacacuauguggcauguuacccggggcagcgugaucugucacgagacagggcgacuggaacccucuugggccgaugucagaaaugacaugauuuccuauggaggcgguuggcgccucggggauaaaugggacaaggaggaggaugugcaaguacuggcuaucgaaccaggaaagaaccccaaacaugugcagaccaagccuggccuuuuuaaaacacugacuggcgagauaggggccguuaccuuggacuucaagccaggaacgucagguagucccauuaucaauaggaaaggcaaggucaucgggcuauacggaaacggcguggugacaaaaagcggugacuaugucuccgcaauuacucaggcugaacguauaggggagccugauuacgagguagacgaagauaucuuucggaagaagagacugaccauuauggaccuccacccgggagccggcaaaacaaagaggauccugccaucuauugugcgcgaggcgcuuaaacgaagauuacggacccugauccucgcccccacuaggguuguggcagcugaaauggaggaagccuugcgcggccugccuauacguuaucagaccccagcugucaagucggagcauacagggagagagaucguggaucucaugugccacgcaacguucacuacccggcugcuuagcucaacaaggguucccaauuacaaccugauugugauggacgaagcccacuuuaccgauccuuccagugucgccgcucgcggauacaucucuacucgaguggagaugggugaagcggcagccauuuucaugacagcuaccccgcccggcgccacggacccauuuccucaaagcaauucccccaucgaggauauagaaagagagauuccagagcggucauggaacacuggguucgacuggaucacagauuaucagggaaaaaccguaugguuugugccuucuaucaaggcaggcaaugacauugccaacugcuugaggaagagcgguaaaaagguuauccagcuaagucgcaaaaccuucgacacugaauaccccaagacaaaacugaccgauugggacuuugucgugacaacugauauauccgagaugggggcuaacuucagagcgggcagggugauugacccacggcguugucucaagccggucaucuuaacggauggaccugaacgcguuauucuggccggccccaucccagugacccccgcaagcgcugcccaacgaagagggaggauaggacggaauccugcacaggaggacgaucaguauguauucucuggugacccacuuaagaacgaugaagaccaugcccacuggacagaggcuaaaaugcugcucgauaauauuuacacucccgagggcaucaucccuaccuuguuugggccggaacgcgagaagacacaggccauugacggagaauucagacugaggggcgagcaacggaaaaccuuuguggagcucaugcgaagaggugaucugccagucuggcuuucauauaagguggcguccgcagggaucaguuacaaagaccgcgaauggugcuucacuggcgagaggaacaaucagauucuagaagagaacauggaaguugagauauggacgcgggagggagaaaagaagaaacugcgucccaagugguuggacgccagaguguaugcugauccuauggccuuaaaagacuuuaaggaguucgcuagcggcaggaaaucgaccacacuggauauccucacugaaauugcaucucugcccaccuaccuuuccagccgcgccaagcuggcucucgacaauaucgucauguugcauacaaccgagcgggggggacgagccuaccagcacgcacugaacgaacuaccagagucacuggagacucucaugcuuguagcgcuguuaggugccaugacagcuggcaucuuuuuguucuuuaugcaggggaagggaauuggcaaacugaguaugggucucauaacgaucgccguggcaucugggcugcuuuggguugcugaaauucaaccucaguggaucgccgcauccauuauccuggaguucuuucucaugguguugcugauacccgaaccagagaagcagagaaccccucaggauaaucaauuaaucuaugucauucuaacuauccugacaauuaucggccucauagccgcuaacgaaaugggacuuauugagaaaaccaagaccgacuucggcuuuuaccaggugaaaacagagacuacgauccuggaugucgacuugaggccggcgagcgccuggacccuguaugcaguggcuacaacuauucucacccccaugcugcgccacacaaucgaaaauaccucagccaaccuuagucucgccgcaauagcuaaucaggccgcgguucugaugggguugggaaagggcuggccacugcaucggauggauuuaggugugccucuacuggcuaugggguguuacagccagguaaaccccacuacgcucacagccucccuugugaugcuguugguccacuaugcaaucauuggaccaggccugcaagccaaagcuaccagagaggcacagaagcguacugccgcggguaucaugaagaauccuaccguugacggcauuacagugaucgaucucgaacccauaucuuacgacccgaaauucgagaagcagcuggggcaagucaugcuuuuagugcugugcgcuggacagcucuugcugaugaggacuaccugggccuucugugagguacuaacacuggcaacgggcccaauucucacccuuugggaagggaacccuggacgguuuuggaacacuacaaucgccgugagcaccgcuaauaucuuccgcggcuccuaucuggccggugcaggguuggcuuuuucacugauuaaaaacgcccagacuccccgaagaggaacaggcaccacgggugagacccucggcgaaaaguggaaaaggcagcugaauucuuuagaucggaaggaguucgaagaguacaagcgcagugggauccuugagguugacagaacagaagcgaaaucggcccugaaggacggaagcaaaauaaagcaugcaguguccaggggcucuucaaaaauucgauggaucgucgagcgggggauggugaagccaaagggaaaagucguggaucucggcugcggucgugggggauggagcuacuauauggcuacucuaaagaacguuaccgaaguaaaaggcuacacaaagggcgggcccggacacgaggaaccuauuccgauggccacuuaugguuggaaucuggugaaauugcauuccggcgucgacguguuuuacaagcccaccgagcaaguugauacacugcucugugacaucggggagaguucuagcaacccaaccauagaagagggaagaacucuucgcgugcugaagauggucgaaccuugguugucauccaaacccgaguucugcaucaaggugcugaauccuuauaugccaacgguaauugaagagcucgagaaauuacagaggaagcacggcgguaaccuggugcgguguccccuuaguagaaauagcacacacgaaauguacuggguuucuggggcauccggaaacaucgucucaagcgugaauaccacuucgaaaaugcugcuaaaccgcuuuaccacaaggcaucgaaagccuacguaugagaaagauguggaccucggcgcuggcacccggucugucaguacugaaacagagaagccagauaugaccauuaucgggagaaggcugcagcgcuugcaggaggaacacaaggagacuuggcauuacgaccaagaaaaucccuaccguacaugggccuaucacggauccuacgaggccccgagcaccgguucagcguccucuaugguuaacggcgugguaaaacugcucacaaagccuugggaugugauuccaauggucacucagcuugcuaugaccgacacgacccccuucgggcagcagcggguguuuaaagaaaagguugauacaagaacuccucaaccaaaacccggaaccaggauggugaugacaacuaccgcaaauuggcugugggccuuacugggcaagaagaaaaacccgcgcuugugcacgaaggaggaguucaucagcaaaguccgaaguaaugcugccauaggugcaguguuucaggaagagcagggguggacauccgccagcgaagcuguaaacgacucucgguucugggagcucguugacaaggaaagagcgcugcaccaagagggaaaaugugagucaugcguguauaacaugaugggcaagagggaaaagaaacuaggcgaguuugggcgcgccaagggaaguagagcaauuugguacauguggcuuggugcucgguuccuggaauucgaggcccucggcuuucugaaugaagaucauugguucgggagggagaacuccuggagcggagucgagggcgaagguuugcaccgucugggguauauccucgaggaaaucgacaaaaaggauggagaccuuauguacgcagaugacaccgccggcugggauacucgaauuacagaggacgaucugcagaaugaggaauuaauaaccgagcagauggcuccucaucacaaaauccuggccaaggcgauuuuuaaguugacuuaucagaacaaaguggugaagguccuccgccccaccccaagaggcgcaguuauggacaucauuucucggaaagaucaaagggggucgggacagguggguacauacggccugaauacguucaccaacauggaaguacagcuaauccgccagauggaggccgaaggggugauaacucaagacgauaugcagaauccuaagggacuuaaagagagagucgagaaguggcugcgggaaugcggcguggacaggcucaaacgaauggcuaucucaggugacgauuguguugugaagccccuggacgagcguuuugggacaagcuuguuauuccugaacgauaugggaaaggucagaaaagacauuccacagugggaacccuccaagggcuggaaaaauuggcaggaggugccuuuuugcagucaucacuuccacaagaucuuuaugaaagauggccgcucucucguaguuccaugucggaaccaagacgaacuuauugggagggccagaaucagccagggagcagguuggucccugcgcgagaccgcuugccuaggcaaggccuacgcucagauguggucacugauguauuuccaucggagggaucuccgauuggccaguauggcaauauguucugcggugccgacugagugguuucccacaagcagaaccacgugguccauucacgcccaucaccaguggaugacaaccgaagacaugcugaaggucuggaaucggguguggaucgaggauaacccuaauaugacugacaaaaccccaguucacucaugggaagauauccccuaccuugggaagagggaggaccuguggugcggaagccucauuggcuuaucuucccgcgcuacaugggccaaaaacauacauacugcaaucacccaagugcguaaucugauugguaaggaagaguaugucgacuacaugccugugaugaaaagauauagugcuccaagcgagucggaagggguauuguga

SEQ ID NO: 15743 - RNA, 9867 nt, Artificial Sequence
  derived and/or modified CDS sequence (opt3) from DENV-4__FJ882586__SS-prME
agcaccauaacacugcucugccuuauucccacugugauggccuuccaccuguccacgcgggacggcgaaccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaaacuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgagcccugccgcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuaugucuccgccauaacacaggcagaacguaucggggagccugacuacgagguagaugaagacauuuuucggaagaagagacugacuaucauggaucuccacccgggagcuggcaaaaccaagaggauucugccaucuaucgugcgcgaggcccuuaaacgaagauuacggacacugauacucgcgcccaccaggguuguggccgcagaaauggaggaggcuuugcgcggccugccuauccguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaaaucagguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaguucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagagagggggccgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccaucauuggaccaggccugcaagcaaaagccacgagagaggcucagaagcguacagcagccgguaucaugaagaauccuaccguugauggcauaacugugauugaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauccucacacuuugggaagggaacccuggacgguuuuggaacacgaccauugcagugagcacugccaauaucuuccgcggcuccuaucuggcuggugccggguuggcauuuucacugaucaagaacgcucagacaccccgaagaggaaccggcacuacaggugagacccucggcgaaaaguggaaaaggcagcuaaauucuuuagaccggaaggaguucgaagaguacaagcgcagugggauucuugagguugacagaacggaagccaaaucggcgcugaaggauggaagcaaaaucaagcaugccguguccaggggaucuucaaaaauucgauggaucgucgagcgggggauggugaagccaaagggaaaagucguggaccucggcugcggucgugggggauggagcuacuauauggcaacccuaaagaacguuacagaaguaaaaggcuacacuaagggcgggcccggacacgaggaaccuauaccgauggcuaccuaugguuggaaucuggugaaauugcauuccggcgucgauguguuuuacaagcccacagagcaaguugacacucugcucugugauaucggggagaguucuagcaacccaaccauugaagagggaagaacacuucgcgugcugaagauggucgaaccuugguugucauccaaacccgaguucugcaucaaggugcugaauccuuauaugccaaccguaauugaagaacucgagaaauuacagaggaagcacggcgguaaccuggugcgguguccccuuaguagaaauagcacucacgaaauguacuggguuucuggggccuccggaaacaucgucucaagcgugaauacgacaucgaaaaugcugcuaaaccgcuuuaccacuaggcaucgaaagccuaccuaugagaaagacguggaucucggcgcaggcacacggucugucaguacggaaaccgagaagccagacaugacuauuaucgggagaaggcugcagcgcuugcaggaggaacacaaggagacauggcauuacgaucaagaaaaucccuaccguaccugggcuuaucacggauccuacgaggccccgagcacugguucagccuccucuaugguuaacggcgugguaaaacugcucacaaagccuugggacgugauaccaauggucacccagcuugcgaugacagauacuacccccuucgggcagcagcggguguuuaaagaaaagguugacacgagaaccccucaaccaaaacccggaacaaggauggugaugacuaccacagcuaauuggcugugggcauuacugggcaagaagaaaaacccgcgcuugugcacucgagaggaguucauuagcaagguccggaguaaugccgcuaucggugccguguuucaggaagaacagggguggaccuccgcaagcgaagccguaaacgacucuagauucugggagcucguugauaaagaaagggcucugcaccaagagggaaagugugagucaugcguguauaacaugaugggcaaacgcgaaaagaagcuaggcgaguuugggagagcgaaaggaagucgggccaucugguacauguggcuuggugcaagguuccuggaguucgaggcucucggcuuucugaaugaagaccauugguucgggcgugagaacuccuggagcggagucgagggcgaagguuugcaccgacugggguauauucucgaggaaauagauaagaaagacggagaucuuauguacgccgacgauacggcaggcugggacacacgcaucaccgaggaugaccugcagaaugaggaauuaauuacugagcagauggccccucaucacaagauccuggcuaaagccauuuuuaaguugacauaucagaacaagguggugaaaguccucagacccaccccacggggcgcgguuauggauaucauaucuaggaaggaccaacgcgggucgggacagguggguacuuacggccugaauaccuucacaaacauggaaguacagcuaaucagacagauggaggcagaaggggugauuacgcaagaugacaugcagaauccuaaaggacuuaaggagcgggucgagaaauggcugagggaaugcggcguggaccgacucaagcguauggccaucucaggugaugacuguguugugaaaccccuggaugagagauuugggaccagcuuguuauuccugaacgacaugggaaagguccgcaaggauauuccacagugggaacccuccaaaggcuggaagaauuggcaggaggugccuuuuugcagucaucacuuccacaaaaucuuuaugaaggacggccggucucucguaguuccauguaggaaccaagaugaacuuauagggagagcucgcauuagccagggagccgguuggucccugcgggagacugcaugccuaggcaaggcuuacgcccagauguggucacugauguauuuccauaggcgagaccucagauuggcuaguauggccaucuguucugcagugccgacagagugguuucccaccagccggacuacaugguccauccacgcgcaucaccaguggaugaccacggaagauaugcugaaggucuggaauaggguguggauugaggacaacccuaauaugauagauaagacaccaguucacucaugggaagacauccccuaccuugggaaacgcgaggaccuguggugcggaagccucauuggcuuaucuucccgugccaccugggcuaagaacauccauacugccauugcacaagugagaaaucugaucgguaaagaagaguaugucgauuacaugccugugaugaagcgauauagugcuccaagcgagucggaagggguauuguga

SEQ ID NO: 15744 - RNA, 9867 nt, Artificial Sequence
  derived and/or modified CDS sequence (opt3) from DENV-4__JN819406__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgcccgugagcugaagugcgggucuggaauuuucgucguggauaauguucauacauggaccgaacaauaccaguuucagcccgagucaccagcacggcuugcgagugcuauccugaacgcccacaaagacggcgugugugggauccgaagcacuacaagauuggagaauguaauguggaagcagauuaccaacgaacucaauuauguccugugggagggaggccacgacuuaacugugguggcaggugaugucaaagggguucugaccaagggaaaaagggcccuaacaccucccgcuuccgaccucaaguacucuuggaagacguggggcaaagccaagauauucaccccagaagcacgcaacucgacuuuucugaucgauggucccgacacaagcgagugcccuaaugaacggagagcuuggaacuccuucgagguggaggauuacggcuucgggauguuuaccacaaauauuuggaugaaauucagggaaggaucaagugagguaugugaccaucgccuuaugucugccgcgaucaaggaucaaaaagccgugcacgcugacaugggcuauuggauugaaagcuccaagaaccagacuuggcagaucgagcgagcaucauugauagaagucaaaaccugccuguggccaaagacgcauacacucuggagcaauggggugcuggagucucagauguuaaucccgaaguccuacgccggacccuuuagucaacacaacuaucggcagggcuacgcuacccagacuguugguccuuggcaccuggggaaacuugagauugauuucggagaaugcccaggcaccacagugacuauccaggagaacugugaccaucguggucccagcuugagaaccacaacggccucuggcaagcucgucacccaauggugcuguagguccugcacuaugccuccacugcgcuuucuaggggaagauggauguugguauggcauggagauucggccccugucagagaaagaagagaauauggugaagagucagguuacagcagggcagggaaccagcgaaacuuucucgaugggccuccugugccuuacauuguuuguggaggaaugucugagaaggcgagucacccgcaaacacaugaucuuagcgguagugauaacgcucugcgccauuauccugggugggcuuacuuggauggaccuguugcgggcucucauuaugcugggagauaccauguccggcagaaucggcgggcagacacaucuagccauaauggcaguuuucaagaugucuccgggauacgugcugggugucuuucucaggaagcugaccagccgugagacugcucuuauggugaucggcauggccaugacaaccacauugucaauuccucacgaccugauggaguuaaucgacgggauuagucucggacugauccuucugaaaauaguaacucaauucgauaacacccaggugggcacgcuagcacucucccugacauuuauucgcucuaccaugagcuuggucauggccuggcggacuaucauggcuguucuguucguggugaccuuaaucccacucuguagaacauccugccugcagaagcaaucacauugggucgaaauuacugcgcuuauccugggugcccaggcauugcccguguaucucaugacccugaugaaaggggcuagcaggcgaaguuggccucuaaaugagggaauuauggccguuggccugguaucucuucucggcuccgcccuguugaagaacgacgugccccuggcugggccaauggucgcaggagguuuacuccuggccgcguacgugaugagcggcucgucagcugaucuuucucuggaaaaagccgcaaauguucagugggacgagauggccgauauaacggggaguuccccuaucauugaagugaagcaggacgaggauggaagcuuuucuauccgggacgucgaggaaacaaacaugauuaccuugcucgugaagcuggcucuaaucacuguaagcggccuguacccccuugcaauaccaaucacaaugacccucugguauauguggcaagucaaaacucagcgcuccggugcccugugggaugugccgucaccugcggcuacacagaaggccgcauugagugaggggguuuacagaauuaugcagaggggauuauucggcaaaacccaagugggcgucgggauccacauggaaggaguguuccacacgauguggcauguuacucgggguagcgugauuugucacgagaccggccgacuggaacccucuugggccgacgucagaaaugauaugaucuccuaugggggaggcuggcgccucggugacaagugggauaaagaggaggacgugcagguacuggcuauagaaccagggaagaaccccaagcaugugcagacaaaaccuggacuuuuuaagacccugacaggcgagauuggcgccguuacuuuggacuucaaaccagggaccucaggaagucccaucaucaauaggaaggguaaagucauuggccuauacgggaacggaguggugacgaagagcggcgauuaugucuccgcaauaacacaggcugaacguaucggugagccugacuacgagguagaugaagacauuuuucggaaaaagagacugacuaucauggaucuccacccgggggccggaaagaccaaaaggauucugccaucuaucgugcgcgaggcgcuuaagcgaagauuacggacacugauacucgcccccaccaggguuguggcagcugaaauggaggaagccuugcgcggccugccuauccguuaucaaacuccagcugucaaaucggagcauaccggcagagagauuguggaccucaugugccacgcaacauucacgacucggcugcuuagcucaaccaggguucccaauuacaaccugaucgugauggaugaagcccacuuuacagacccuuccagugucgccgcucgcggguacauuucuacccgaguggagaugggagaagcggcagccaucuucaugacugcuacaccgcccggugccaccgauccauuuccucagagcaauucccccauagaggacauugaaagagagaucccagagcggucauggaacacgggcuucgauuggaucacugacuaucaggggaagacaguaugguuugugccuucuauuaaagcaggaaaugacaucgccaacugcuugaggaagagcggcaagaaaguuauacaacuaagucgcaagaccuucgauaccgaauaccccaaaacuaagcugacagacugggauuuugucgugaccacagacauuuccgagaugggugcuaacuucagagcggggagggugaucgauccacggcguugucucaaaccggucauuuuaacugacggcccugaacgcguuauccuggccggacccauaccagugacgcccgcaagcgcugcccagcgaagaggcaggauugggcggaauccugcacaggaggaugaccaguauguauucucuggagauccacuuaagaacgacgaagaucaugcccacuggaccgaggcuaagaugcugcucgacaauaucuacacacccgaggguaucauuccuacuuuguuuggcccggaacgcgagaaaacccaagccaucgauggggaauucagacugaggggagagcagcggaagacauuuguggagcucaugcgaagaggcgaccugccagucuggcuuucauauaaaguggcguccgcagguauuaguuacaaggaccgcgaauggugcuucaccggggagaggaacaaucagauacuagaagagaacauggaaguugagaucuggacucgggagggcgaaaaaaagaagcugcgucccaaaugguuggaugccagaguguaugcugacccuauggccuuaaaggauuuuaaagaguucgcuagcggaaggaagucgauuacgcuggacauccucaccgaaaucgcaucucugcccacauaccuuuccagccgcgccaaacuggcucucgauaauauugucauguugcauacuaccgagcggggcgggcgagccuaccagcacgcacugaacgaacuaccagagucacuggagacacucaugcuuguagcgcuguuaggagccaugaccgcugguauauuuuuguucuuuaugcaaggcaaggggaucggaaagcugaguaugggccucauuacuaucgccguggcaucuggucugcuuuggguugcugaaauucagccucaguggaucgccgcauccauaauccuggaguucuuucucaugguguugcugauucccgaaccagagaaacagagaacaccucaagacaaucaguuaaucuaugucauucuaacgauccugaccauaauugggcucaucgccgcuaacgaaaugggccuuauugagaagacuaaaacagauuucggauuuuaccaggugaagaccgagaccacaauccuggacgucgauuugaggccggcgagcgccuggacucuguaugcaguggcuacgaccauacucacacccaugcugcgccacacuaucgaaaauaccucagccaaccuuagucucgccgcaauugcuaaucaggccgcgguucugaugggcuuggggaaaggauggccacugcaucggauggacuuaggcgugccucuacuggcuauggguuguuacagccaaguaaaccccacaacccucacugccucccuugugaugcuguugguccacuaugcaaucauugggccaggacugcaggccaaggcuacgagagaggcacagaaacguacagccgcgggcaucaugaagaauccuaccguugaugguauaacugugauugaccucgaacccaucucuuacgauccgaaguucgagaaacaacugggccaggucaugcuuuuagugcugugcgcugggcagcucuugcugaugaggaccacaugggccuucugugagguacuaacucuggcaaccggaccaauccucacacuuugggaaggcaacccugggcgguuuuggaacacgaccauugccgugagcacugcuaauaucuuccgcggauccuaucuggccggcgcagguuuggcuuuuucacugauaaagaacgcccagacaccccgaagagggaccggaacuacaggcgagacccucggugaaaaauggaagaggcaacugaauucuuuagaccggaaagaguucgaagaguacaagcgcaguggcauucuugagguugacagaacggaagcgaagucggcccugaaagaugggagcaagaucaaacaugcaguguccaggggaucuucaaagauucgauggaucgucgagcggggcauggugaaaccaaaggggaaggucguggaccucggaugcggccgugguggguggagcuacuauauggcuacccuaaaaaacguuacagaaguaaagggauacacuaaaggcggccccgggcacgaggaaccuauaccgauggccaccuauggauggaaucuggugaaguugcauuccggugucgauguguuuuacaaacccacagagcagguugacacucugcucugugauaucggcgagaguucuagcaacccaaccauugaagaggggagaacacuucgcgugcugaagauggucgaaccuugguugucauccaagcccgaguucugcaucaaagugcugaauccuuauaugccaaccguaauugaagagcucgagaaguuacagaggaaacacggaggcaaccuggugcgguguccccuuaguagaaauagcacucacgaaauguacuggguuucuggugcauccgggaacaucgucucaagcgugaauacgacaucgaagaugcugcuaaaccgcuuuaccacuaggcaucgaaaaccuaccuaugagaaggacguggaucucggagcuggcacacggucugucaguacggaaaccgagaaaccagacaugacuauuaucggcagaaggcugcagcgcuugcaagaggaacacaaggagacauggcauuacgaucaggaaaaucccuaccguaccugggccuaucacggguccuacgaggccccgagcacuggaucagcguccucuaugguuaacggugugguaaagcugcucacaaaaccuugggacgugauaccaauggucacccagcuugcuaugacagauacuacccccuucggccagcaacggguguuuaaggaaaaaguugacacgagaaccccucagccaaagcccgggacaaggauggugaugacuaccacagcaaauuggcugugggccuuacugggaaaaaagaagaacccgcgcuugugcacucgagaggaguucauuagcaaaguccggaguaaugcugccaucggcgcaguguuucaggaagagcaagguuggaccuccgccagcgaagcuguaaacgacucuagauucugggagcucguugauaaggaaagggcgcugcaccaggaggggaaaugugagucaugcguguauaacaugaugggaaagcgcgaaaaaaagcuaggcgaguuuggcagagccaaggggagucgggcaaucugguacauguggcuuggagcuagguuccuggaauucgaggcccucgguuuucugaaugaagaccauugguucggccgugagaacuccuggagcggggucgagggagaaggcuugcaccgacuggguuauauucucgaggaaauagauaaaaaggacggggaucuuauguacgcagacgauacggccggaugggacacacgcaucaccgaggaugaccugcagaaugaggaauuaauuacugagcagauggcuccucaucacaaaauccuggccaaggcgauuuuuaaauugacauaucaaaacaagguggugaagguccucagacccaccccacggggcgcaguuauggauaucauaucuaggaaagaccagcgcggcucggggcaggugggaacuuacggucugaauaccuucacaaacauggaaguacagcuaaucagacaaauggaggccgaaggcgugauuacgcaggaugacaugcagaauccuaaggggcuuaaagagcgggucgagaaguggcugagggaaugcggaguggaccgacucaaacguauggcuaucucaggcgaugacuguguugugaagccccuggaugagagauuugguaccagcuuguuauuccugaacgacauggggaaaguccgcaaggauauuccacagugggaacccuccaagggauggaaaaauuggcaagaggugccuuuuugcagucaucacuuccacaagaucuuuaugaaagacggccggucucucguaguuccauguaggaaccaggaugaacuuauaggcagagcccgcauuagccagggggcaggauggucccugcgggagacugcuugccuagguaaggccuacgcucagauguggucacugauguauuuccauaggcgagaccucagauuggccaguauggcaaucuguucugcggugccgacagagugguuucccaccagccggacuacaugguccauccacgcccaucaccaauggaugaccacggaagauaugcugaaagucuggaauaggguguggauugaggacaacccuaauaugauagauaagacaccaguucacucaugggaagacauccccuaccuuggcaagcgcgaggaccuguggugcgggagccucauuggauuaucuucccgugcuaccugggccaaaaacauccauacugcaauuacccaggugagaaaucugaucggcaaggaagaguaugucgauuacaugccugugaugaaacgauauagugcuccaagcgagucggaagguguauuguga

SEQ ID NO: 15745 - RNA, 9867 nt, Artificial Sequence
  derived and/or modified CDS sequence (opt3) from DENV-4__GQ199876__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugaucgggagaguaauuuccgccacacccuuggcugagaacaccaacagcgugacaaauaucgagcucgaaccgccuuucggagacucguauauaguuauuggugucggcaacucugcgcugacuuuacauugguuuaggaaaggguccucaaucggaaagauguucgagaguaccuaccggggcgcaaaacgcauggccauccugggugaaacggcuugggauuuugggagcgugggcggacuauucaccucccucggcaaggccgugcaccaggucuuugggucuguuuauacaacuauguucggaggcgugagcuggaugauuagaauccugauugguuuucuuguguuguggauagggaccaauucaaggaacacaaguauggcaaugacuugcaucgccguaggaggcauuacccuguuccucgguuuuacgguccaggcugacaugggcugugugguuuccuggagcgggcgugagcugaagugcggaucuggcaucuucguggucgauaaugugcauacauggaccgaacaauacaaauuucagcccgagucaccagcccggcuugcaagugcgauccugaacgcucacaaggacgggguuuguggaauucgaagcacuacaagauuggagaaugugauguggaaacagauaaccaacgaacucaauuauguacugugggagggcggucacgacuuaacugucguggccggggaugugaagggaguccugaccaaaggcaagagggcacuaacaccucccgccuccgaccucaaguacucuuggaaaacgugggguaaggcuaaaaucuucaccccagaagcccgcaacucgacuuuucugauugauggccccgacacaagcgagugcccuaaugaacggagagcauggaacuccuucgagguugaggauuacggguucggaauguuuaccacaaauaucuggaugaaguucagggaaggcucaagugaggugugugaccaucgccuuaugucugcugccauuaaagaucagaaggcgguacacgccgacaugggguauuggaucgaaagcuccaaaaaccaaacuuggcagauagagcgagcuucauugaucgaagugaagaccugccuguggccaaagacgcauacacucuggagcaauggaguccuggagucucagauguuaauuccgaaauccuacgcaggccccuuuagucagcacaacuaucggcaagguuacgccacccagacuguggggccuuggcaccugggaaagcuugagaucgauuucggcgaaugcccagguaccacaguuacuauucaggagaacugugaccaucguggccccagcuugagaaccacaacggcuucugggaaacucgugacccaguggugcuguagguccugcacuaugccuccacugcgcuuucuaggagaagauggcuguugguaugggauggagauccggccccugucagagaaggaagagaauauggucaaaagucaagugacagccggacagggcaccagcgaaacuuucucgaugggucuccugugccuuacauuguuuguugaggaaugucugagaaggcgagugacccgcaagcacaugauauuagcagucguaauuacgcucugcgcgaucauucuggggggacuuacuuggauggaccuguugcgggcccucaucaugcugggcgauaccauguccggcagaauagggggacagacacaucuagcuaucauggccguguucaagaugucuccggguuacguucugggcguguuucucaggaaacugaccagccgugagacugcacuuauggucauugggauggcuaugacaaccacauugucaaucccucacgaccugauggaguuaauugacggaaucagucucggccugauacuucugaagauugugacucaguucgauaacacccaaguagguacgcuagcccucucccugacauuuauccgcucuaccaugagcuuggugauggcauggcggacuaucauggccguccuguucguugugaccuuaauuccacucuguagaacauccugccugcagaaacagucacauuggguggaaaucacugcucuuauucugggggcgcaagccuugcccgucuaucucaugacccugaugaagggagcaagcaggcgaaguuggccucuaaaugagggcauaauggcugugggccugguuucucuucucggguccgcccuguugaaaaacgacguaccccuggccggaccaaugguggcugguggcuuacuccuggcagccuacgucaugagcgggucgucagcggaucuuucucuggaaaaggcugccaaugugcagugggacgagauggcagauaucacgggaaguuccccuauuaucgaaguuaagcaggacgaggauggcagcuuuucuauucgggacguggaggaaacaaacaugaucaccuugcucgucaaacuggcccuaauaacugugagcggucuguacccccuugcuaucccaauuacaaugacccucugguauauguggcagguaaagacucaacgcuccggggcacugugggaugucccgucaccugccgcgacacagaaagcugccuugagugagggaguguacagaaucaugcagaggggcuuauucggcaagacccagguuggggugggaauucacauggaaggugucuuccacacgauguggcaugugacucggggcagcguuaucugucacgagaccgggcgacuggaacccucuugggcagacgugagaaaugauaugauauccuauggaggcgguuggcgccucggggacaaaugggauaaggaggaggacguccaagugcuggccauugaaccaggaaagaaccccaaacauguacagacaaagccuggccuuuuuaaaacccugacaggcgagaucggggcugugacuuuggacuucaagccaggaaccucagguagucccaucauuaauaggaaaggcaagguuauagggcuauacggaaacggcgucgugacgaaaagcggugauuauguguccgccaucacacaggcagaacguauuggggagccugacuacgaggucgaugaagacaucuuucggaagaagagacugacuauuauggaucuccacccgggagcuggcaaaaccaagaggauccugccaucuauaguacgcgaggcccuuaaacgaagauuacggacacugauccucgcgcccaccagggugguugccgcagaaauggaggaagcuuugcgcggccugccugugcguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaagagcgguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaauucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagcgggggggacgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccaucauuggaccaggccugcaagcaaaagccacgagagaggcucagaagcguacagcagccgguaucaugaagaauccuaccguugauggcauaacugugauugaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauccucacacuuugggaagggaacccuggacgguuuuggaacacgaccauugcagugagcacugccaauaucuuccgcggcuccuaucuggcuggugccggguuggcauuuucacugauaaaaaacgcucagacaccccgaagaggaaccggcacuacaggugagacccucggcgaaaaguggaaaaggcagcugaauucuuuagaccggaaggaguucgaagaguacaagcgcagugggauucuugagguugacagaacggaagccaaaucggcgcugaaggauggaagcaaaaucaagcaugccguguccaggggcucuucaaaaauucgauggaucgucgagcgggggauggugaagccaaagggaaaagucguggaccucggcugcggucgugggggauggagcuacuauauggcaacccuaaagaacguuacagaaguaaaaggcuacacuaagggcgggcccggacacgaggaaccuauaccgauggcuaccuaugguuggaaucuggugaaauugcauuccggcgucgauguguuuuacaagcccacagagcaaguugacacucugcucugugauaucggggagaguucuagcaacccaaccauugaagagggaagaacacuucgcgugcugaagauggucgaaccuugguugucauccaaacccgaguucugcaucaaggugcugaauccuuauaugccaaccguaauugaagagcucgagaaauuacagaggaagcacggcgguaaccuggugcgguguccccuuaguagaaauagcacucacgaaauguacuggguuucuggggccuccggaaacaucgucucaagcgugaauacgacaucgaaaaugcugcuaaaccgcuuuaccacuaggcaucgaaagccuaccuaugagaaagacguggaucucggcgcaggcacacggucugucaguacggaaaccgagaagccagacaugacuauuaucgggagaaggcugcagcgcuugcaggaggaacacaaggagacauggcauuacgaucaagaaaaucccuaccguaccugggcuuaucacggauccuacgaggccccgagcacugguucagccuccucuaugguuaacggcgugguaaaacugcucacaaagccuugggacgugauaccaauggucacccagcuugcgaugacagauacuacccccuucgggcagcagcggguguuuaaagaaaagguugacacgagaaccccucaaccaaaacccggaacaaggauggugaugacuaccacagcuaauuggcugugggcauuacugggcaagaagaaaaacccgcgcuugugcacucgagaggaguucauuagcaagguccggaguaaugccgcuaucggugccguguuucaggaagagcagggguggaccuccgcaagcgaagccguaaacgacucuagauucugggagcucguugauaaagaaagggcucugcaccaagagggaaagugugagucaugcguguauaacaugaugggcaaacgcgaaaagaagcuaggcgaguuugggagagcgaaaggaagucgggccaucugguacauguggcuuggugcaagguuccuggaauucgaggcucucggcuuucugaaugaagaccauugguucgggcgugagaacuccuggagcggagucgagggcgaagguuugcaccgacugggguauauucucgaggaaauagauaagaaagacggagaucuuauguacgccgacgauacggcaggcugggacacacgcaucaccgaggaugaccugcagaaugaggaauuaauuacugagcagauggccccucaucacaagauccuggcuaaagccauuuuuaaguugacauaucagaacaagguggugaaaguccucagacccaccccacggggcgcgguuauggauaucauaucuaggaaggaccaacgcgggucgggacagguggguacuuacggccugaauaccuucacaaacauggaaguacagcuaaucagacagauggaggcagaaggggugauuacgcaagaugacaugcagaauccuaaaggacuuaaggagcgggucgagaaauggcugagggaaugcggcguggaccgacucaagcguauggccaucucaggugaugacuguguugugaaaccccuggaugagagauuugggaccagcuuguuauuccugaacgacaugggaaagguccgcaaggauauuccacagugggaacccuccaaaggcuggaagaauuggcaggaggugccuuuuugcagucaucacuuccacaaaaucuuuaugaaggacggccggucucucguaguuccauguaggaaccaagaugaacuuauagggagagcucgcauuagccagggagccgguuggucccugcgggagacugcaugccuaggcaaagcuuacgcccagauguggucacugauguauuuccauaggcgagaccucagauuggcuaguauggccaucuguucugcagugccgacagagugguuucccaccagccggacuacaugguccauccacgcgcaucaccaguggaugaccacggaagauaugcugaaggucuggaauaggguguggauugaggacaacccuaauaugacagauaagaccccaguucacucaugggaagacauacccuaccuugggaaacgcgaggaccuguggugcggaagccucaucggcuuaucuucccgugccacuugggcuaagaacauucauaccgccaucacacaagugagaaaucugauugguaaagaagaguaugucgauuacaugccugugaugaagcgauauagugcaccaagcgagucggaagggguauuguga

SEQ ID NO: 15746 - RNA, 9867 nt, Artificial Sequence
  derived and/or modified CDS sequence (opt3) from DENV-4__KP723482__SS-prME
agcaccaugacccugcucugccuuauccccacugugauggcauuccaccuguccacgcgggacggcgagccuuugaugauugucgcuaagcaugaaagagggcggccauuacuguuuaagaccacagaggggauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaaugguaacacucacgccgucgggaaugauaccagcaaccacggcgugacagcaaccauaacuccucguuccccaucaguagagguuaaguuaccggacuacggagaacugacgcucgauugcgagccccgcaguggcauugacuucaaugagaugauccuuaugaagaugaaaaagaaaacauggcuggugcauaagcagugguuuuuggaccuaccucugccauggaccgcuggggccgauacuagcgaaguccacuggaacuacaaagagagaauggugaccuucaaggucccccaugcgaaaaggcaggacgugacaguucucggaucucaggaaggugccaugcacuccgcacuggcuggcgccaccgagguggauucaggggacggaaaucacauguuugcuggccaucuuaaguguaagguacggauggaaaaacugcgaauuaaggguaugagcuauacuaugugcagugggaaauucucuaucgauaaggagauggccgagacacaacacggcacgaccgucgugaaaguuaaguacgaaggagcaggcgccccuuguaaggugccaaucgagauucgcgacgucaacaaagaaaaggugguagggagaauaaucuccagcacucccuucgcugagaacacaaauucggugaccaacauugaguuggaaccgccuuuuggagauucuuauaucguuauaggugucggcgacuccgcgcucacacugcauugguucaggaaagggucaaguauuggaaagauguuugagagcacuuaccggggcgcaaaacgcauggccaucuuaggugaaaccgcuugggauuucggguccgugggcggacuguuuacgucucuaggcaaggccgugcaccaggucuucgggagcguuuauaccacaauguuuggaggcgugucauggaugaucaggauucucaucgguuuccuggugcuuuggauugggacuaauaguaggaacaccuccauggcaaugacaugcauagccguaggaggcaucacuuuguuucuggguuucaccguccaggcugacaugggcugugugguuagcuggaaugggaaggagcucaaaugcggaucuggcauuuuuguggucgauaacgugcauacguggacagaacaauacaaguuccagcccgagucaccagcccgucuggcaagugcgauccuuaaugcucacaaagacgggguuuguggaauccggagcaccacucgacuggagaacgugauguggaagcagauuacaaaugaauugaacuauguacucugggagggcggucacgaccugaccgucguggccggggaugugaaaggagucuuaacuaagggcaagagagcacugaccccucccguuaaugaccuaaaauacuccuggaagacaugggguaaagccaagauauuuacgccagaagcuaggaacucuaccuuccucaucgauggccccgacacuucggagugcccuaaugaacgccgggccuggaacuucuuugagguggaggauuacggguucggaauguuuacaaccaauauuuggaugaaauucagagaaggcagcuccgagguaugugaccauaggcugaugucagcagcuaucaaggaucagaaagccgugcacgcggacaugggguauuggauugaaaguucuaagaaccaaacauggcagaucgagaaggccagccuuauagaagucaaaacuugcuuguggccaaagacccauacgcugugguccaacggagugcucgagucacagaugcugaucccgcgcagcuacgcuggccccuuuucucagcacaauuaucgacaagguuacgcaacacagaccgccgggccuuggcacuuaggaaaacuggagauugauuucggcgaaugcccagguacuaccguuacaauccaggaggacugugaucaucggggccccucccuucguacuaccacagcuagugggaaguuggugacgcaguggugcuguagaagcugcaccaugccuccacucagguuucugggagaagacggcuguugguaugggauggagauucgcccccuaucugagaaagaagagaacauggucaagucccaagugacugccggacagggcacaucagaaaccuucaguaugggucugcucugccugacucuuuuuguugaggaauguuugcggagaagggugacacgaaagcacaugauccuggcagucguaauaaccuucugcgcgauuaucuuagggggacucacguggauggaucugcuucgcgugcugauuauguugggcgacacuaugagcggccggaucgggggacagauacaucucgccaucauggcuguuuuuaaaaugucgccggguuacgugcugggcgucuuccuaagaaagcugaccuccagggagacagcccucauggugauugggauggcaaugaccacuguauuuucuaucccucacgaccugauggagcuuauugauggaaucagcuugggccugauauuacucaaaauugugacacauuucgacaauacccaggucgguacacuggcucuuucacugacuuucauccguaguaccacgccccugguuauggccuggcgcacaaucauggcaguguuuuucguggucacccucauuccccugugucggacuuccugcuugcaaaagcagucucacuggguggaaaucaccgcccugauuuuaggggcucaggcgcucccuguuuaucugaugacacuuaugaaaggagccagcagaagguccuggccccugaacgagggcauaauggcaguaggcuuggugucacuccuggggagcgcucuacugaagaaugaugucccacuugccggaccuaugguggccgguggccuccuguuggcugcauacguuaugagugggucuuccgccgaccugagcuuagaaaaggcggcuaacgugcaaugggaugagauggccgacaucacuggaucgucacccauuaucgaagucaaacaggaugaggacggcucuuuuaguauucgagauguggaggaaaccaauaugaucacgcuccugguaaaacuugcacugauaacagucuccgguuuguacccacucgccaucccggugaccauggcucugugguauguuuggcaagugaaaacucagcggagcggggcacuaugggacgucccuucucccagcgccacacaaaaggcgacccuguccgagggaguguaccgcauuaugcagagaggccuuuucggcaaaacucagguuggggugggaauccacauggaaggugucuuucauacaauguggcacgugaccaggggcucaguaauuugucaugagacggggcggcucgaaccaaguugggcugaugugcgaaacgacaugaucagcuauggaggcgguuggagacugggggauaagugggacaaggaggaggacguucaggucuuggccauagaacccggcaagaauccuaagcacgugcaaacuaaaccaggcuuauucaagacccugacaggcgagauuggggcagugacccucgauuuuaaacccggaacaucugguuccccuaucaucaacaagaaaggcaaggucauugggcuguacggaaauggcguagugacuaagucaggugacuauguuagugccauaacccaggcugaacgcaucggggagccggauuacgagguggacgaagauauuuucaggaaaaagcgucuuacgaucauggaccugcauccaggagccggcaaaacaaagcggauuuugcccagcaucgucagagaggcacuaaaaaggcgccugcgaacucucauacuggcuccuaccagagugguugccgcggaaauggaggaagcccuucggggcuuaccaaucagguaucagacacccgcagugaaguccgagcacaccgggcgcgagauugucgaucugaugugccacgcuacuuuuaccacacgucucuugucuucgacgagagugccuaacuacaaucugaucguaauggacgaagcccauuucacugauccgugcagcguggcugcacggggauacauuucaaccaggguugagaugggugaagccgccgcuaucuuuaugacagcgacaccaccaggcuccauagacccuuucccccagaguaacucuccaauugaggauaucgaacgcgagaucccugagcgaagcuggaauacuggguucgacuggauuacagacuaucaaggaaagaccgucugguuugugcccuccaucaaagcaggcaacgauauagccaacugucucagaaagucagguaaacgggugauucagcugucuaggaagacguucgacacugaauacccaaaaacaaaacuuaccgauugggacuuugucguuaccacugauaucagcgagaugggggcuaauuuccgcgccggcagagugauugacccgaggcggugccugaagccuguaaucuugacagauggacccgaacgugugauacuagcaggcccaauucccgucaccccugccagugcugcgcagcgccgagggagaaucggaaggaacccagcccaagaggacgaucaguauguguuuuccggugacccccugaaaaaugaugaagaccacgcacauuggacagaggcuaagaugcucuuagauaacaucuacacuccugagggcauuaucccgacgcuguucgggccagaacgggagaaaacccaggccauugacggagaauuucgccuuagaggcgagcagaggaagacauucguugagcugaugcggcgaggugaccuccccgugugguugagcuauaaagucgcaucugccgggauaucauacaaggauagagaaugguguuuuacuggcgagcgcaauaaccaaauccuggaagagaauauggaaguagagauuuggaccagggagggagaaaagaaaaagcuccggccuaaauggcuggacgcucguguguaugccgaucccauggcgcuuaaggacuucaaagaguuugcauccggcagaaagaguaucacacuagauauccugaccgaaauugccacuuugccaacguacuuaagcucgaaggcuaaacuggcccucgacaacauaguuaugcugcacaccacagagaaaggugggagggcuuaccagcacgcacuuaaugaacugccugagucucucgagacuuugaugcugguggcccuacugggggcuaugaccgccggcaucuuccucuuuuucaugcaggggaaaggaauuggcaaacuuuccaugggucugaucgcaauugcggucgccagcggguuauuguggguggcugaaauccagccccaauggauagccgcaucaaucauucuggaguucuuucucaugguccugcuuaucccagaaccugagaaacagcgcacaccgcaggauaaccagcugauuuaugugauccucaccauauugacuauuaucggccugauugcugccaaugaaaugggauuaaucgagaagacaaaaacggacuucggcuuuuaccaaguuaagcccgagaccacuauacuagauguggaccugcggccagcaagugccuggacacucuaugcuguagcgaccaccauccuuacaccuaugcugcgacauacuauugaaaacacgucugccaauuugucccuggcagcuaucgccaaccaggccgcagugcucauggggcugggaaagggcuggccccuucacagaauggaucucggugucccacuguuggcuauggggugcuacagccagguuaauccuaccacacugacugccucauuagugaugcuacugguccauuaugcgauuaucggacccggccuccaggcuaaagccaccagggaggcacaaaagcgcacagccgcugguauaaugaaaaacccgaccguggacggcauuacuguaaucgaucuugaaccaaucaguuacgacccuaaguucgagaaacagcugggacaggugauguugcugguucucugugugggacaacugcuuuuaaugcggacgacaugggcacugugcgagguccucaccuuggccacuggccccgugaugacccugugggaagggaacccaggaagauuuuggaauacaacuauugcggucagcaccgcuaacaucuuccguggcuccuaucuagccggugcagggcuggccuuuucucucauaaagaaugcucagacacccaggcggggaacgggcaccacuggugagacacuuggcgaaaaguggaaacgccagcugaacagcuuggaccgaaaggaguucgaagaguacaaaagauccgggauucuggagguggauaggaccgaagccaagucagcacuccgggacggaacuaaaaucaaguacgcuguuucucgcggcaguucgaagauuagauggaucguagagagggggaugauaaaaccuaagggaaaaguggucgaucugggcuguggucgagggggauggagcuauuacauggccacauuaaagaaugugaccgaaguuaaaggcuauacgaagggcgggccgggacacgaggaacccaucccaauggcgaccuacgguuggaaccuugugaagcugcauuccggcgucgacguguuuuauaaaccuacagagcagguagauacucuccuaugcgacauuggggagucuucaagcaaucccaccaucgaagagggacggacacugcguguguugaagaugguugaaccuuggcuguccaguaaaccagaguucuguauuaagguccucaaccccuacaugccuacugugaucgaagaacuugagaaacugcaaagacgccacggcgguucuuuggugaggugcccacugagcagaaauucaacccacgaaauguauugggucuccggggccaguggaaacauuguuagcucugugaauacaaucuccaagaugcucuuaaacagauuuaccacucgccauaggaaacccacguacgagaaggauguagaccugggcgcaggcacacgaucagugagcaccgaaacugagaagccggauaugaccgucauagggcggagacuucagaggcugcgcgaggaacacaaagagacauggcauuacgaccaggaaaauccuuaucguacgugggcuuaccacggaucguaugaggccccaucuaccgguagugcauccagcauggugaacggcguugugaagcuacucacuaaacccugggaugucauuccuauggugacacagcuggcuaugaccgacacuacaccauucgggcaacagcggguauuuaaggaaaaaguugacaccagaacaccccagccgaagccuggaacuaggaugaucaugaccacgaccgccaauugguugugggcccugcucggcaagaaaaagucaccccgccuuuguacacgagaggaguucaucuccaaagugcggucuaacgcggcuauuggugcagucuuccaggaggaacagggguggacuagcgccagugaagcugugaaugauuccagauuuugggagcugguggacaaggaaagggccuuacaccaggagggaaaaugcgagagcugcgucuacaacaugaugggcaagcgcgaaaagaaacugggcgaguucgggagagcaaagggaucucgggccauaugguauaugugguugggugcuagguuucucgaguucgaggcgcugggcuuucuaaacgaagaucauugguucucacgugagaauaguugguccgggguugagggagaaggccuucaccgacuggguuacauccucgaggacauugauaaaaaggacggggaucugaucuaugccgacgauaccgcaggaugggacacacgcauuacugaagaugacuugcugaacgaggagcucaucaccgaacagauggcuccacaucacaaaacgcuugccaaggcaauauuuaagcugacauaccaaaauaaagugguaaagguguuaagaccuacccccaaaggcgccgucauggauaucauuagccggaaggaccagaggggcucuggacaggugggaacuuacggucugaacacauucaccaauauggagguucaguugauccgccaaauggaagcugagggcgugauuacucaggacgauaugcagaacccaaaagggcucaaggaaagagucgagaaauggcugaaggaguguggaguggaccggcuaaagaggauggccaucucgggcgaugacugcguaguuaaaccccuugaugaacgauuuucaaccagccuacucuuccugaaugacauggguaaggugcguaaagauauaccucagugggagccauccaagggguggaaaaacuggcaagaagucccguuuuguagucaucacuuccacaagauuuuuaugaaggacggaagaucuuuggugguucccugccgcaaucaggaugaguuaaucggccgggcgaggaucagccagggcgcaggguggucccugagagaaacagccugucucggaaaggcuuaugcccagauguggucacuuauguacuuccaucgccgggaccugaggcuagcaaguauggcuauuugcucugccgugccuacggagugguucccaaccagccgaacuacaugguccauacacgcucaucaccaauggaugaccacugaggauaugcugaaggucuggaacagaguguggaucgaagacaaucccaacaugacagacaaaaccccuguacacucaugggaggauauuccauaucucgguaagcgggaagacuugugguguggcagccugaucgggcuuucuuccagggccacgugggccaagaauauucauacagcgaucacccaggugcgcaaccugauaggaaaggaggaauacgucgauuauaugcccgccaugaagcguuacagugcuccuuuugagagcgagggcguucucuga

SEQ ID NO: 15747 - RNA, 9867 nt, Artificial Sequence
  derived and/or modified CDS sequence (opt3) from DENV-4__JN638570__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucugccuggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauaugguggaccggggcuggggcaacgggugcggacuguucgguaaaggcggggucguuacgugcgccaaguuuucuuguuugggaaaaauuaccggcaaucucgugcaaaucgagaaccuggaauauacaguaguggucacugugcauaauggugauacccacgcaguugggaacgacacaagcaaucacggcgugacugcuaccauuacaccucguuccccaucagucgaggugaaguuaccggauuacggagaacugacccucgacugcgagccccgcaguggcaucgacuucaacgagaugauccuuaugaagaugaaaacuaagacguggcugguacauaaacagugguuuuuggaucuaccucugccauggacaaccggggccgacacucucgaaguucacuggaaucauaaggagagaauggugaccuucaaagucccccacgcgaagaggcaggaugugacaguccugggaagccaggaaggugccaugcacucugcacuugcuggcgccaccgagguggacuccggggauggaaaccauauguuugcuggccaccugaaauguaagguucggauggaaaaguugcgaauuaaagguaugucauacacuaugugcagcgggaaguucaguauagacaaagagauggccgagacacaacauggcacgaccgugguaaaggucaaauaugaaggaacuggcgcaccuuguaaggugccaaucgagauucgcgauguuaauaaggaaaaaguggucgggagaaucauaucuuccacacccuucgccgagaacaccaacagcgugacaaauauugagcucgaaccgccuuuuggagacucguacaucguaaucggugugggcgauggggcucugacuuuacacugguucaggaagggaucuuccauuggcaaaauguuugagucaaccuaucggggugcgaagcgcauggcaauccugggggaaacggccugggacuucggcaguguuggaggccuacucaccagccuggggaaagcuguccaucagguguuuggauccguguacacaacuauguucggcggugucucuuggaugguuagaauucuuauaggguugcuggugcucuggaucggaaccaacagcaggaauacaucaauggccaugaguugcauugcagugggcgguaucacucuguuucuuggcuucaccguacacgccgauauggggugugucguguccuggagcggaaaggagcugaagugcggcucugggaucuuuguuauugacaacgugcacacguggacagaacaguauaaauuccaacccgagucaccagcucguuuggccagugcaauacucaaugcgcauaaggagggagucuguggcauccggagcaccacucgacuggaaaacgugauguggaaacagauuacaaaugaguuaaacuacguucugugggaaggugggcacgaccuaaccgugguagcuggagaugucaagggcgugcucuccaaagguaagagagcccuggcaccucccgugaaugaccuuaaguauucuuggaaaacuuggggcaaggccaaaaucuuuaccccagagacaaggaacucgacguucuuggucgaugggcccgacaccagcgaaugcccuaaugagcgccgggcuuggaacuuucuggagguugaagauuacggauucggcauguucacuacaaauauuuggaugaaguuuagagagggguccccagaagugugugaccauaggcucaugucagccgcaaucaaagaucagaaggcuguacacgccgacaugggauacuggauagagaguucuaaaaaccagaccuggcaaaucgaaaaggcgagccugauugaggugaagacaugcuuauggccgaaaacucacacccugugguccaauggcguccuugagucacagauguugauccccaaggccuaugcugguccuauuagccagcauaacuaccgccagggguaugcaacgcaaacagccggaccauggcaccucggcaaacuggaaaucgauuucggugagugccccggcaccacugugaccguucaggaagacugugaucaucgagggccuucucuacggacaacuaccgcuuccggaaagcuggugacacaguggugcugucguaguugcacgaugccaccccucagauuucugggcgaggacggguguugguacggaauggagauaaggccgcuuaacgaaaaagaggaaaauauggucaagagccaggugucugccggccaagguaccuccgagacuuucucaaugggguugcugugcuuaacacucuuuguugaagagugucugcgccggagagugaccaggaagcacaugaugcuugucguagugacuacacugugcgcaauuaucuugggaggccucaccuggauggaucugcuacgagcgcugauuaugcucggcgacacgaugagugggcgcaugggaggucagauccaucuggccauaauggcuguuuucaaaaugagcccuggcuaugugcuugggaucuuuuugcggaagcugacuucgagagagaccgccuuaauggucauuggaauggcaaugacaaccgugcucgcuaucccacacgaccugauggaauucauugauggcaucucccuuggucugauacuacucaaaaugguaacucacuuugacaacacacagguggggacccuggccuuggcacugacauucauuaagucuacuaugcccuuagucauggccuggaggaccaucauggcuguucucuuuguggugacgcugaucccucuuugucguacaagcugccugcagaaacaaucacauugggucgagauuaccgcguugauccucggagcccaggcacugcccguguaccuaaugacucugaugaagggcgcuaguaagcgcuccuggccacuuaaugaaggcauuauggccguugggcucguaucucuguugggaagcgcccuguuaaaaaacgaugugccucucgcuggucccauggucgcaggcgggcugcuucuggccgcguaugugauguccggaucaagcgcugacuugagucucgagaaggccgcaaauguucggugggaugaaauggccgacauaaccggcucuuccccaaucauugaggugaaacaggaugaggacgguagcuucucgaucagagaugucgaagagacaaacaugauuacucugcuagugaagcuggcucuuaucaccguaucagggcucuacccgcuggcaauaccugucacgaugacauugugguacauguggcaagugaaaacccagaggucuggagccuuaugggacguucccaguccagcggcugcccagaaggcaacucugacagaaggcguguaucgaaucaugcagcggggccucuuugggaagacccaagucggaguggguauucacacugagggcguuuuccauacaauguggcacgugacccgcggguccgucaucugucaugaaagcggaagacuggagcccucuugggccgaugugaggaaugacaugauuagcuacggcgguggguggcggcuuggagauaaaugggacaaggaggaagacguacaggugcuggcuaucgagccuggcaaaaacccaaagcacguucagacgaaacccggcuuguucaagacucuaaccggggaaauaggagccgucacacuggauuuuaaaccugguaccuccggcucaccgauuaucaaucgaaaggggaaggugaucggacucuauggcaacgguguggucacaaaaaguggggacuacguaagcgcaauuacucaggcugagagaauaggagagccagauuaugaaguggacgaggauaucuuccgcaagaaaaggcugaccauuauggaccuucaccccggcgccggcaagacgaaacguaucuuaccuucuauuguucgggaagcgcugaagagaaggcuccgcacauugauccuggccccaacucgaguggucgcagcugagauggaagaggcccucagagggcugcccauacgguaccaaaccccugcugugaaguccgagcauacaggaagggaaaucguugaucuuaugugccacgcaaccuuuacuacccgccuguugucaaguacacgugugccgaauuauaaccuaauugucauggacgaggcccauuucacggaucccagcuccguggccgcuagagguuacaucucuacucggguagaaaugggcgaggcggcagccauuuuuaugaccgcuacaccaccugggaccacugaccccuucccacagucgaauagcccuaucgaagauauagagagggagauucccgaacgcucauggaacacaggauuugacuggaucaccgacuaccagggcaaaacggugugguucguuccauccaucaaggccgguaaugauauugcaaacugccugcgaaaaagugggaagaaagucauccagcucucuagaaagacuuuugacacagaguauccgaagaccaaauuaaccgauugggacuucguggugacuacagauauaagcgaaaugggcgccaacuuucgggcuggaagggucauugacccucgcagaugucugaagcccguuauccuuaccgauggcccagagagggugauucuggcggggcccaucccuguaacaccagccuccgcagcucaacggcguggacgcauaggucgaaaucccgcccaggaagacgaucaguacguguucucaggcgacccucucagaaacgaugaggaccacgcacacuggacugaggccaaaauguugcuggauaauauuuauacgccggaagggaucaucccaacccucuucggacccgagagggaaaagacacaagcuauugacggcgaguuucggcugcgcggugagcagagaaaaacuuucgucgaacuuaugaggcggggggaccuaccuguguggcugucuuacaagguugccagcgcgggcaucaguuauaaggaucgagaguggugcuuuaccggagaaagaaacaaucagauuuuggaggaaaacauggagguggagauauggacacgcgaaggcgagaaaaagaaauuaaggcccaaguggcuggacgcacgggucuacgccgauccaauggcucucaaagacuucaaggaauuugccuccgggcguaagagcaucacccuggauauucuuacugagaucgcuucucugccuacguaucucucauccagagcaaaauuggcccuggacaauaucguaaugcuacauaccacagaaaggggagguaaggcuuaccagcacgcccugaacgagcuccccgagagucuugaaacucugauguuaguggcauugcugggcgcgaugaccgccgggauuuuccucuuuuucaugcaaggaaaaggcauagguaagcugagcauggggcuuaucgcuauugccguugcaucgggccugcucuggguggcugagauccagccacaguggauugccgcaucuaucauauuggaauuuuuccugauggucuuacuagugccugagccggaaaaacagcgcacaccccaagauaaucagcugaucuacgucauucucaccauccuuacuauuaucgcccugguggcugcgaacgagaugggauugauagagaagacaaaaacggacuuuggcuucuaucagguuaaggccgaaaccacuauucuggauguggaccuccggccagcauccgcuuggacacuguacgccguagccaccaccauccuuacaccuaugcuccgacauacuauugagaauacgagcgcaaaccugucauuggcugccaucgcgaaucaggcugccgugcugaugggguuaggaaagggcuggccccuacacagaauggaucugggugucccacuccuugcaaugggguguuauagucaaguuaacccuaccacacugacugccucuuuggugaugcugcucguccauuacgcuauaaucggacccggccugcaggcaaaagccaccagggaagcgcagaagcgcacagcugccgguauuaugaaaaauccgaccguggacggcaucacuguaauugaucuugagccaaucuccuaugacccuaaguuugagaaacaguuagggcaagugaugcugcucguuuugugcgcaggacagcugcuacugaugcggacgacaugggccuucugugaagugcucacccuugcuacuggccccauacugaccuugugggaggggaacccaggaagauucuggaacacaacuauugccgucagcaccgcaaauaucuuucguggcucauaccuggcuggugccgggcucgcguucagucugaucaagaacgcccagacacccaggcggggaacgggcaccacuggugaaacauuaggcgagaaguggaaacgccaacuuaauagccuggaccgaaaggaauuugaggaguauaaaagauccgggauucucgaaguggauaggaccgaggcaaagucugcucuaaaagacggaagcaagaucaaguacgccgucucccggggcacuucaaaaauacgcuggauuguggaaagagggaugguuaagccuaaaggaaagguaguggaucugggcugcgguagggggggauggucuuacuauauggcaacauugaaaaacgucaccgaggugaagggcuacacgaagggcgggccgggacacgaagagcccaucccaauggcuaccuaugguuggaaucugguuaaacuccacaguggcguggacgucuucuacaagccuacagagcagguggauacucuucugugugacauuggggaaucgagcuccaaccccaccaucgaggaaggacgaacauugcggguacugaaaaugguggagccuuggcucucuucaaagccagaauuuugcauaaaaguuuuaaaucccuauaugccuacugucaucgaggagcuggaaaagcuucagcguagauacggcgguagccuggugcgcuguccacuauccaggaacaguacccaugagauguauugggugucuggggucagcggaaauauuguuucauccgugaacacaaccaguaaaaugcuccugaaucgguucacuacgagacaccgcaagcccacauacgaaagggaugccgacuugggcgccggcacccgaagcguaucuacugagaccgagaagccggauaugacaaucauugggcggagacugcagaggcuccaagaagagcauaaagaaacguggcacuacgaccacgagaacccuuaucgcaccugggcguaccauggauccuaugaagcuccaucaacugguagcgcaucgucuauggugaauggcgucgugaagcuucugacaaaacccugggauguugugccuauggucacccaguuagccaugacugacacaaccccauuugggcagcagcguguguucaaggagaaaguagacacacggacuccccaaccgaagccuggaaccagaguugugaugacgaccacagcuaacuggcuguggacuuugcucggcaggaagaaaaauccccgccugugcacccgagaggaauuuaucaguaagguccgguccaacgccgcaauuggugccguguuccaggaggaacagggguggacaagcgcuucagaggcggugaaugauuccagauuuugggaacuagucgacaaagagagggcccuucaccaggagggaaagugugaaucuugcguuuacaacaugaugggcaaacgcgagaagaagcugggcgaauucgggagagcaaaaggaagccgggcuaucugguauauguggcucggugccagguuucuggaguucgaagcauugggcuuccugaacgaggaucauugguuugggcgugagaauaguugguccggaguggaaggcgagggucuccaccgacuuggguacauacuggaagacauugauaagaaagacggagauuuaaucuaugccgacgauacugcuggcugggacacccgcaucacggaggaugaccuguugaacgaggaacucauuacagagcaaauggccccacaucacaagauacuggcgaaagcaaucuucaagcuaaccuaccagaauaagguagugaaaguccuuagaccuacucccaagggcgccgugauggauauuaucagccggaaagaccagagggggucuggacaaguugguacauacggccugaacaccuuuacuaauauggaagugcagcucauucgccagauggaggcugaaggggucaucaccagagacgauaugcacaacccaaagggacugaaagagcggguggagaagugguugaaagaaugcggcguagacagguuaaagcgaauggccauaucaggugaugacuguguugugaagccccuggaugagcguuucaguacaucccuccuuuuucugaaugacauggggaaagucagaaaggauaucccucagugggaaccaagcaaaggauggaagaacuggcaagaggugccguucugcucucaucacuuucauaaaauuuucaugaaggacggccgcucgcuaguugugcccugucggaaucaggaugaacugaucggcagggcaagaauuucacagggggcuggauggagccuccgcgagacggccugcuuggguaaggcuuaugcccagauguggucccugauguacuuucaccggagggaccuucgacuggcaaguauggcgaucuguucugccgucccuaccgagugguucccaacuagcagaacaaccugguccauacacgcucaucaccaauggaugacuacagaagauaugcucaaaguguggaaccggguauggauugaggacaaucccaacaugaucgacaagaccccugugcauucaugggaagauaucccauauuuaggcaaaagggaggaccuguggugcgggaguuugauuggacugucuagccgcgccacgugggcaaagaauauacacacagcuaucacccagguccguaaccucauuggcaaagaagaguacguugauuauaugcccgccaugagacgauacuccgcacauuuugagucagaaggugugcuuuga

SEQ ID NO: 15748 - RNA, 9867 nt, Artificial Sequence
  derived and/or modified CDS sequence (opt3) from DENV-4__JN638571__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucugccuggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauaugguggaccggggcuggggcaacgggugcggacuguucgguaaaggcggggucguuacgugcgccaaguuuucuuguuugggaaaaauuaccggcaaucucgugcaaaucgagaaccuggaauauacaguaguggucacugugcauaauggugauacccacgcaguugggaacgacacaagcaaucacggcgugacugcuaccauuacaccucguuccccaucagucgaggugaaguuaccggaauacggagagcugacccucgauugcgagccccgcaguggcaucgacuucaacgaaaugauccuuaugaagaugaaaacuaagacguggcugguacauaaacagugguuuuuggaccuaccucugccauggacaaccggggccgauacucucgagguucacuggaaucauaaggaaagaauggugaccuucaaagucccccacgcgaagaggcaggacgugacaguccugggaagccaggagggugccaugcacucugcacuugcuggcgccaccgaaguggauuccggggacggaaaccauauguuugcuggccaccugaaauguaagguucggauggagaaguugcgaauuaaagguaugucauacacuaugugcagcgggaaguucaguauagauaaagagauggccgaaacacaacauggcacgaccgugguaaaggucaaauaugagggaacuggcgcaccuuguaaggugccaaucgaaauucgcgacguuaauaaggagaaaguggucgggagaaucauaucuuccacacccuucgccgagaacaccaacagcgugacaaauauugaacucgagccgccuuuuggagauucguacaucguaaucggugugggcgacggggcucugacuuuacacugguucaggaagggaucuuccauuggcaaaauguuugaaucaaccuaucggggugcgaagcgcauggcaauccugggggagacggccugggauuucggcaguguuggaggccuacucaccagccuggggaaagcuguccaucagguguuuggauccguguacacaacuauguucggcggugucucuuggaugguuagaauucuuauaggguugcuggugcucuggaucggaaccaacagcaggaauacaucaauggccaugaguugcauugcagugggcgguaucacucuguuucuuggcuucaccguacacgccgacauggggugugucguguccuggagcggaaaggaacugaagugcggcucugggaucuuuguuauugauaacgugcacacguggacagagcaguauaaauuccaacccgagucaccagcucguuuggccagugcaauacucaaugcgcauaaggaaggagucuguggcauccggagcaccacucgacuggagaacgugauguggaaacagauuacaaaugaauuaaacuacguucugugggagggugggcacgaccuaaccgugguagcuggagacgucaagggcgugcucuccaaagguaagagagcccuggcaccucccgugaaugaucuuaaguauucuuggaaaacuuggggcaaggccaaaaucuuuaccccagaaacaaggaacucgacguucuuggucgacgggcccgauaccagcgagugcccuaaugagcgccgggcuuggaacuuucuggaaguugaggacuacggauucggcauguucacuacaaauauuuggaugaaguuuagagaaggguccucagaggugugugaucauaggcucaugagugccgcaaucaaagaccagaaggcuguacacgccgauaugggauacuggauagaaucuagcaaaaaccagaccuggcaaaucgagaaggcgucccugauugaggugaagacaugcuuauggccaaaaacucacacccuguggucaaauggcguccuugaaagccagauguugaucccgaaggccuaugcuggucccauuucucagcauaacuaccgccagggguaugcaacgcaaacagccggaccuuggcaccucggcaaacuggagaucgacuucggugaaugcccaggcaccacugugaccguucaggaggauugugaccaucgagggcccucccuacggacaacuaccgcuaguggaaagcuggugacacaguggugcugucguagcugcacgaugccuccacucagauuucugggcgaggauggguguugguacggaauggaaauaaggccccuuaacgagaaagaagagaauauggucaagucucagguguccgccggccaagguaccucagaaacuuucaguaugggguugcugugcuuaacacucuuuguugaggagugucugcgccggagagugaccaggaagcacaugaugcuugucguagugacuacacugugcgcaauuaucuugggaggccucaccuggauggaccugcuacgagcgcugauuaugcucggcgauacgaugagcgggcgcaugggaggucagauccaucuggccauaauggcuguuuucaaaaugucgccgggcuaugugcuugggaucuuuuugcggaagcugacuuccagagaaaccgccuuaauggucauuggaauggcaaugacaaccgugcucgcuaucccucacgaccugauggaguucauugacggcaucucucuuggucugauacuacucaaaaugguaacucacuuugauaacacacagguggggacccuggccuuggcacugacauucauuaagagcacuaugccauuagucauggccuggaggaccaucauggcuguucucuuuguggugacgcugaucccccuuugucguacaucaugccugcagaaacaaagucauugggucgaaauuaccgcguugauccucggagcccaggcacugccuguguaccuaaugacucugaugaagggcgcuuccaagcgcucuuggccccuuaaugagggcauuauggccguugggcucguaagccuguugggauccgcccuguuaaaaaacgacgugccacucgcugguccuauggucgcaggcgggcugcuucuggccgcguaugugaugucaggaagcagugcugauuugucucucgaaaaggccgcaaauguucggugggacgagauggccgauauaaccggcuccagccccaucauugaggugaaacaggacgaagaugguucguucucaaucagagacgucgaggaaacaaacaugauuacucugcuagugaagcuggcucuuaucaccguaucugggcucuacccacuggcaauaccggucacgaugacauugugguacauguggcaagugaaaacccagaggaguggagccuuaugggauguuccuucccccgcggcugcccagaaggcaacucugacagagggcguguaucgaaucaugcagcggggccucuuugggaagacccaagucggaguggguauucacacugaaggcguuuuccauacaauguggcacgugacccgcgggagcgucaucugucaugagucuggaagacuggagccaagcugggccgacgugaggaaugauaugauuuccuacggcgguggguggcggcuuggagacaaaugggauaaggaagaggacguacaggugcuggcuaucgaacccggcaaaaacccuaagcacguucagacgaaaccaggcuuguucaagacucuaaccggggagauaggagccgucacacuggacuuuaaacccgguaccucaggcaguccuauuaucaaucgaaaggggaaggugaucggacucuauggcaacgguguggucacaaaaagcggggauuacguaucugcaauuacucaggcugagagaauaggagaaccggacuaugagguggaugaagacaucuuccgcaagaaaaggcugaccauuauggaucuucacccaggcgccggcaagacgaaacguaucuuacccuccauuguucgggaggcgcugaagagaaggcuccgcacauugauccuggccccuacucgaguggucgcagcugaaauggaggaggcccucagagggcugccaauacgguaccaaacccccgcugugaagucagaacauacaggaagggagaucguugaccuuaugugccacgcaaccuuuacuacccgccuguugaguagcacacgugugccuaauuauaaccuaauugucauggaugaagcccauuucacggacccguccucuguggccgcuagagguuacaucucgacucggguagagaugggcgaagcggcagccauuuuuaugaccgcuacacccccagggaccacugauccuuucccccagagcaauucaccaaucgaggacauagagagggaaauuccugagcgcuccuggaacacaggauuugauuggaucaccgacuaccagggcaaaacggugugguucguucccaguaucaaggccgguaaugacauugcaaacugccugcgaaaaucugggaagaaagucauccagcucagcagaaagacuuuugauacagaauauccaaagaccaaauuaaccgacugggauuucguggugacuacagacauauccgagaugggcgccaacuuucgggcuggaagggucauugauccgcgcagaugucugaagccuguuauccuuaccgacggccccgaaagggugauucuggcggggccaauccccguaacaccugccucagcagcucaacggcguggacgcauaggucgaaauccagcccaggaggaugaccaguacguguucucuggcgauccccucagaaacgacgaggaucacgcacacuggacugaagccaaaauguugcuggacaauauuuauacgccugaggggaucaucccgacccucuucggaccagaaagggagaagacacaagcuauugauggcgaguuucggcugcgcggugaacagagaaaaacuuucgucgagcuuaugaggcggggggaccuacccguguggcugagcuacaagguugccagugcgggcaucuccuauaaggaccgagaauggugcuuuaccggagagagaaacaaucagauuuuggaagagaacauggagguggaaauauggacacgcgagggcgaaaaaaagaaauuaaggccuaaguggcuggaugcacgggucuacgccgaccccauggcucucaaagauuucaaggaguuugccagcgggcguaagucuaucacccuggacauucuuacugaaaucgcuucacugccaacguaucucuccaguagagcaaaauuggcccuggauaauaucguaaugcuacauaccacagagaggggagguaaggcuuaccagcacgcccugaacgagcucccugaaagccuugagacucugauguuaguggcauugcugggcgcgaugaccgccgggauuuuccucuuuuucaugcaaggaaaaggcauagguaagcugucgauggggcuuaucgcuauugccguugcaucuggccugcucuggguggcugaaauccagccccaguggauugccgcauccaucauauuggaguuuuuccugauggucuuacuagugccagaaccugagaaacagcgcacaccgcaagacaaucagcugaucuacgucauucucaccauccuuacuauuaucgcccugguggcugcgaacgagaugggauugauagaaaagacaaaaacggauuuuggcuucuaucagguuaaggccgagaccacuauucuggacguggaucuccggcccgcaagcgcuuggacacuguacgccguagccaccaccauccuuacaccaaugcuccgacauacuauugaaaauacgucagcaaaccugaguuuggcugccaucgcgaaucaggcugccgugcugaugggguuaggaaagggcuggccucuacacagaauggaccugggugucccccuccuugcaaugggguguuauucucaaguuaacccaaccacacugacugccuccuuggugaugcugcucguccauuacgcuauaaucggaccuggccugcaggcaaaagccaccagggaggcgcagaagcgcacagcugccgguauuaugaaaaaucccaccguggauggcaucacuguaauugaccuugagccgaucagcuaugauccaaaguuugaaaaacaguuagggcaagugaugcugcucguuuugugcgcaggacagcugcuacugaugcggacgacaugggccuucugugaggugcucacccuugcuacuggcccuauacugaccuugugggaagggaaccccggaagauucuggaacacaacuauugccgucucaaccgcaaauaucuuucguggcaguuaccuggcuggugccgggcucgcguucagccugaucaagaacgcccagacaccaaggcggggaacgggcaccacuggugagacauuaggcgaaaaguggaaacgccaacuuaauucccuggaccgaaaggaguuugaggaauauaaaagaucugggauucucgagguggacaggaccgaagcaaagagcgcucuaaaagauggauccaagaucaaguacgccgucucacggggcacuucuaaaauacgcuggauuguggagagagggaugguuaagcccaaaggaaagguaguggaccugggcugcgguagggggggauggaguuacuauauggcaacauugaaaaacgucaccgaagugaagggcuacacgaagggcgggccuggacacgaggagccgauccccauggcuaccuaugguuggaaucugguuaaacuccacucgggcguggaugucuucuacaagccaacagaacagguggacacucuucugugugauauuggggagagcuccucuaacccuaccaucgaagagggacgaacauugcggguacugaaaaugguggaacccuggcucucaagcaagccugaguuuugcauaaaaguuuuaaauccauauaugcccacugucaucgaggaacuggagaagcuucagcguagauacggcgguucccuggugcgcuguccucuaaguaggaacucuacccaugaaauguauugggugagcggggucucaggaaauauuguuuccagugugaacacaaccagcaaaaugcuccugaaucgguucacuacgagacaccgcaagccaacauacgagagggacgccgauuugggcgccggcacccgaucuguauccacugagaccgaaaagcccgacaugacaaucauugggcggagacugcagaggcuccaagaggaacauaaagagacguggcacuacgaucacgaaaacccguaucgcaccugggcguaccauggaucauaugaggcuccuagcacugguucggcaucuaguauggugaauggcgucgugaagcuucugacaaaaccaugggacguugugcccauggucacccaguuagccaugacugauacaaccccuuuugggcagcagcguguguucaaggagaaaguagacacacggacuccacaacccaagccgggaaccagaguugugaugacgaccacagcuaacuggcuguggacuuugcucggcaggaagaaaaauccucgccugugcacccgagaagaguuuaucuccaagguccggcuaaacgccgcaauuggugccguguuccaggaagagcagggguggacaagcgcuucagaagcggugaaugacuccagauuuugggagcuugucgauaaagagagggcccugcaccaggaaggaaagugugagucuugcguuuacaacaugaugggcaaacgcgaaaagaagcucggcgaguucgggagagcaaaaggaagccgggcuaucugguauauguggcugggugccagguuuuuggaauucgaggcacugggcuuccucaacgaggaccauugguuugggcgugaaaauaguugguccggaguggagggcgaaggucuucaccgacugggguacauauuagaggauauugacaagaaagauggagaccugaucuaugccgaugacacugcuggcugggauacccgcaucacggaggacgauuugcucaacgaagagcugauuacagaacaaauggccccccaucacaagauacuagcgaaagcaaucuucaagcuuaccuaccagaauaagguagugaaaguccugagaccaacuccuaagggcgccgugauggacauuaucagccggaaagaucagagggggucuggacaaguugguacauacggccucaacaccuuuacuaauauggaggugcagcugauucgccagauggaagcugagggggucaucaccagagacgacaugcacaaccccaagggauugaaagagcggguggaaaagugguuaaaagagugcggcguagauaggcugaagcgaauggccauaucaggugacgauuguguugugaagccacucgacgaacguuucaguacaucccuucuguuucuaaaugauauggggaaagucagaaaggacaucccccagugggagccuagcaaaggauggaagaacuggcaagaagugccauucugcucucaucacuuucauaaaauuuucaugaaggauggccgcucgcugguugugccgugucggaaucaggacgagcucaucggcagggcaagaauuucacagggggcuggauggagcuugcgcgagacggccugccuggguaaggcuuaugcccagauguggucccuuauguacuuucaccggagggaucugcgacucgcaaguauggcgaucuguucugccguccccaccgaaugguucccuacuagcagaacaaccugguccauacacgcucaucaccaauggaugacuacagaggacauguuaaaaguguggaaccggguauggauugaagauaauccaaacaugaucgacaagacccccgugcauucaugggaggacaucccuuaucugggcaaaagggaagauuuguggugcgggagucugauuggacucucuagccgcgccacgugggcaaagaauauacacacagcuaucacccagguccguaaccuuauuggcaaagaggaguacguugacuauaugccagccaugagacgauacuccgcacauuuugaaucagagggugugcuguga

SEQ ID NO: 15749 - RNA, 9867 nt, Artificial Sequence
  derived and/or modified CDS sequence (opt3) from DENV-4__JN638572__SS-prME
agcacaaucacacugcucugccuuauucccacugugauggccuuccaccuguccacgagagacggcgagccuuugaugauagucgcuaagcaugaaagggggcggccauuacuguuuaaaaccacagagggaaucaacaaguguacuuuaauugcaauggaucucggugaaaugugcgaggacaccguuacauacaaauguccgcugcuugugaauaccgaacccgaggauaucgacugcugguguaaccugacuucugccuggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuaucuuaaugaugcugguugcccccucauaugggaugaggugugugggagucgguaaccgggauuucguggaaggcguaagcgggggagcuuggguugaccuuguguuggagcacggcgguugcgucaccacaauggcccaggggaagccuacccuggauuuugaacuaauuaagacgacugcgaaagagguggcacuccugcgcacauacuguaucgaagccaguauuuccaauaucaccacugcuacacgaugcccaacccaaggagagcccuaucuuaaggaggaacaggaccagcaguacauauguagaagggauaugguggaccggggcuggggcaacgggugcggacuguucgguaaaggcggggucguuacgugcgccaaguuuucuuguuugggaaaaauuaccggcaaucucgugcaaaucgagaaccuggaauauacaguaguggucacugugcauaauggugauacccacgcaguugggaacgacacaagcaaucacggcgugacugcuaccauuacaccucguuccccaucagucgaggugaaguuaccggaauacggagagcugacccucgauugcgagccccgcaguggcaucgacuucaacgaaaugauccuuaugaagaugaaaacuaagacguggcugguacauaaacagugguuuuuggaccuaccucugccauggacaaccggggccgauacucucgagguucacuggaaucauaaggaaagaauggugaccuucaaagucccccacgcgaagaggcaggacgugacaguccugggaagccaggagggugccaugcacucugcacuugcuggcgccaccgaaguggauuccggggacggaaaccauauguuugcuggccaccugaaauguaagguucggauggagaaguugcgaauuaaagguaugucauacacuaugugcagcgggaaguucaguauagauaaagagauggccgaaacacaacauggcacgaccgugguaaaggucaaauaugagggaacuggcgcaccuuguaaggugccaaucgaaauucgcgacguuaauaaggagaaaguggucgggagaaucauaucuuccacacccuucgccgagaacaccaacagcgugacaaauauugaacucgagccgccuuuuggagauucguacaucguaaucggugugggcgacggggcucugacuuuacacugguucaggaagggaucuuccauuggcaaaauguuugaaucaaccuaucggggugcgaagcgcauggcaauccugggggagacggccugggauuucggcaguguuggaggccuacucaccagccuggggaaagcuguccaucagguguuuggauccguguacacaacuauguucggcggugucucuuggaugguucggauucuuauaggguugcuggugcucuggaucggaaccaacagcaggaauacaucaauggccaugaguugcauugcagugggcgguaucacucuguuucuuggcuucaccguacacgccgacauggggugugucguguccuggagcggaaaggaacugaagugcggcucugggguuuuugugaucgauaacguccacacguggacagagcaguauaaauuccaacccgagucaccagcucguuuggccagugcaauucucaaugcgcauaaggaaggaguguguggcauacggagcaccacucgacuggagaacguuauguggaaacagaucacaaaugaauuaaacuacgugcugugggagggugggcacgaccuaaccguagucgcuggagacgugaagggcgugcucuccaaagguaagagagcccuggcaccucccgucaaugaucuuaaguauucuuggaaaacuuggggcaaggccaaaauuuuuaccccagaaacaaggaacucgacguucuugguugacgggcccgauaccagcgagugcccuaaugagcgccgggcuuggaacuuucuggaaguggaggacuacggauucggcauguucacuacaaauaucuggaugaaguuuagagaaggguccucagagguaugugaucauaggcucaugagugccgcaauuaaagaccagaaggcugugcacgccgauaugggauacuggaucgaaucuagcaaaaaccagaccuggcaaauagagaaggcgucccugaucgaggucaagacaugcuuauggccaaaaacucacacccuguggucaaauggcgugcuugaaagccagauguugauuccgaaggccuaugcuggucccaucucucagcauaacuaccgccagggguaugcaacgcaaacagccggaccuuggcaccucggcaaacuggagauugacuucggugaaugcccaggcaccacuguuaccgugcaggaggauugugaccaucgagggcccucccuacggacaacuaccgcuaguggaaagcuggucacacaguggugcugucguagcugcacgaugccuccacucagauuucugggcgaggauggguguugguacggaauggaaaucaggccccuuaacgagaaagaagagaauauggugaagucucagguuuccgccggccaagguaccucagaaacuuucaguaugggguugcugugcuuaacacucuuuguggaggagugucugcgccggagagucaccaggaagcacaugauacuuguagugguuacuacacugugcgcaauuaucuugggaggccucaccuggauggaccugcuacgagcgcugauuaugcucggcgauacgaugagcgggcgcaugggaggucagauccaucuggccauaauggcuguguucaaaaugucgccgggcuauguccuugggaucuuuuugcggaagcugacuuccagagaaaccgccuuaauggugauuggaauggcaaugacaaccguacucgcuaucccucacgaccugauggaguucauugacggcaucucucuuggucugauacuacucaaaauggugacucacuuugauaacacacaggucgggacccuggccuuggcacugacauucauuaagagcacuaugccauuaguuauggccuggaggaccaucauggcugugcucuuuguggucacgcugaucccccuuugucguacaucaugccugcagaaacaaagucauuggguggaaauuaccgcguugauccucggagcccaggcacugccuguuuaccuaaugacucugaugaagggcgcuuccaagcgcucuuggccccuuaaugagggcauuauggccguagggcucgugagccuguugggauccgcccugcuaaagaacgacgucccacucgcugguccuaugguggcaggcgggcugcuucuggccgcguauguuaugucaggaagcagugcugauuugucucucgaaaaggccgcaaaugugcggugggacgagauggccgauauaaccggcuccagccccaucauugaggucaaacaggacgaagaugguucguucucaaucagagacguggaggaaacaaacaugauuacucugcuaguaaagcuggcucuuaucaccgucucugggcucuacccacuggcaauaccggugacgaugacauugugguacauguggcaaguuaaaacccagaggaguggagccuuaugggaugugccuucccccgcggcugcccagaaggcaacucugacagagggcgucuaucgaaucaugcagcggggccucuuugggaagacccaagugggaguugguauucacacugaaggcguguuccauacaauguggcacgucacccgcgggagcgugaucugucaugagucuggaagacuggagccaagcugggccgacguaaggaaugauaugauuuccuacggcgguggguggcggcuuggagacaaaugggauaaggaagaggacgugcagguucuggcuaucgaacccggcaaaaacccuaagcacguccagacgaaaccaggcuuguucaagacucuaaccggggagauaggagccgugacacuggacuuuaaacccgguaccucaggcaguccuauuaucaaucgaaaggggaaggugaucggacucuauggcaacggugucguaacaaaaagcggggauuacgugucugcaauuacucaggcugagagaauaggagaaccggacuaugagguugaugaagacaucuuccgcaagaaaaggcugaccauuauggaucuucacccaggcgccggcaagacgaaacguaucuuacccuccauugugcgggaggcgcugaagagaaggcuccgcacauugauccuggccccuacucgagucguggcagcugaaauggaggaggcccucagagggcugccaauacgguaccaaacccccgcuguuaagucagaacauacaggaagggagaucguggaccuuaugugccacgcaaccuuuacuacccgccuguugaguagcacacgugucccuaauuauaaccuaauugugauggaugaagcccauuucacggacccguccucuguagccgcuagagguuacaucucgacucggguggagaugggcgaagcggcagccauuuuuaugaccgcuacacccccagggaccacugauccuuucccccagagcaauucaccaaucgaggacauagagagggaaauuccugagcgcuccuggaacacaggauuugauuggaucaccgacuaccagggcaaaacgguuugguucguccccaguaucaaggccgguaaugacauugcaaacugccugcgaaaaucugggaagaaagugauccagcucagcagaaagacuuuugauacagaauauccaaagaccaaauuaaccgacugggauuucguggucacuacagacauauccgagaugggcgccaacuuucgggcuggaaggguuauugauccgcgcagaugucugaagccugugauccuuaccgacggccccgaaaggguaauucuggcggggccaauccccgugaccccugcaucagcagcucaacggcguggacgcauaggucgaaauccagcccaggaggaugaccaguacgucuucucuggcgauccccucagaaacgacgaggaucacgcacacuggacugaagccaaaauguugcuggacaauauuuauacgccugaggggaucaucccgacccucuucggaccagaaagggagaagacacaagcuauugauggcgaguuucggcugcgcggugaacagagaaaaacuuucguggagcuuaugaggagaggggaccuacccguuuggcugagcuacaagguggccagugcgggcaucuccuauaaggaccgagaauggugcuuuaccggagagagaaacaaucagauuuuggaagagaacauggaggucgaaauauggacacgcgagggcgagaagaagaaauuaaggccuaaguggcuggaugcacggguauacgccgaccccauggcucucaaagauuucaaggaguuugccagcgggcguaagucuaucacccuggacauucuuacugaaaucgcuucacugccaacguaucucuccaguagagcaaaauuggcccuggauaauaucgugaugcuacauaccacagagaggggagguaaggcuuaccagcacgcccugaacgagcucccugaaagccuugagacucugauguuaguugcauugcugggcgcgaugaccgccgggauuuuccucuuuuucaugcaaggaaaaggcauagguaagcugucgauggggcuuaucgcuauugccguggcaucuggccugcucugggucgcugaaauccagccccaguggauugccgcauccaucauauuggaguuuuuccugauggugcuauuagucccagaaccugagaaacagcgcacaccgcaagacaaucagcugaucuacgugauucucaccauccuuacuauuaucgcccugguugcugcgaacgagaugggauugauagaaaagacaaaaacggauuuuggcuucuaucaggugaaggccgagaccacuauucuggacguagaucuccggcccgcaagcgcuuggacacuguacgccguggccaccaccauccuuacaccaaugcuccgacauacuauugaaaauacgucagcaaaccugaguuuggcugccaucgcgaaucaggcugccguccugaugggguuaggaaagggcuggccucuacacagaauggaccuggguguuccccuccuugcaaugggguguuauucucaagugaacccaaccacacugacugccuccuuggucaugcugcucgugcauuacgcuauaaucggaccuggccugcaggcaaaagccaccagggaggcgcagaagcgcacagcugccgguauuaugaaaaaucccaccguagauggcaucacugugauugaccuugagccgaucagcuaugauccaaaguuugaaaaacaguuagggcaaguuaugcugcucguguugugcgucggacagcugcuacugaugcggacgacaugggcacucugugaggugcuuacccuggccacuggcccuauaaugaccuugugggaagggaaccccggaagauucuggaacacaacuauugcugucucaaccgccaauaucuuccguggcaguuaccuggccggugcugggcucgccuuuagccugaucaagaacgcgcagacaccaaggcggggaacgggcaccacuggugagacauuaggcgaaaaguggaaacgccaacuuaauucccuggaccgaaaggaguucgaggaauauaaaagaucugggauucucgagguggacaggaccgaagccaagagcgcacuacgggauggauccaaaacuaagcacgcuguuucacgcggcucuaguaagaucagauggauaguagagagggggaugauuaaacccaagggaaaaguggucgaccugggcugcggucgagggggauggucguacuacauggccacauugcagaacgugaccgaaguuaagggcuauacgaaaggcgggccuggacacgaggagccgauccccauggcaaccuacgguuggaaucuggugaagcuccauagcggcgucgauguguuuuauaagccaacagaacagguagacacucuucugugugauauuggggaguccucuucaaacccuaccaucgaagagggacggacauugcgugugcugaaaaugguugaacccuggcucagcuccaagccugaguucugcauaaaagucuuaaauccauacaugcccacugugaucgaggaacuggagaaacuucagagacgcuauggcgguagucuggugagguguccucuaucucggaacagcacccacgaaauguacugggucucagggguuuccggaaauauugugaguagcguaaacacaaccucuaaaaugcuccugaauagauuuacuacgcgccauaggaagccaacauaugagcgagacgcugauuugggcgccggcacccgguccgugucaacugagaccgaaaaacccgacaugacaaucauugggagaaggcugcaacgccuccaggaggaacacaaggagacguggcacuacgaucaugaaaacccguaccguaccugggccuaucacggaagcuacgaggcgccuucgacugguucugcuaguuccauggucaauggcgugguuaaacuucugacaaaaccaugggacgugguccccauggugacccaguuagcaaugacugauacaaccccuuucgggcagcaacggguauuuaaggagaaaguugacacaagaacuccacagcccaagccgggaaccaggguggucaugacgaccacagccaacuggcuguggacuuugcucggccgcaaaaagaauccucgacugugcacccgggaagaguucaucagcaaggugagaucaaacgcugccauuggugcaguguuucaggaggaacagggguggacauccgccucugaagcugucaaugacagcagguucugggagcuaguugauaaagagcgcgcgcuucaucaagaaggaaagugugagaguugcguguauaacaugaugggcaaaagagaaaagaaacugggcgaguuugggcgggccaagggauccagggcaaucugguacauguggcucggugcucguuuccuggaauuugaggccuugggcuuccugaacgaggaccacugguucgggcgagaaaauagcuggucuggaguagagggcgaaggucuccaucgccuuggguauauacuggaggauauugacaagaaagauggagacuuaaucuacgcagaugacacugccggcugggauaccagaaucacggaggacgaucuguugaacgaagaacucauuacagaacagauggcuccccaccacaaggugcuggccaaagcgauauuuaagcuaaccuaucagaauaaagucgugaagguucuucggccaacuccuaagggcgcagugauggacaucauuucaaggaaagaucaacgcgggaguggacaggucgguacauacggccugaacaccuucacuaauauggaggugcagcucaucagacagauggaagccgaggggguaauuacccgggacgacaugcauaaccccaagggacugaaagagaggguugaaaagugguugaaagagugcggcguggaucgauuaaagcguauggcuaucuccggugacgauugugucgugaaaccacuggacgaaagauuuagcacaucucuccuuuuccugaaugauauggggaagguucgcaaggacauaccccaaugggagccuucgaaaggauggaagaacuggcaggaagugccauuuugcucacaccauuuccacaaaaucuuuaugaaggauggccggagccuagucgugccguguaggaaucaggacgagcugauuggcagagcccgcaucucccagggggcaggauggagucuccgggagacggcuugcuuggguaaagccuacgcucaaauguggucucugauguauuuccacaggcgagaucuuagacuggccagcauggcaauuuguuccgcgguacccaccgaaugguuuccuacuucacggacaaccuggaguauccaugcccaccaucaguggaugacuacagaggacaugcucaagguguggaacagggucuggauagaagauaauccaaacaugaccgacaagacgcccguucacucuugggaggacauuccuuacuuaggcaaacgcgaagaucuguggugcgggagcuugaucggacuguccucacgugcuacaugggccaagaauauccauaccgcaauuacucaggugagaaaccucauaggcaaagaggaguauauggacuacaugccagucaugaagcgauauagcgcucccucugaauccgagggugugcuuuga

SEQ ID NO: 15750 - RNA, 9867 nt, Artificial Sequence
  derived and/or modified CDS sequence (opt3) from DENV-4__JX024757__SS-prME
agcaccaugacacugcucugccuuauccccacugugauggccuuccaccuguccacgagagacggcgagccuuugaugauugucgcuaagcaugaaagggggcggccauuacuguuuaaaaccacagagggaauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggagcgcuggggccgacaccucugaaguccacuggaauuacaaagagagaauggugacuuucaaggucccccaugcgaaaaggcaggaugugaccguucucggaucccaggaaggugccaugcacucagcacuggcuggcgccacagagguggacagcggggauggaaaccacauguuugcuggccaucuuaaguguaagguacggauggaaaaacugcgaauuaaggguaugaguuauaccaugugcucugggaaauucuccaucgacaaggagauggccgagacucaacacggcacaacggucgugaaaguuaaguacgaaggagcaggcgccccuuguaaggugccaaucgagauucgcgaugucaauaaagaaaaggugguagggagaauaaucagcucgacccccuucgcugagaacacuaacucugugacaaauauugaguuggaaccgccuuuuggagacuccuauaucguuauaggugucggcgauucagcgcucacccugcauugguucaggaaagggaguagcauuggaaagauguuugaguccacauaccggggcgcaaaacgcauggccaucuuaggugaaacugcuugggacuucgggucugugggcggacuguuuaccagccuaggcaaggccgugcaccaggucuucgggucaguuuauacgaccauguuuggaggcgugaguuggaugaucagaauucucaucgguuuccuggugcuuuggauugggacaaacuccaggaauacuagcauggcaaugaccugcauagccguaggaggcaucacauuguuucuggguuucacuguccaggcugauaugggcugugugguuucuuggaacgggaaggagcucaaaugcggaucaggcauuuuuguggucgacaaugugcauaccuggacggaacaauacaaguuccagcccgagaguccagcccgucuggcaagcgcgauccuuaacgcucacaaagacgggguuuguggaauccgguccacaacccgacuggagaaugugauguggaagcagauuacuaacgaauugaauuauguacucugggagggcggucacgaucugacagucguggccggggacgugaaaggagucuuaaccaagggcaagagagcacugacuccucccguuaacgaucuaaaauacucuuggaagaccugggguaaagccaagauauuuacaccagaagcuaggaauucgacguuccucaucgacggccccgauaccagcgagugcccuaacgggcgccgggccuggaauuuccuggaaguggaggacuacggauuuggcauguucacuacaaacauuuggaugaaauuuagagagggguccucagaaguaugugaucauaggcuuaugagugcagcuaucaaggaccagaaagccgugcacgcggauaugggauauuggauugagucuagcaagaaucaaaccuggcagaucgaaaaggccuccuugauagaggucaaaacaugccuguggccaaagacucauacccucuggucaaacggcgugcuggaaagccagauguuaaucccgcgcucuuacgcuggucccuucucccagcacaacuaucgacaaggguacgcaacgcagacagccggaccuuggcaccugggcaaacuugagauugacuuuggugagugcccaggcaccacuguuaccauccaggaagauugugaccaucgggggcccaguuugcguacaacuaccgcuagcggaaagcucgugacacaguggugcuguagaucuugcacgaugccuccacugagguuccuaggcgaggauggguguugguauggaauggaaauucgcccccuguccgagaaagaggaaaauauggucaagucacaagugaccgccggccaggguacuagugagacauuuagcauggggcuccugugccuuaccuuguucguugaagagugucugcggagaagggugacucgaaaguacaugauguuagucguagugaucacauuuugcgcaauaauucucggaggccugaccuggauggaccuucugcgcgcguugaucaugcucggcgacacgaugucggggcggauuggaggucagauccaccuggccauaauggcuguuuucaaaauguccccgggcuaugugcuaggggucuuucugagaaagcucacuucuagggaaaccgcccugauggugaucggaauggcaaugacaaccguauucagcauuccucaugaucuuauggaguugaucgacggcauuucacuggguuuaauccuccugcguauagugacucacuuugauaacacacaggucgggacccuugcucugagucuaacauucauucgcuccacuaccccacucguuauggccuggcggacgaucauggcaguguucuuuguggucacacugauccccuuguguagaaccucuugccugcaaaaacagagccauuggguggagauuacugccuuaauccucggagcucaggcgcugccuguuuaccuuaugacccugaugaagggcgccuccaggcgaucauggcccuugaaugaaggcauuauggcaguagggcucgugagccugcuaggaagugcucugcuuaaaaacgacgucccacucgccgguccuaugguggccggcgggcuguugcuggcugcauacguuaugucuggauccagcgccgauuuaucgcucgagaaggcggcuaaugugcaaugggacgaaauggccgauauaacaggcucaucucccaucauugaggucaagcaggacgaagaugguaguuucuccauccgggacguggaggagacuaacaugauuacccugcuuguaaaacuggcauugaucacggucagcgggcucuauccacuggccauaccggugacaauggcucuaugguacaucuggcagguuaagacccagcgcucuggagcacugugggaugugccuagccccgccgcgacucaaaaagcuacacuuuccgaaggcgucuauagaauuaugcagaggggccucuuugggaagacccaggugggaguugguauccacauggagggcguguuccacacuauguggcaugucacacgggggucagugauuugucacgaaaccggacgacuggagccaaguugggccgacguaagaaaugauaugaucagcuacggcgguggguggcgcuugggagacaaaugggacaaggaagaggaugugcagguuuuagcaauagagcccggcaagaacccuaaacauguccaaacgaagccaggccuguuuaaaacucucaccggggaaauuggagccgugacacuggacuucaagcccgguaccucuggcuccccuaucaucaauaaaaaggggaaagugauuggacuuuauggcaacggugucguaacaaagucaggggauuacgugagugcuauaacucaggccgagaggaucggagaaccggacuaugagguugaugaggacauuuuucguaagaaacggcugaccaucauggauuugcacccaggcgcaggcaagacgaaaagaauucuacccagcaucgugagggaagcucugaagcgccgacucagaacacugauacuugccccuacucgggucguggcggccgagauggaagaggcauuaagggggcugccaauccgcuaccagacccccgcuguuaaauccgaacauacaggacgugagauuguggaccucaugugccacgccaccuucacuaccagauugcugucuucgacacgggucccuaauuacaaccucaucgugauggaugaggcucacuuuacggacccgugcagcguagcagccagggguuauauuucaacucgcguggaaaugggcgaggccgcugcgaucuucaugaccgcaacacccccaggguccauagauccuuuuccccagaguaauucuccaauugaagacaucgagcgagaaaucccugagagaagcuggaacaccggauucgacuggauuacugauuaccaaggcaagacaguuugguucguccccuccaucaaggccgguaaugacauagcuaacugucugcggaaaucagggaagagggugauucagcuuucucgcaaaaccuuugauacggaguauccaaagacuaaacugacagacugggauuucguggucaccaccgacaucagcgaaaugggcgccaacuuuagagcaggaaggguuauugauccgcggcguugcuugaagccugugauccuaacugacggccccgagcgcguaauacuggccgggccaauucccgugacaccugcuagugcggcccagcgaagaggaaggaucggucggaauccagcacaagaagaugaccaguacgucuucuccggcgauccccucaagaacgacgaggaucaugcucacuggaccgaagccaaaauguuacuggacaauaucuauacaccugaggggauuaucccgacucuuuuuggaccagagcgcgaaaagacgcaggcaauugacggcgaguucagacugaggggugaacagcggaaaaccuuuguggagcucaugcgaagaggggauuugcccguuuggcugagcuacaagguggccucugcuggcauaucauauaaagaccgcgagugguguuucacaggagaaaggaacaaucaaauccucgaggaaaacauggaggucgaaauuuggacucgggagggcgagaagaagaaacugcguccuaaguggcuugaugccagaguauacgcggaccccauggcacuaaaagauuuuaaggaauucgccuccgggaggaaaaguaucacccuggacaucuugacagagauugcuaccuuaccaacuuaccugagcucgaaggccaagcucgcucuggauaauauagugaugcuucauacgaccgaaaaaggaggucgcgcauaucagcacgcccugaacgagcucccugaaucuuuggagacacugaugcuaguugcucugcucggcgcccuuacugcagggaucuuucuguucuuuaugcagggaaagggcauugguaaauuauccaugggguugaucgcgauugccguggcuagcggccugcucugggucgccgagauccagccccaauggauagcagcuucaaucauucuggaauucuuccuuauggugcugcucaucccagagccugaaaagcagcggaccccgcaggacaaucaguugauuuacgucauccugacaauauuaaccauuaucggacuaauugccgcaaacgagaugggccugaucgaaaaaacuaagacagauuuuggguucuaucaagugaaaacggagaccacuauacucgacguugaucuucgacccgccagugcuuggacacuguacgcgguggccaccaccaucuugacaccaaugcugagacacacuauugagaauacgucugcaaaccucucccuggcugccaucgccaaucaggcagcuguacuuaugggacucggcaaggguuggccucugcauaggauggacuugggggugccccuguuagccaugggaugcuauagccaggucaacccaaccacacuaacugcgucacugguuaugcuccuugugcacuacgcuauuaucggcccuggucugcaggccaaggcaacccgcgaagcccaaaaacggacagcugcaggcauaaugaagaaucccaccgucgaugggauuacugugaucgacuuggagccgaucaguuaugacccaaaauuugaaaagcagcugggacagguaaugcuccuggugcuuuguguuggccaauuacugcucaugagaacgacaugggccuugugcgaggugcugacccuagcgacugggccuauuaugacccugugggagggaaaccccggccguuucuggaacacaacuaucgcugucagcaccgccaauauauuuagggguuccuaccucgcaggggccggacuugcuuucucucugauuaaaaacgcccagacaccacggcgcggcacggguaccacuggcgaaacauugggggagaaguggaagcgacagcugaauagccucgauagaaaagaauuugaggaauacaagagguccggaauccuggagguggaccggaccgaggcaaaaucagcuuuacgcgauggcucuaagauuaaacaugccgucaguagagggucgagcaagaucagguggauaguggaacgaggaaugaucaagcccaaaggcaagguuguagaccuugguugugggcggggaggcugguccuauuacauggcgacucugaaaaacgugacagaggucaagggcuauaccaaagggggaccuggucacgaagagccgauucccauggccacguacggcuggaaucucgugaagcuacauucugggguugauguguucuauaagccaaccgaacaggucgacacacuguugugcgauaucggagagucaagcuccaacccuacuauugaggaaggccguacccugagagugcucaaaaugguagagcccuggcuuaguucuaagccugaauuuuguaucaaagugcugaauccauacaugcccacaguuauugaggaauuggagaagcugcaacgcaggcacggugggagccucguccggugcccuuuaucaagaaacuccacucacgagauguauugggugaguggagcaagcggcaauaucgugucuuccgucaacaccauaucaaaaaugcugcuuaaucgcuucacaaccaggcaucgaaagccaacuuacgaaaaagacguugaucugggcgcugggacgcggagcgugucgacagagaccgaaaagcccgacaugacuauuaucggaagaaggcuacagcgccuccgugaggagcacaaggaaaccuggcauuacgaucaggagaacccguaucggacaugggccuaccacgguucuuaugaagcaccuaguacgggcuccgcuagcucaaugguaaaugggguggucaaacuguugaccaagccaugggacgugauccccaugguuacucagcuggccaugacagacaccacuccuuuuggacaacagagaguguucaaagagaaggucgauacaaggaccccacagcccaaaccgggcacacgcaugauuaugacuaugaccgccaacuggcucugggcgcuucuggguaagaagaaauccccucgauuauguacgcgggaagaguuuauaucuaaggugagaagcaaugcugcaaucggggccguauuccaggaggaacaaggauggaccagugcuuccgaggccguuaacgacagcagguucugggaacugguggauaaagagcgcgcauugcaccaggaaggcaagugcgagucuugcgucuacaauaugaugggcaaaagagagaagaagcucggggaauuuggacgggccaaagguucaagggcuauuugguauauguggcugggcgcgcguuuccuagaguuugaagcccuuggguuccugaacgaggaccauugguuuagucgagaaaacuccuggagcggaguggagggcgagggucuccaccgccugggguacaucuuggaagauauugacaagaaagauggagaccugaucuaugcagaugacacagcuggcugggauacuagaauaaccgaggacgaucuccuuaaugaagagcugaucacagagcagauggccccccaucacaagacuuuagcaaaagccauuuucaagcugaccuaccaaaacaagguggucaaaguuuugcggccaacgccuaagggcgcugugauggacaucauuucuaggaaagaccagcgcgggucgggacagguagguacauacggccucaauaccuuuacuaacauggaagugcagcugaucagacaaauggaggccgaaggggucauaacacaggaugacaugcagaauccccggggacuaaaggagaggguggaaaaauggcuuaaggaguguggcguugaucgacugaaacguauggcgauuucaggugacgauugcguggucaagccaaucgacgagagauucagcaccucccuccuguuuuugaacgauauggggaaggugcgcaaagacaucccccagugggaaccuaguaagggauggaaaaauuggcaagagguaccauucuguucucaucacuuucacaagauuuucaugaaagauggccggagcuuaguugugccgugcaggaaccaggacgaacugauaggcagagcacgcaucucccagggggccggauggucacuccgggagacugcuugucuugguaaggccuaugcacagauguggagucugauguacuuucauaggcgagaucuaagacuggcuucuauggccauuugcagcgcuguccccaccgaaugguucccuacaucccggacgaccuggucaauccacgcccaucaccaauggaugacuacagaggacaugcucaagguguggaauaggguuuggauugaggacaacccaaauaugaccgauaaaacucccgugcacagcugggaagacaucccuuauuugggcaagcgcgaggaucuguggugugggucucuuauaggacuguccagucgugcaacaugggcgaaaaacauccauaccgccauuacgcaggucagaaaucucaucggcaaggaagaguacguggacuauaugccagcuaugaaacgauacagcgcccccuucgaaucggaggguguauuauga

SEQ ID NO: 15751 - RNA, 9867 nt, Artificial Sequence
  derived and/or modified CDS sequence (opt3) from DENV-4__JF741967__SS-prME
agcaccaugacacugcucugccuuauccccacugugauggccuuccaccuguccacgagagacggcgagccuuugaugauugucgcuaagcaugaaagggggcggccauuacuguuuaaaaccacagagggaauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaaugguaacacucacgccgucgggaaugauaccagcaaccacggcgugacagcaaccauaacuccucguuccccaucaguagagguuaaguuaccggacuacggagaacugacgcucgauugcgagccccgcaguggcauugacuucaaugagaugauccuuaugaagaugaaaaagaaaacauggcuggugcauaagcagugguuuuuggaccuaccucugccauggaccgcuggggccgauacuagcgaaguccacuggaacuacaaagagagaauggugaccuucaaggucccccaugcgaaaaggcaggacgugacaguucucggaucucaggaaggugccaugcacuccgcacuggcuggcgccaccgagguggauucaggggacggaaaucacauguuugcuggccaucuuaaguguaagguacggauggaaaaacugcgaauuaaggguaugagcuauacuaugugcagugggaaauucucuaucgauaaggagauggccgagacacaacacggcacgaccgucgugaaaguuaaguacgaaggagcaggcgccccuuguaaggugccaaucgagauucgcgacgucaacaaagaaaaggugguagggagaauaaucuccagcacucccuucgcugagaacacaaauucggugaccaacauugaguuggaaccgccuuuuggagauucuuauaucguuauaggugucggcgacuccgcgcucacacugcauugguucaggaaagggucaaguauuggaaagauguuugagagcacuuaccggggcgcaaaacgcauggccaucuuaggugaaaccgcuugggauuucggguccgugggcggacuguuuacgucucuaggcaaggccgugcaccaggucuucgggagcguuuauaccacaauguuuggaggcgugucauggaugaucagaauucucaucgguuuccuggugcuuuggauugggacuaauaguaggaacaccuccauggcaaugacaugcauagccguaggaggcaucacuuuguuucuggguuucaccguccaggcugacaugggcugugugguuagcuggaaugggaaggagcucaaaugcggaucuggcauuuuuguggucgauaacgugcauacguggacagaacaauacaaguuccagcccgagucaccagcccgucuggcaagugcgauccuuaaugcucacaaagacgggguuuguggaauccggagcaccacucgacuggagaacgugauguggaagcagauuacaaaugaauugaacuauguacucugggagggcggucacgaccugaccgucguggccggggaugugaaaggagucuuaacuaagggcaagagagcacugaccccucccguuaaugaccuaaaauacuccuggaagacaugggguaaagccaagauauuuacgccagaagcuaggaacucuaccuuccucaucgauggccccgacacuucggagugcccuaaugaacgccgggccuggaacuucuuugagguggaggauuacggguucggaauguuuacaaccaauauuuggaugaaauucagagaaggcagcuccgagguaugugaccauaggcugaugucagcagcuaucaaggaucagaaagccgugcacgcggacaugggguauuggauugaaaguucuaagaaccaaacauggcagaucgagaaggccagccuuauagaagucaaaacuugcuuguggccaaagacccauacgcugugguccaacggagugcucgagucacagaugcugaucccgcgcagcuacgcuggccccuuuucucagcacaauuaucgacaagguuacgcaacacagaccgccgggccuuggcacuuaggaaaacuggagauugauuucggcgaaugcccagguacuaccguuacaauccaggaggacugugaucaucggggccccucccuucguacuaccacagcuagugggaaguuggugacgcaguggugcuguagaagcugcaccaugccuccacucagguuucugggagaagacggcuguugguaugggauggagauucgcccccuaucugagaaagaagagaacauggucaagucccaagugacugccggacagggcacaucagaaaccuucaguaugggucugcucugccugacucuuuuuguugaggaauguuugcggagaagggugacacgaaagcacaugauccuggcagucguaauaaccuucugcgcgauuaucuuagggggacucacguggauggaucugcuucgcgugcugauuauguugggcgacacuaugagcggccggaucgggggacagauacaucucgccaucauggcuguuuuuaaaaugucgccggguuacgugcugggcgucuuccuaagaaagcugaccuccagggagacagcccucauggugauugggauggcaaugaccacuguauuuucuaucccucacgaccugauggagcuuauugauggaaucagcuugggccugauauuacucaaaauugugacacauuucgacaauacccaggucgguacacuggcucuuucacugacuuucauccguaguaccacgccacuaguuauggccuggcgcacaaucauggcaguguuuuucguggucacccucauuccccugugucggacuuccugcuugcaaaagcagucucacuggguggaaaucaccgcccugauuuuaggggcucaggcgcucccuguuuaucugaugacacuuaugaaaggagccagcagaagguccuggccccugaacgagggcauaauggcaguaggcuuggugucacuccuggggagcgcucuacugaagaaugaugucccacuugccggaccuaugguggccgguggccuccuguuggcugcauacguuaugagugggucuuccgccgaccugagcuuagaaaaggcggcuaacgugcaaugggaugagauggccgacaucacuggaucgucacccauuaucgaagucaaacaggaugaggacggcucuuuuaguauucgagagguggaagagaccaauaugaucacgcuccugguaaagcuugcacugauaacagucuccgguuuguacccacucgccaucccggugaccauggcucugugguauguuuggcaggugaaaacucagcggagcggggcacuaugggaugucccuucucccgccgcgacacacaaggcuacccugagcgaaggaguguaccgcauuaugcaaagaggccuuuucggcaaaacucagguuggggugggaauccauauggagggugucuuucacacagugggccauguaaccaggggguccgugauuugucacgaaacgggacggcucgagccaucauggggcgacguucgaaacgauaugaucaguuauggugggggauggagacugggcgacaagugggauaaggaggaagacguccagguguuggccauagagcccggcaaaaauccuaagcaugugcagacuaaaccaggguuauucaagacccugacaggagaaauuggugcagucacccucgacuuuaaacccggcacaagcgggucuccuaucaucaacaagaaaggaaagguaauuggccuguacgguaauggggugguuacuaaguccggagauuaugugucagccauaacccaagcugagcgcaucggcgagccggacuacgaagucgaugaggacauuuucaggaaaaagcgucuuacgaucauggaucugcacccaggcgccgggaaaacaaagcggauuuugcccaguaucgugagagaagcacuaaaaaggcgccugcgaacucucauacuggcuccuaccagaguuguggccgcggagauggaagaggcccuucggggauuaccaaucagguaucagacacccgcagucaagagcgagcacaccggucgcgaaauuguggaccugaugugccaugcuacuuuuaccacacgucucuuguccucuacgagaguaccuaacuacaaucugaucgugauggaugaggcccacuucacugacccgugcucgguugcugcacggggcuacauuagcaccagggucgaaaugggggaggccgccgcuaucuuuaugacagcgacccccccaggaucaauagauccuuucccccaguccaacaguccaauugaagacaucgagcgcgagaucccugaacgaucuuggaauacuggcuucgauuggauuacagacuaucaggguaagaccgugugguuugugcccagcaucaaagcagggaacgacauagccaacugucucagaaaguccggcaaacgggucauucaacugucaaggaagacguucgauacugaguacccaaaaacaaagcuuaccgacugggauuuuguugugaccacugacaucucugaaaugggagcuaauuuccgcgccggcagaguaauugauccgaggcggugccugaagccugugaucuugacagacgggcccgagcgugucauacuagcaggaccaauucccgugaccccugccagcgcugcgcagcgccgagguagaaucggcaggaacccagcccaggaagaugaccaauauguuuuuaguggggauccccugaaaaaugacgaggaucaugcacacuggacagaggcuaagaugcucuuagacaacaucuacacuccugaaggaauuaucccgacgcuguucggcccagagcgggaaaaaacccaggccauugauggugaguuucgccuuagaggggagcagaggaagacauucguggaacugaugcggcgaggcgaccuccccgucugguuguccuauaaaguagcaagcgccggaauaucuuacaaggacagagagugguguuuuacuggcgaacgcaauaaccagauccuggaggaaaauauggagguggagauuuggaccagggaaggggagaagaaaaagcuccggccuaaauggcuggaugcucguguuuaugccgaccccauggcgcuuaaggauuucaaagaauuugcaucaggaagaaaguccaucacacuagacauccugaccgagauugccacuuugccaacguacuuaaguagcaaggcuaaacuggcccucgauaacauagugaugcugcacaccacagaaaaggguggcagggcuuaccaacaugcacuuaaugagcugccugagucgcucgaaacuuugaugcuggucgcccuacugggggcuaugaccgccggaaucuuccucuuuuucaugcagggcaaagguauugggaagcuuucuaugggccugaucgcaauugcgguggccuccggauuauugugggucgcugagauccagccccaguggauagccgcaagcaucauucuggaauucuuucucauggugcugcuuaucccagagccugaaaaacaacgcacaccgcaggacaaccagcugauuuauguuauccucaccauauugacuauuaucggccugauugcugccaaugagaugggguuaaucgagaagacaaaaacggauuucggauuuuaccaggugaagcccgaaaccacuauacuagacguagaucugcggccagcaucagccuggacacucuaugcuguggcgaccaccauccuuacaccuaugcugcgacacacuauugagaacacgagugccaauuugucucuggcagcuaucgccaaccaagccgcaguccucaugggccuggguaagggguggccccuucauagaauggaccucggaguuccacuguuggcuaugggcugcuacucccaggugaauccuaccacacugacugccagcuuagucaugcuacuggugcacuaugcgauuaucggucccggccuccaggcuaaagccaccagggaagcacagaagcgcacagccgcugggauaaugaaaaacccgaccguagauggaauuacugugaucgaccuugagccaaucucauacgauccuaaguucgagaaacaacugggccagguuauguugcuggugcucugugucgggcagcugcuuuuaaugcggacgacaugggcacugugcgaagugcucaccuuggccacuggacccgucaugacccugugggagggcaacccagguagauuuuggaauacaacuauugcggugaguaccgcuaacaucuuccgugggagcuaucuagccggagcaggccuggccuuuucccucauaaagaaugcucaaacacccaggcgggguacgggcaccacuggggaaacacuuggagagaaguggaaacgccagcugaacucuuuggaccgaaaggaauucgaggaguacaaaagaagcggcauucuggaaguugacaggaccgaggccaaguccgcacuccgggaugggacuaaaaucaaguacgcuguaucacgcggaucuaguaagauuagauggaucguggaaaggggcaugauaaaaccuaaggguaaagucguggaccugggguguggacgaggcggcuggucguauuacauggccacauuaaagaauguuaccgaggugaaaggguauacgaagggagguccgggccaugaagagcccaucccaauggcgaccuacggguggaaccuugucaagcugcacagcggaguggauguauuuuauaaaccuacagagcagguggacacucuccuaugcgauauuggcgaauccucuucaaaucccaccaucgaggaaggucggacacugcguguuuugaagauggucgagccuuggcugagcuccaaaccagaauucuguauuaaggugcucaaccccuacaugccuacugugaucgaggagcuugaaaaacugcagagacgccacgggggaaguuuggucaggugcccacugucucggaauagcacccaugagauguauuggguuucaggcgccuccggcaacauugugaguagcguaaauacaaucucuaagaugcucuuaaacagauuuaccacucgccacaggaaacccacguacgaaaaggacguggaucugggggcaggaacacgauccgucucaaccgagacugagaagccggacaugaccgugauaggucggagacuucaaaggcugcgcgaagagcauaaagaaacauggcacuacgaucaggagaauccuuaucguacgugggcuuaccacggcagcuaugaagccccaucgaccgggucugcaaguuccaugguuaacggaguggucaagcuacucacuaaacccugggacgugauuccuaugguaacacagcuggcuaugaccgauacuacaccauucggccagcaacggguuuuuaaggagaaaguggacaccagaacaccccagccgaagccugguacuaggaugaucaugaccacgaccgccaauugguugugggcccugcucgggaagaaaaagagcccccgccuuuguacacgagaggaauucaucucaaaaguccgguccaacgcggcuauuggagcaguguuccaggaggaacagggcuggacuucugccagcgaggcugugaaugacaguagauuuugggaacuggucgauaaggagagggccuuacaucaagagggcaaaugcgaauccugcguuuacaacaugauggggaagcgcgagaagaaacugggagaauucgguagagcaaagggcagccgggccauaugguauaugugguugggggcuagguuucucgaguucgaagcgcugggauuucuaaacgaggaccacugguucucucgugagaauucauggaguggcguggaaggugaggggcuucaucgacugggauacauccucgaagauauugacaaaaaggauggcgaccugaucuaugccgaugacaccgcaggcugggauacacgcauuacugaggacgauuugcugaacgaggaacucaucaccgagcagauggcuccacaccauaaaacgcuugccaaggcaauauuuaagcugacauaccagaauaaaguagugaaggucuuaagaccuacccccaaaggggccgugauggacaucauuucccggaaggaucaaaggggaagcggucagguuggcacuuacgggcugaacacauucaccaauauggaagugcaguugauccgccagauggaggcugaaggagucauuacucaagacgacaugcagaacccaaaaggccucaaggagagaguggagaaauggcugaaggaaugugguguagaucggcuaaagaggauggccaucucuggggacgauugcguugugaaaccccuugacgagcgauuuucgaccucacugcucuuccugaaugauaugggaaagguccguaaagacauaccucagugggaaccaagcaagggcuggaaaaacuggcaggaggugccguuuuguucccaccacuuccauaagauuuuuaugaaggauggcagaaguuugguugugcccugccgcaaucaagacgaauuaaucgggcgggcgaggaucucucagggagcagguuggagccugagagagacagccugucucggcaaagcuuaugcccagauguggucccuuauguacuuccaccgccgggaucugaggcuagcaucaauggcuauuugcagugccgucccuacggagugguucccaaccucucgaacuacauggagcauacaugcucaccaccaguggaugaccacugaagacaugcugaagguguggaacagaguauggaucgaggauaaucccaacaugacagacaaaaccccugugcauuccugggaagacauuccauaucucgggaagcgggaggauuugugguguggaucacugaucggccuuagcucuagggccacgugggcaaaaaauauucacacagcgaucacccaaguccgcaaccugauagguaaggaagaguacguugacuauaugcccgccaugaagcguuacuccgcuccuuuugagagugaaggggugcucuga

SEQ ID NO: 15752 - RNA, 9867 nt, Artificial Sequence
  derived and/or modified CDS sequence (opt3) from DENV-4__JQ822247__SS-prME
agcaccaugacccugcucugccuuauccccacugugauggccuuccaccuguccacgagagacggcgagccuuugaugauugucgcuaagcaugaaagagggcggccauuacuguuuaagaccacagaggggauaaacaaguguacucuaaucgcaauggaucucggugaaaugugcgaggacaccguuacauacaaguguccgcugcuugugaauaccgaacccgaggauauugacugcugguguaaccugacuucuacaugggugauguauggaaccugcacgcagucaggggagcgccgacgugaaaagagaaguguggccuugacuccucacagcggaaugggccucgagaccagggcggaaacauggauguccucugagggugcuuggaagcaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaaugguaacacucacgccgucgggaaugauaccagcaaccacggcgugacagcaaccauaacuccucguuccccaucaguagagguuaaguuaccggacuacggagaacugacgcucgauugcgagccccgcaguggcauugacuucaaugagaugauccuuaugaagaugaaaaagaaaacauggcuggugcauaagcagugguuuuuggaccuaccucugccauggaccgcuggggccgauacuagcgaaguccacuggaacuacaaagagagaauggugaccuucaaggucccccaugcgaaaaggcaggacgugacaguucucggaucucaggaaggugccaugcacuccgcacuggcuggcgccaccgagguggauucaggggacggaaaucacauguuugcuggccaucuuaaguguaagguacggauggaaaaacugcgaauuaaggguaugagcuauacuaugugcagugggaaauucucuaucgauaaggagauggccgagacacaacacggcacgaccgucgugaaaguuaaguacgaaggagcaggcgccccuuguaaggugccaaucgagauucgcgacgucaacaaagaaaaggugguagggagaauaaucuccagcacucccuucgcugagaacacaaauucggugaccaacauugaguuggaaccgccuuuuggagauucuuauaucguuauaggugucggcgacuccgcgcucacacugcauugguucaggaaagggucaaguauuggaaagauguuugagagcacuuaccggggcgcaaaacgcauggccaucuuaggugaaaccgcuugggauuucggguccgugggcggacuguuuacgucucuaggcaaggccgugcaccaggucuucgggagcguuuauaccacaauguuuggaggcgugucauggaugaucaggauucucaucgguuuccuggugcuuuggauugggacuaauaguaggaacaccuccauggcaaugacaugcauagccguaggaggcaucacuuuguuucuggguuucaccguccaggcugacaugggcugugugguuagcuggaaugggaaggagcucaaaugcggaucuggcauuuuuguggucgauaacgugcauacguggacagaacaauacaaguuccagcccgagucaccagcccgucuggcaagugcgauccuuaaugcucacaaagacgggguuuguggaauccggagcaccacucgacuggagaacgugauguggaagcagauuacaaaugaauugaacuauguacucugggagggcggucacgaccugaccgucguggccggggaugugaaaggagucuuaacuaagggcaagagagcacugaccccucccguuaaugaccuaaaauacuccuggaagacaugggguaaagccaagauauuuacgccagaagcuaggaacucuaccuuccucaucgauggccccgacacuucggagugcccuaaugaacgccgggccuggaacuucuuugagguggaggauuacggguucggaauguuuacaaccaauauuuggaugaaauucagagaaggcagcuccgagguaugugaccauaggcugaugucagcagcuaucaaggaucagaaagccgugcacgcggacaugggguauuggauugaaaguucuaagaaccaaacauggcagaucgagaaggccagccuuauagaagucaaaacuugcuuguggccaaagacccauacgcugugguccaacggagugcucgagucacagaugcugaucccgcgcagcuacgcuggccccuuuucucagcacaauuaucgacaagguuacgcaacacagaccgccgggccuuggcacuuaggaaaacuggagauugauuucggcgaaugcccagguacuaccguuacaauccaggaggacugugaucaucggggccccucccuucguacuaccacagcuagugggaaguuggugacgcaguggugcuguagaagcugcaccaugccuccacucagguuucugggagaagacggcuguugguaugggauggagauucgcccccuaucugagaaagaagagaacauggucaagucccaagugacugccggacagggcacaucagaaaccuucaguaugggucugcucugccugacucuuuuuguugaggaauguuugcggagaagggugacacgaaagcacaugauccuggcagucguaauaaccuucugcgcgauuaucuuagggggacucacguggauggaucugcuucgcgugcugauuauguugggcgacacuaugagcggccggaucgggggacagauacaucucgccaucauggcuguuuuuaaaaugucgccggguuacgugcugggcgucuuccuaagaaagcugaccuccagggagacagcccucauggugauugggauggcaaugaccacuguauuuucuaucccucacgaccugauggagcuuauugauggaaucagcuugggccugauauuacucaaaauugugacacauuucgacaauacccaggucgguacacuggcucuuucacugacuuucauccguaguaccacgccccugguuauggccuggcgcacaaucauggcaguguuuuucguggucacccucauuccccugugucggacuuccugcuugcaaaagcagucucacuggguggaaaucaccgcccugauuuuaggggcucaggcgcucccuguuuaucugaugacacuuaugaaaggagccagcagaagguccuggccccugaacgagggcauaauggcaguaggcuuggugucacuccuggggagcgcucuacugaagaaugaugucccacuugccggaccuaugguggccgguggccuccuguuggcugcauacguuaugagugggucuuccgccgaccugagcuuagaaaaggcggcuaacgugcaaugggaugagauggccgacaucacuggaucgucacccauuaucgaagucaaacaggaugaggacggcucuuuuaguauucgagauguggaggaaaccaauaugaucacgcuccugguaaaacuugcacugauaacagucuccgguuuguacccacucgccaucccggugaccauggcucugugguauguuuggcaagugaaaacucagcggagcggggcacuaugggacgucccuucucccgccgcgacacaaaaggcuacccugagcgagggaguguaccgcauuaugcagagaggccuuuucggcaaaacucagguuggggugggaauccacauggaaggugucuuucauacaauguggcacgugaccaggggcuccguaauuugucaugagacggggcggcucgaaccaucaugggccgaugugcgaaacgacaugaucaguuauggaggcgguuggagacugggggauaagugggacaaggaggaggacguucaggucuuggcaauagaacccggcaagaauccuaagcacgugcaaacuaaaccaggcuuauucaagacccugacaggcgagauuggggccgugacccucgauuuuaaacccggaacaagcgguucuccuaucaucaacaagaaaggcaaggucauugggcuguacggaaauggcguagugacuaaguccggugacuauguuucagcuauaacccaggccgaacgcaucggggagccggauuacgagguggacgaagauauuuucaggaaaaagcgucuuacgaucauggaccugcauccaggagcaggcaaaacaaagcggauuuugcccaguaucgucagagaggcucuaaaaaggcgccugcgaacucucauacuggccccuaccagagugguugcggccgaaauggaggaagcacuucggggcuuaccaaucagguaucagacacccgcuguaaagagcgagcacaccgggcgcgagauugucgaucugaugugccacgccacuuuuaccacacgucucuuguccucuacgagagugccuaacuacaaucugaucguaauggacgaagcucauuucacugauccgugcucgguggcagcccggggauacauuagcaccaggguugagaugggugaagccgcugcgaucuuuaugacagcaacaccaccaggcucaauagacccuuucccccaguccaacaguccaauugaggauaucgaacgcgagaucccugagcgaucuuggaauacuggguucgacuggauuacagacuaucaaggaaagaccgucugguuugugcccagcaucaaagccggcaacgauauagcuaacugucucagaaaguccgguaaacgggugauucagcugucaaggaagacguucgacacugaauacccaaaaacaaaacuuaccgauugggacuuugucguuaccacugauaucucugagaugggggccaauuuccgcgcaggcagagugauugacccgaggcggugccugaagccuguaaucuugacagauggacccgaacgugugauacuagccggcccaauucccgucaccccugcuagcgcggcccagcgccgagggagaaucggaaggaacccagcacaagaggacgaucaguauguguuuaguggugacccccugaaaaaugaugaagaccacgcucauuggacagaggccaagaugcucuuagauaacaucuacacuccugagggcauuaucccgacgcuguucgggccagaacgggagaaaacccaggcaauugacggagaauuucgccuuagaggcgagcagaggaagacauucguugagcugaugcggcgaggugaccuccccgugugguuguccuauaaagucgccagcgcugggauaucuuacaaggauagagaaugguguuuuacuggcgagcgcaauaaccaaauccuggaagagaauauggaaguagagauuuggaccagggagggagaaaagaaaaagcuccggccuaaauggcuggacgcccguguguaugcggaucccauggcacuuaaggacuucaaagaguuugccucaggcagaaaguccaucacacuagauauccugaccgaaauugcuacuuugccaacguacuuaaguagcaaggccaaacuggcucucgacaacauaguuaugcugcacaccacagagaaaggugggagggcauaccagcacgcccuuaaugaacugccugagucgcucgagacuuugaugcugguggcucuacugggggccaugaccgcaggcaucuuccucuuuuucaugcaggggaaaggaauuggcaaacuuucuaugggucugaucgcgauugccgucgcuuccggguuauuguggguggccgaaauccagccccaauggauagcagcuagcaucauucuggaguucuuucucaugguccugcuuaucccagaaccugagaaacagcgcacaccgcaggauaaccagcugauuuaugugauccucaccauauugacuauuaucggccugauugccgcaaaugaaaugggauuaaucgagaagacaaaaacggacuucggcuuuuaccaaguuaagcccgagaccacuauacuagauguggaccugcggccagccucagcuuggacacucuaugcgguagccaccaccauccuuacaccuaugcugcgacauacuauugaaaacacgagugcaaauuugucucuggcugccaucgccaaccaggcagcugugcucauggggcugggaaagggcuggccccuucacagaauggaucucggugucccacuguuggccauggggugcuacucccagguuaauccuaccacacugacugcgagcuuagugaugcuacugguccauuaugcuauuaucggacccggccuccaggccaaagcaaccagggaggcccaaaagcgcacagcugcagguauaaugaaaaacccgaccguggacggcauuacuguaaucgaucuugaaccaaucucauacgacccuaaguucgagaaacagcugggacaggugauguugcugguucucugugugggacaacugcuuuuaaugcggacgacaugggcccugugcgagguccucaccuuggcgacuggccccgugaugacccugugggaagggaacccaggaagauuuuggaauacaacuauugcugucaguaccgccaacaucuuccguggcagcuaucuagccggugcagggcuggcuuuuucccucauaaagaaugcccagacacccaggcggggaacgggcaccacuggugagacacuuggcgaaaaguggaaacgccagcugaacucuuuggaccgaaaggaguucgaagaguacaaaagaagcgggauucuggagguggauaggaccgaagcaaaguccgcucuccgggacggaacuaaaaucaaguacgccguuucacgcggcucuaguaagauuagauggaucguagagagggggaugauaaaaccuaagggaaaaguggucgaucugggcuguggucgagggggauggucguauuacauggcgacauuaaagaaugugaccgaaguuaaaggcuauacgaagggcgggccgggacacgaggaacccaucccaauggccaccuacgguuggaaccuugugaagcugcauagcggcgucgacguguuuuauaaaccuacagagcagguagauacucuccuaugcgacauuggggaguccucuucaaaucccaccaucgaagagggacggacacugcguguguugaagaugguugaaccuuggcugagcuccaaaccagaguucuguauuaagguccucaaccccuacaugccuacugugaucgaggaacuugagaaacugcaaagacgccacggcgguaguuuggugaggugcccacugucucggaauagcacccacgaaauguauugggucucaggggcauccggaaacauuguuaguagcgugaauacaaucucuaagaugcucuuaaacagauuuaccacucgccauaggaaacccacguacgagaaggauguagaccugggcgcuggcacacgauccgugucaaccgaaacugagaagccggauaugaccgucauagggcggagacuucagaggcugcgcgaggaacacaaagagacauggcauuacgaccaggaaaauccuuaucguacgugggccuaccacggaagcuaugaggcaccaucgaccgguucugcuaguuccauggugaacggcguugugaagcuacucacuaaacccugggaugucauuccuauggugacacagcuggccaugaccgacacuacaccauucgggcaacagcggguauuuaaggaaaaaguugacaccagaacaccccagccgaagccuggaacuaggaugaucaugaccacgaccgccaauugguugugggcgcugcucggcaagaaaaagagcccccgccuuuguacacgagaggaguucaucucaaaagugcgguccaacgcugcaauuggugccgucuuccaggaggaacagggguggacuucugcuagcgaagccgugaaugauaguagauuuugggagcugguggacaaggaaagggcauuacaccaggagggaaaaugcgaguccugcgucuacaacaugaugggcaagcgcgaaaagaaacugggcgaguucgggagagccaagggaagccgggcuauaugguauaugugguugggugcgagguuucucgaguucgaggcccugggcuuucuaaacgaagaucauugguucucucgugaaaauucauggagugggguugagggagaaggccuucaccgacuggguuacauccucgaggacauugauaaaaaggacggggaucugaucuaugcagacgauaccgcuggaugggacacacgcauuacugaagaugacuugcugaacgaggagcucaucaccgaacagauggccccacaucacaaaacgcuugcaaaggccauauuuaagcugacauaccaaaauaaagugguaaagguguuaagaccuacccccaaaggcgcugucauggauaucauuucccggaaggaccagaggggcagcggacaggugggaacuuacggucugaacacauucaccaauauggagguucaguugauccgccaaauggaagccgagggcgugauuacucaggacgauaugcagaacccaaaagggcucaaggaaagagucgagaaauggcugaaggaguguggaguggaccggcuaaagaggauggcgaucucuggcgaugacugcguaguuaaaccccuugaugaacgauuuucgaccucacuacucuuccugaaugacauggguaaggugcguaaagauauaccucagugggagccaagcaagggguggaaaaacuggcaagaagucccguuuuguucccaucacuuccacaagauuuuuaugaaggacggaagaaguuuggugguucccugccgcaaucaggaugaguuaaucggccgggcaaggaucucucagggcgccggguggagccugagagaaacagcuugucucggaaaagccuaugcacagauguggucccuuauguacuuccaucgccgggaccugaggcuagcuucaauggccauuugcagugcugugccuacggagugguucccaaccucucgaacuacauggagcauacacgcccaucaccaauggaugaccacugaggauaugcugaaggucuggaacagaguguggaucgaagacaaucccaacaugacagacaaaaccccuguacacuccugggaggauauuccauaucucgguaagcgggaagacuugugguguggcucacugaucgggcuuagcucuagggcaacgugggcgaaaaauauucauacagccaucacccaggugcgcaaccugauaggaaaggaggaauacgucgauuauaugcccgcuaugaagcguuacuccgccccuuuugagagugagggcguucucuga

SEQ ID NO: 15753 - RNA, 9867 nt, Artificial Sequence
  derived and/or modified CDS sequence (opt3) from DENV-4__JF262783__SS-prME
agcaccgugacccugcucugccuuauccccacugucauggccuuccaccuguccacgagagacggcgagccuuugaugauuguugcuaagcaugaaagggggcggccauuacuguuuaaaaccacagagggaauaaacaaguguacucuaaucgccauggaucucggugaaaugugcgaggacaccgugauguacaaauguccgcugcuuguaaauacagaacccgaggauauugacugcugguguaaccugaccucuacuugggugauguauggcacaugcacccagucaggggagcgccgacgugaaaagagaagugucgccuugacgccucacagcggaaugggccucgagacuagggcggaaaccuggauguccucugagggugcuuggaaacaugcccaacggguggagucguggauccugcgcaauccaggguucgcacugcucgccggauuuauggcuuacaugauuggccagacaggcauccagagaacuguuuucuuuguguuaaugaugcuggucgcacccucauaugggaugaggugugugggaguagguaaccgggauuucguugaaggcgugagcgggggagccugggucgaccuuguguuggagcacggcgguugcgugaccacaauggcucaggggaagccuacccuggauuuugaacuaauaaagacgacugccaaagaggucacacuccugcgcaccuacuguaucgaagcgaguauuuccaauaucacuacagcaacccgaugcccaacgcaaggagagcccuaucuuaaggaggaacaggaccagcaguacauuuguagaagggauguuguggaccggggcuggggcaacgggugcggacuguucgguaaaggcgggguagugaccugcgccaaguuuuuguguucuggaaaaaucacaggcaaucucguccaaauagagaaccuggaauauacugugguugugaccguccauaauggugauacacacgugguagggaaggacacuagcaaccacggcguuaccgcuacaauuaccccucguuccccaucaguggaggucaaguuaccggauuacggagaacugacucucgacugcgagccccgcaguggcaucgacuucaaugagaugauucuuaugaaaaugaagaaaaagacguggcuggugcauaaacagugguuuuuggaucuaccucugccauggacagccggggcagacaccagcgaaguccaguggaacuacaaggagagaauggugacuuucaaaguuccccacgcuaagaggcaggaugugaccguacucggaucucaagaaggugccaugcauuccgcgcugacaggcgccaccgaggucgacucaggggauggaaaucacauguuugcaggccaccuuaaguguaaagugcggauggaaaagcugcgaaucaaagguaugagcuauacuaugugcagugggaaguucucuaucgacaaagagauggcugagacacagcauggcacgaccguugugaaggucaaguacgaaggagccggcgcuccuuguaaagugccaauugagauacgcgauguaaacaaggaaaaagugguugggagaaucauuuccagcacucccuucgccgagaauacaaacucggucaccaacaucgaguuggaaccgccuuuuggagacucuuauauagugauuggugugggcgauuccgcacucacacugcacugguucaggaaggggucaaguaucggaaaaauguuugagagcacuuaccggggcgccaagcgcauggcuaucuuaggugaaaccgcgugggacuucggguccgucggcggacuguuuacgucucuaggcaaggcaguucaucagguguucgggagcguguauaccacaauguuuggaggcguaucauggauggucaggauucucaucggucugcuuguguuguggauugggacuaauaguaggaacaccuccauggccaugacaugcauagcuaucggaggcauuacucuguuccucgguuuuaccguucacgccgauaugggcugugcagugagcuggucugggaaagagcugaagugcggaucaggcaucuucgucaucgacaaugugcauacguggacagaacaauacaaauuucagcccgagaguccagcccgucuugcuagcgccauucugaacgcacacaaggacgggguuuguggaauacgguccaccacucgauuggagaaugugauguggaaacagaucacaaacgaacucaauuauguacugugggagggcggucacgauuuaaccgucguggcgggggacgugaagggaguccugacuaagggcaaaagagcucuaaccccucccguuaacgaucucaaguacucuuggaaaacaugggguaaggccaaaauuuucacgccagaagcaagaaauucgaccuuucugaucgacggccccgauacuagcgagugcccuaacgaacgccgggccuggaauuuccuugagguggaggacuacggguucggaauguuugcuacaaacauuuggaugaaguucagagaaggcuccucagagguaugugaucauagguugaugagugccgcaaucaaagaccagaaggcugugcacgccgauaugggguauuggauagaaucuagcaagaaucaaaccuggcagaucgagaaagcgucccugauugaagucaagacaugccucuggccaaaaacucauacccuguggucaaacgagguguuagagagccagaugcugaucccgaaggccuacgcuggacccuuuucucagcacaauuaucgccaaggcuacgcaacgcagacaauugguccuuggcaccuugggaaauuggaaaucgacuucggagagugcccaggcaccacuguuaccauacaggaagauuguaaccaucgaggucccucccuccggacaacuaccgccaguggcaagcuggugacacaguggugcugucguagcugcacgaugccuccacuaagauuucugggggaggacggauguugguauggcauggagauuaggccccucucugaaaaggaggaaaacauggucaaaucccaagugucagcugggcagggaaccagugagacuuucagcaugggccugcuuugcuugacacuguuuguugaagaguguuuacgccggagagugaccaggaagcacaugauccucgucguagugacuacacugugcgccauuauccuuggugggcugaccuggauggauuugcuccgagcacugauaaugcuaggagacacgaugucgggccgcaugggcgggcagauccaucugacuauuauggcgguuuucaaaauguccccgggauacgugcucggugucuuucugcggaaacuuaccucuagagagacagccuugaucgugauuggcauggcuaugaccacuguacugagcaucccucacgacuuaauggaguucauagaugggauuucacucggacugauccuucugaaaaugguggcccauuuugacaauacacaggucggcacccuagcacucagucugacauucaucagguccacuaugccauugguuauggcuuggcguaccauuauggccgugcuguuuguggucacguuaaucccccucugucgcacaucuugccugcaaaagcagagccacuggguggagauuaccgcacuuauacugggugcccaggcuuugccuguuuaucucaugacucugaugaagggggcguccaaacggucauggccccuaaacgaaggaaucauggccguaggccuggugagccuucucggcagugcacuguugaagaaugaugucccacuggcugggccuaugguggccggagguuuacuccuggccgcuuacguuaugucuggcuccagcgcagaccuuucgcuggagaaagccgcgaacgugcaaugggaugaaauggcugacauuaccgggucaucucccaucauugaggucaagcaggaugaggacggaaguuucuccaucagagauguggaagagacaaauaugauaacuuugcucguaaaacuggcccuaaucaccgucagcggccuguacccacuugcaauuccggugacgauggcccucugguauauguggcagguuaagacacagaggucuggugcucugugggacgugccuagccccgcagccgcgcaaaaggcuaccuugacugaaggggucuaccgaaucaugcagcggggauuauucggcaaaacacaggugggcguugggauucacauggagggaguguuucauaccauguggcacgucacucgcgguuccgugaucugucaugaaacaggcagacuggagccaucaugggccgauguaaggaacgacaugauaaguuaugggggaggcuggcggcucggugauaagugggacaaagaggaagacgugcagguucuggcaauugagcccgggaagaauccuaaacacguccaaaccaagccaggacuuuucaaaacgcugacuggcgaaaucggcgccgugaccuuggauuuuaagcccgggacaagcggaucuccuaucauuaacaagaaaggucgagugauaggccuauacgggaauggaaucgucaccaaguccggcgacuauguaucagcuauuacacaggccgagagaaucggugagccggauuacgaaguggacgaggauauuuuccgcaaaaagaggcugacuguuauggaccuccauccaggggcaggaaaaaccaagcguauccugcccaguauagugcgggaagcucuuaagagaagguuacgcacgcugauccucgccccuacacgagucguggcggccgagauggaagaggcauugagaggccugccaauucgguaucagacucccgcuguuaaaagcgagcacaccggcagggaaaucguggaucucaugugccacgccacauuuaccacucgccugcuuuccucuacccgugucccuaacuacaaucugauugugauggacgaggcucauuucacagauccgucgagcguagcagccagaggguacaucucaacgcggguggaaaugggagaggccgcugcgauauuuaugacugcaacacccccaggugccacagacccuuucccccaguccaacaguccaauugaagauaucgagagggagaucccugaacgcucuuggaauaccggcuuugacuggauuacugacuaucaagggaagacaguuugguucguccccagcaucaaagcuggaaacgauauagccaauugcuugcgaaaguccggcaaaaaggugauucagcuaucaagaaagaccuuugacacggaguacccaaaaacuaagcugacagauugggacuucguggucaccaccgauaucucugaaaugggugcaaacuuccgggccaggcgcguuauugacccgagaaggugucucaaaccugugaucuuaacugaugggcccgagcggguaauacuggcuggcccaauucccgugaccccugcgagcgccgcacagcgucgcggacgaaucggcagaaacccagcucaagaagacgaucaguaugucuuuaguggggacccccuuaagaaugaugaggaccacgcccauuggacagaggcaaaaaugcugcucgauaacaucuacacaccugaaggaauuaucccgacuuuguucgguccagagagggaaaagauucaggccauagacggcgaguuucggcugcgcggggagcagagaaagacguucguggaacucaugaggcggggagaccugcccguuuggcuuuccuauaaaguggcuagcgccggcaucucuuacaaggaucgagaguggugcuuuaccggugaaagaaauaaccaaauucuagaggaaaauauggaggucgagaucuggacacgcgaaggggagaaaaagaaacugaggccuaagugguuggacgcgcggguauaugcagaucccauggccuuaaaggacuucaaagaauuugcuucaggccguaaguccaucacucuggauauucucaccgagauagccagucugccaacauaccuuagcucgagagcuaaacuggcacucgacaacaucgugauguugcacaccacugaaaggggaggccgcgccuaccagcacgcucugaaugagcuaccugagucucuggaaacgcucaugcuuguugcccuguuaggggcaaugaccgcgggaauuuucuuguuuuucaugcaggguaagggcaucgggaaacuguccaugggacucauggccauugcuguggccagcggccugcuuugggucgcagagauccagccccaauggauagcugccucaaucauucuggaauuuuuccucauggcauugcugaucccagagccugaaaagcagcggacaccgcaggauaaccaguuaauuuaugugauccuaacuauacugaccauuaucggucucauugccgcuaaugagauggggcuuaucgagaaaacaaagaccgacuuuggcuucuaccaagucaagacugaaacaacgauacuggauguggacuugcgacccgcgagugccuggacccuguaugcaguugcuacuacaauccucaccccaaugcugagacauaccauugagaacacaucugccaaucuuucccucgccgcaaucgcuaaccaggccgcggugcugaugggauugggcaaaggguggccucugcacaggauggauuuaggaguaccccuacuggcuaugggcuguuacagccaggugaauccaacuacgcucaccgccucacuugucaugcugaguguucauuaugcaauuaucgguccuggguugcaggccaaggcuacacgcgaagcacaaaaacggacugccgcgggaauaaugaagaaccccaccguggacggcauuacagucaucgaucuggagccgaucagcuacgacccaaaauucgagaagcagcucggucaggugaugcugcuugcuuuaugcgccggccaacugcucuugaugagaaccacuugggcauuuugugaaguacugacgcuagccacagggccuauucugacccucugggagggaaaucccggccguuucuggaacacuaccaucgcuguguccacagccaacauauuuagggggucuuaucuugcaggagcuggccuggccuucagcuugauuaagaaugcgcagacuccacggcgcgguaccgggacaacgggagaaacccugggcgagaaauggaagcgacagcucaacucccuggacagaaaagaauuugaggaguacaagaggucagguaucuuagaaguugaucggacugaggccaaaucugcacuuaaggacggcaguaagauuaaacacgcugugucgcgcgggagcuccaagaucagauggauagucgaaaggggaauggugaaacccaagggcaaagucguggaucuggggugcggacgaggcgguuggucuuacuauauggccacacucaagaauguuaccgagguaaagggguacacuaaaggaggcccuggccaugaagaaccgauccccauggcaacauauggguggaaccuagugaagcugcacucaggagucgacguguucuacaaaccaaccgagcagguugauacguugcugugugacauuggugaaagcuccaguaauccuaccaucgaggaaggccggacacuccgugugcuuaagauggucgagcccuggcugucuagcaaaccugaauuuugcauuaagguguugaacccauauaugcccacuguaaucgaggagcuggaaaaacuccaaagaaagcacgggggaucauuagugcgcuguccucuguccaggaauaguacccaugagauguacuggguuagcggcgcuucugguaacauugucuccucagugaauacaacuagcaagaugcuucugaaccgguucaccacaagacaccgcaaaccaaccuaugaaaaggaugugaaucuaggggccggaacuaggucggucucuacggagacagagaaacccgacaugaccaucauaggccgacggcuccagagacugagggaagaacauaaggaaacuuggcacuacgaucaggagaacccguaccgcaccugggccuaucacggcaguuacgaagcgccuuccacagggagcgcuucauccaugguuaauggagugguaaaauugcugacgaagccaugggacgugauucccauggucacccagcucgcaaugacugauacaaccccuuuuggucaacagcguguguucaaggagaaaguugacacucggacaccacagcccaagccgggcaccagaauggugaugacaacuaccgccaacuggcuuugggcucuguuagggaaaaagaaaucuccuaggcugugcacgcgcgaggaauuuaucagcaagguccgaaguaaugccgcaaucggagccguguuccaggaggaacaaggcuggaccuccgcuagcgaggcgguaaacgacucucgguuuugggaauugguugauaaggagagagcccuccaucaggaggguaaaugugaaucaugcguguauaauaugauggggaagagggagaaaaagcugggagaguucggccgcgcaaaaggcaguagagcuauuugguacauguggcuaggggcccgguuccuugaguuugaagcacugggauuccucaacgaggaccacugguuugguagggagaacuccuggagcggcgucgaaggggagggacugcaucguuugggcuauauacuggaagauaucgacaagaaggauggugaccucauuuacgccgaugacacagcugggugggauacucgaaucaccgaggacgaucuucugaaugaggaauuaauuacagagcagauggcaccccaccaucgcauccuggcgaaagcaauauucaaguugacuuaucaaaacaaaguggugaagguccucagaccaaccccuaaaggagccguuauggacaucauuucucggaaggaucagaggggcucgggccagguggggacguacggacugaauacauuuaccaacauggaaguacagcuaauccgccaaauggaggcugaaggugugauuacucaggacgacaugcagaaucccaaaggccuuaaggagagagucgagaaguggcugaaagaaugcgggguggaucggcucaagaggauggccaucucaggagacgauuguguugugaaaccacuggacgagcgauucagcacauccuuguuauuucugaacgauaugggcaagguccguaaagacauaccccagugggaaccuaguaaggguuggaagaauuggcaagaggugccauucugcucucaccacuuucauaaaauuuucaugaaggaugggagaagccucguaguuccgugucgcaaccaggacgaacuuaucggacgggcaaggaucucccagggcgcuggcuggucacugagagagaccgccugccuagggaaggcuuacgcccagauguggagucugauguauuuucaccgccgggaucucagguuggcaucuauggcgauuuguagcgccgugcccacugagugguucccuaccucccgaacaacguggucaauacaugcucaccaccaauggaugaccacugaagacaugcugaaggucuggaauagaguguggaucgaggauaacccaaauaugacagacaaaacccccguucauagcugggaagacauuccuuaccuuggaaagcgggaggaucuguggugcgguucucucaucggcuuauccaguagggccacuugggcaaagaacauucacacagcuaucacccaggugcgcaaucugauagggaaagaagaguaugucgacuacaugccagugaugaagcguuauagcgcccccuuugagucggaaggaguauuguga

SEQ ID NO: 15754 - RNA, 9867 nt, Artificial Sequence
  derived and/or modified CDS sequence (opt3) from DENV-4__KU513441__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaagagugguagggagggugaucuccgccacacccuuggcugagaacaccaacagcguuacaaauauugagcucgaaccgccuuucggagacucguauaucgucauaggugugggcaacucugcgcugacuuuacauugguuucggaagggguccucaauuggaaaaauguucgagaguaccuaccgcggcgcaaagagaauggccauccugggugaaacggcuugggauuuugggagcgugggcggacuauucaccucccucggcaaagccguccaccagguuuuugggucuguguauacaacuauguucggaggcgugagcuggaugaucaggauucugaucgguuuucuuguauuguggauugggaccaauucacguaacacaaguauggcaaugacuugcauagccgucggaggcaucacccuguuccucgguuuuacggugcaggcugacaugggcuguguuguguccuggagcgggcgggagcugaagugcggaucuggcauuuucgucguggauaauguucauacauggaccgaacaauacaaguuucagcccgagucaccagcccgacuugcaagugcgauccugaacgcucacaaagacgggguguguggaaucagaagcacuacaagguuggagaauguaauguggaagcagauuaccaacgaacucaauuauguccugugggagggcggucacgacuuaacugugguggccggggaugucaaaggaguucugaccaagggcaaacgcgcacuaacaccucccgccuccgaccucaaguacucuuggaagacgugggguaaagcuaagauauucaccccagaagcccggaacucgacuuuucugaucgauggccccgacacaagcgagugcccuaaugaaagaagggcauggaacuccuucgagguggaggauuacggguucggaauguuuaccacaaauauuuggaugaaauuccgcgaaggcucaagugagguaugugaccaucgacuuaugucugcugccaucaaggaucagaaagcggugcacgccgacaugggguauuggauugaaagcuccaagaaccaaacuuggcagaucgagcgggcuucauugauagaagucaaaaccugccuguggccaaagacgcauacacucuggagcaauggagugcuggagucucagauguuaaucccgaaguccuacgcaggccccuuuagucagcacaacuaucgucaagguuacgccacccagacuguugggccuuggcaccugggaaaacuugagauugauuucggcgaaugcccagguaccacagugacuauccaggagaacugugaccauagaggccccagcuugaggaccacaacggcuucugggaagcucgucacccaguggugcugucgcuccugcacuaugccuccacugcgguuucuaggagaagauggcuguugguaugggauggagauuagaccccugucagagaaagaagagaauauggugaagagucaaguuacagccggacagggcaccagcgaaacuuucucgaugggucuccugugccuuacauuguuuguggaggaaugucugaggcgacgcgucacccggaaacacaugaucuuagcaguagugauaacgcucugcgcgauuauccuggggggacuuacuuggauggaccuguugagagcccucauuaugcugggcgauaccauguccggcaggaucgggggacagacacaucuagcuauaaucgccguuuucaagaugucuccggguuacgugcugggcgucuuucuccguaagcugaccagccgcgagacugcacuuauggugauugggauggcuaugacaaccacauugucaaucccucacgaccugauggaguuaauugacggaaucagucucggccugauacuucugaaaauuguaacucaguucgauaacacccaaguggguacgcuagcccucucccugacauuuauccggucuaccaugagcuuggucauggcauggagaacuaucauggccguucuguucguggugaccuuaauuccacucuguaggacauccugccugcagaagcagucacauugggucgaaaucacugcucuuauucugggggcgcaagccuugcccguguaucucaugacccugaugaaaggagcaagccgacggaguuggccucuaaaugagggcauaauggcuguuggccugguaucucuucucggguccgcccuguugaagaacgacgugccccuggccggaccaauggucgcugguggcuuacuccuggcagccuacgugaugagcgggucgucagcggaucuuucucuggaaaaagcugccaauguucagugggacgagauggcagauaucacgggaaguuccccuauuaucgaagugaagcaggacgaggauggcagcuuuucuauucgcgacgucgaggaaacaaacaugaucaccuugcucgugaagcuggcccuaauaacuguaagcggucuguacccccuugcuaucccaauuacaaugacccucugguauauguggcaggucaaaacucaaagauccggggcacugugggaugugccgucaccugccgcgacacagaaggcugccuugagugagggaguuuacaggaucaugcagcggggcuuauucggcaaaacccaggugggggucggaauucacauggaagguguguuccacacgauguggcauguuacucgaggcagcgugaucugucacgagaccgggagacuggaacccucuugggcagacguccgcaaugauaugauauccuauggaggcgguuggaggcucggggacaagugggauaaagaggaggacgugcaaguacuggccauugaaccaggaaagaaccccaagcaugugcagacaaaaccuggccuuuuuaagacccugacaggcgagaucggggcuguuacuuuggacuucaaaccaggaaccucagguagucccaucauuaaucguaagggcaaagucauagggcuauacggaaacggcguggugacgaagagcggugauuaugucuccgccaucacacaggcagaacggauuggggagccugacuacgagguagaugaagacaucuuuagaaaaaagaggcugacuauuauggaucuccacccgggagcuggcaagaccaaacgcauccugccaucuauagugcgagaggcccuuaagagacgguuaaggacacugauccucgcgcccacccgcguuguggccgcagaaauggaggaagcuuugcguggccugccuauuagauaucagacuccagccgucaaaucggagcauaccgggcgggagaucguggaccucaugugccacgcuacauucacgacuaggcugcuuagcucaacccgcguucccaauuacaaccugauugugauggaugaagcacacuuuacagacccuuccagugucgccgcccgaggauacaucucuaccagaguggagaugggugaagcugcggcaauauucaugacugccacaccgcccggcgcuaccgauccauuuccucaaagcaauucccccauugaggacaucgaacgggagaucccagagaggucauggaacacgggguucgauuggauuacugacuaucagggaaagacaguaugguuugugccuucuaucaaagccggcaaugacauagcaaacugcuugcgcaagagcgguaagaaaguuauucagcuaaguagaaagaccuucgauaccgaauaccccaaaacuaagcugacagacugggauuuugucgugaccacagacaucuccgagaugggggccaacuucagggcuggccgggugauugauccacgucgcugucucaaaccggucaucuuaacugacggaccugaacgaguuauacuggcgggccccauuccagugacgcccgccagcgcagcucaaagaagggggcggaucggacgcaauccugcccaggaggaugaccaguauguauucucuggugauccacuuaagaacgacgaagaucaugcacacuggaccgaggccaagaugcugcucgacaauaucuacacacccgagggcauuaucccuacuuuguuugggccggaaagagagaaaacccaggcuauugauggagaauucaggcugcggggcgagcaacgaaagacauuuguggagcucaugagacgcggugaccugccagucuggcuuucauauaaaguggccuccgcggggauaaguuacaaggacagggaauggugcuucaccggcgagcggaacaaucagauccuagaagagaacauggaaguugagauuuggacucgugagggagaaaaaaagaagcugagacccaaaugguuggaugcaaggguguaugccgacccuauggcuuuaaaggauuuuaaagaguucgccagcggccgcaagucgaucacgcuggacauccucaccgaaauugcuucucugcccacauaccuuuccagccgggcaaaacuggcccucgauaauauagucauguugcauacuaccgagcgagggggaagagcuuaccagcacgcccugaacgaacuaccagagucacuggagacacucaugcuuguagcacuguuaggugcgaugaccgccggcaucuuuuuguucuuuaugcaggggaagggaauuggcaagcugaguaugggucucaucacuauugcuguggccucugggcugcuuuggguugcagaaauccaaccucaguggauagcugccuccaucauucuggaguucuuucucaugguguugcugauccccgaaccagagaaacagaggacaccucaggacaaucaauuaauuuaugucauccuaacgauacugaccauuaucggccucauugcagccaacgaaaugggacuuaucgagaagacuaaaacagauuucggcuuuuaccaggugaagaccgagaccacaauacuggacgucgauuugcgcccggcuagcgcguggacucuguaugccguggcaacgaccauccucacacccaugcugcggcacacuauugaaaauaccucagcuaaccuuagucucgccgccaucgcaaaucaggcugccguucugaugggguugggaaaaggcuggccacugcauagaauggacuuaggugugccucuacuggcgaugggguguuacagccagguaaaccccacaacccucacugcuucccuugugaugcuguugguccacuaugccauuaucggaccaggccugcaagcaaaggccacgcgugaggcucagaaaaggacagcagccgguauaaugaagaauccuaccguugauggcauuacugugaucgaccucgaacccaucucuuacgauccgaaguucgagaaacagcuggggcaagucaugcuuuuagugcugugcgcgggacagcucuugcugaugcggaccacaugggcuuucugugagguacuaacucuggccaccggcccaauucucacacuuugggaagggaacccuggacgcuuuuggaacacgaccaucgcagugagcacugccaauauauuccgaggcuccuaucuggcuggugccggguuggcauuuucacugauuaagaacgcucagacacccagaaggggaaccggcacugccggugagacacucggcgaaaaauggaagcggcagcugaauucuuuagaccgcaaagaguucgaagaguacaagagaagugggauccuugagguugacaggaccgaagcgaagucggcccugaaagauggaagcaagauuaaacaugcagugucccgaggcucuucaaagauccgguggauagucgagcgugggauggugaaaccaaagggaaaggucguggaccucggcugcgguagagggggauggagcuacuauauggcuacgcuaaaaaacguuaccgaaguaaagggcuacacaaaaggcgggcccggacacgaggaaccuaucccgauggccacuuaugguuggaaucuggugaaguugcauuccggcgucgauguguuuuacaaacccaccgagcaaguugacacacugcucugugauauuggggagaguucuagcaacccaacuaucgaagagggacgcacccuuagggugcugaagauggucgaaccuugguugucauccaagcccgaguucugcauuaaagugcugaauccuuauaugccaacaguaaucgaagagcucgagaaguuacagcggaaacacggcgguaaccuggugagauguccccuuagucgcaauagcacccacgaaauguacuggguuucuggggcauccggaaacauugucucaagcgugaauacuacgucgaagaugcugcuaaacagguuuacaacccgacaucggaaaccuacuuaugagaaggacguggaucucggcgcuggcaccagaucugucaguacagaaaucgagaaaccagacaugacgauaauugggaggcgccugcagcguuugcaggaggaacacaaggagaccuggcauuacgaucaagaaaaucccuaccggacuugggccuaucacggauccuacgaggccccgagcacagguucagcguccucuaugguuaacggcgugguaaagcugcucaccaaaccuugggacgugaucccaauggucacucagcuugcuaugacagauaccacacccuucgggcagcagagaguguuuaaggaaaaaguugacacuaggaccccucaaccaaagcccggaacgcgcauggugaugaccacaacugcaaauuggcugugggccuuacugggcaaaaagaagaacccgcgauugugcacccgggaggaguucaucagcaaagucagaaguaaugcugccauuggugcaguguuucaggaagagcagggguggacauccgccagcgaagcuguaaacgacucuagguucugggagcucguugauaaggaacgcgcgcugcaccaagagggaaaaugugagucaugcguguauaacaugaugggcaagagagaaaaaaagcuaggcgaguuugggcgggccaagggaaguagggcaauaugguacauguggcuuggugcucguuuccuggaauucgaggcccucggcuuucugaaugaagaccauugguucgggcgagagaacuccuggagcggagucgagggcgaagguuugcaccgccugggguauauccucgaggaaauugauaaaaaggacggagaucuuauguacgcagacgauacugccggcugggacaccagaaucacggaggaugaccugcagaaugaggaauuaauuacagagcagauggcuccucaucacaaaauccuggccaaggcgauauuuaaauugaccuaucagaacaagguggugaagguccuccggcccacuccaaggggcgcaguuauggauaucauuucucgcaaagaccaaagagggucgggacagguggguacauacggccugaauaccuucacuaacauggaaguacagcuaauccggcagauggaggccgaaggggugauuacccaagaugacaugcagaauccuaagggacuuaaagagagggucgagaaguggcugcgagaaugcggcguggaccgucucaaaagaauggcuaucucaggugaugacuguguugugaagccccuggaugagcgcuuugggacaagcuuguuauuccugaacgacaugggaaaaguccggaaggauauaccacagugggaacccuccaagggcuggaaaaauuggcaggaggugccuuuuugcagucaucacuuccacaagauuuuuaugaaagacggcaggucucucguaguuccauguagaaaccaagaugaacuuaucgggcgcgcccggaucagccagggagcagguuggucccugagggagacggcuugccuaggcaaggccuacgcucagauguggucacugauguauuuccaucgaagagaccuccgguuggccaguauggcaauuuguucugcggugccgaccgagugguuucccacuagcaggacaaccugguccauacacgcccaucaccaguggaugacuacagaagauaugcugaaagucuggaaucgcguguggaucgaggacaacccuaauaugauugauaagaccccaguucacucaugggaagacauccccuaccuugggaagcgugaggaccuguggugcggaagccucauuggcuuaucuuccagagcuacgugggccaaaaacauccauacagcaauaacccaagugcgaaaucugaucgguaaggaagaguaugucgauuacaugagugugaugaaaagguauagcgcuccuucggaguccgaagggguauuguga

SEQ ID NO: 15755 - RNA, 9867 nt, Artificial Sequence
  derived and/or modified CDS sequence (opt3) from DENV-4__KC762694__SS-prME
agcaccaugacacugcucugccuuauccccacugugauggccuuccaccuguccacgagagacggcgagccuuugaugauugucgcuaagcaugaaagagggcggccauuacuguuuaagaccacagagggaauaaacaaguguacucuaaucgcaauggaucucggugaaaugugcgaggacaccguuacauacaaguguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaagcaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaaggugccaaucgagauucgcgaugucaauaaagaaaaggugguagggagaauaaucuccagcacucccuucgcugagaacacaaacucggugaccaauauugaguuggaaccgccuuuuggagacucuuauaucguuauaggugucggcgauuccgcgcucacacugcauugguucaggaaagggucaaguauuggaaagauguuugagagcacuuaccggggcgcaaaacgcauggccaucuuaggugaaaccgcuugggacuucggguccgugggcggacuguuuacgucucuaggcaaggccgugcaccaggucuucgggagcguuuauaccacaauguuuggaggcgugucauggaugaucaggauucucaucgguuuccuggugcuuuggauugggacuaacaguaggaauaccuccauggcaaugacaugcauagccguaggaggcaucacuuuguuucuggguuucaccguccaggcugauaugggcugugugguuagcuggaacgggaaggagcucaaaugcggaucuggcauuuuuguggucgacaaugugcauacguggacagaacaauacaaguuccagcccgagucaccagcccgucuggcaagugcgauccuuaacgcucacaaagacgggguuuguggaauccggagcaccucccgacuggagaaugugauguggaagcagauuacuaacgaauugaauuauguacucugggagggcggucacgaucugacagucguggccggggacgugaaaggagucuuaaccaagggcaagagagcacugacuccucccguuaacgaucuaaaauacucuuggaagaccugggguaaagccaagauauuuacaccagaagcuagaaauucgacguuccucaucgacggccccgauaccagcgagugcccuaacgaacgccgggccuggaauuucuuugagguggaggacuacggguucggaauguuuacuacaaacauuuggaugaaauucagagaaggcuccucagagguaugugaucauaggcugaugagugcagcuaucaaggaccagaaagccgugcacgcggauaugggguauuggauugaaucuagcaagaaucaaaccuggcagaucgagaaggccucccuuauagaagucaaaacaugcuuguggccaaagacucauacccuguggucaaacggagugcucgagagccagaugcugaucccgcgcucuuacgcuggccccuuuucccagcacaacuaucgacaagguuacgcaacgcagacagccgggccuuggcacuuaggaaaacuggagauugacuucggcgaaugcccagguaccacuguuaccauccaggaggauugugaccaucggggccccagucuucguacaacuaccgcuagcgggaaguuggugacacaguggugcuguagaucuugcacgaugccuccacucagguuucugggagaagauggcuguugguaugggauggagauucgcccccuauccgagaaagaagagaauauggucaagucacaagugaccgccggacagggcacaagugaaacauucagcaugggucugcucugccugacccuuuuuguugaggaauguuugcggagaagggugacucgaaagcacaugauccuggucguagugauaacauucugcgcaauuaucuuagggggacucaccuggauggaccugcuucgcgcgcugauuauguugggcgacacgaugucgggccggaucgggggacagauacaucucgccaucauggcuguuuuuaaaauguccccggguuacgugcugggcgucuuccuaagaaagcugacuucuagggagaccgcccucauggugauugggauggcaaugacaaccguauuuagcaucccucacgaucugauggagcuuauugacggaaucucauugggccugauauuacucaaaauugugacucauuucgauaacacacaggucgguacccuggcucuuagucugacauucauccguuccacuacgccccugguuauggccuggcgcaccaucauggcaguguuuuucguggucacacucauuccccugugucggaccucuugcuugcaaaagcagagccacuggguggaaaucacugcccugauuuuaggggcucaggcgcucccuguuuaucugaugacccuuaugaaaggagccuccagaaggucauggccccugaaugagggcauaauggcaguaggcuuggugagccuccuggggagugcucuacugaagaacgacgucccacuugccggaccuaugguggccgguggccuccuguuggcugcauacguuaugucuggguccagcgccgaucugucguuagaaaaggcggcuaaugugcaaugggacgagauggccgauaucacaggaucaucucccauuaucgaagucaaacaggacgaggauggcaguuuuuccauucgagacguggaggaaacuaacaugaucacccuccugguaaaacuugcacugauaacggucagcgguuuguacccacucgccaucccggugacaauggcucugugguauguuuggcaagugaaaacccagcggucuggggcacuaugggaugucccuagccccgccgcgacucaaaaggcuacacuguccgagggaguguaccgcauuaugcagagaggccuuuucggcaaaacccagguuggggugggaauccacauggaaggugucuuucauacuauguggcacgugacaaggggcucaguaauuugucaugagaccgggcggcucgaaccaaguugggccgacgugcgaaaugauaugaucagcuauggaggcgguuggagacugggggacaagugggacaaggaggaggauguucaggucuuggcaauagaacccggcaagaacccuaagcacgugcaaacgaaaccaggcuuauucaagacucugaccggcgagauuggggccgugacacucgacuuuaaacccggaaccucugguuccccuaucaucaauaagaaaggcaaggucauugggcuguacggaaacggcguagugacaaagucaggugauuauguuagugcuauaacucaggccgaacgcaucggggagccggacuacgagguggaugaagacauuuucaggaaaaagcgucuuaccaucauggaucugcauccaggagcaggcaaaacgaagcggauuuugcccagcaucgucagagaggcucuaaaaaggcgccugcgaacacucauacuggccccuacuagagugguugcggccgaaauggaggaagcacuucggggcuuaccaaucagguaucagacccccgcugugaaguccgagcacacagggcgcgagauugucgaccugaugugccacgccaccuuuacuacccgucucuugucuucgacaagagugccuaauuacaaccugaucguaauggaugaagcucauuucacggacccgugcagcguggcagcccggggauacauuucaacuaggguugagaugggugaagccgcugcgaucuuuaugaccgcaacacccccaggcuccauagauccuuucccccagaguaauucuccaauugaggacaucgaacgcgagaucccugagcgaagcuggaacaccggguucgacuggauuacugauuaucaaggaaagacagucugguuugugcccuccaucaaagccggcaaugacauagcuaacugucucagaaagucagguaaacgggugauucagcugucuaggaagaccuucgauacggaauacccaaaaacuaaacuuacagacugggauuuugucguuaccaccgacaucagcgagaugggggccaacuuccgcgcaggcagagugauugauccgaggcggugccugaagccuguaaucuugacugacggacccgaacgugugauacuagccggcccaauucccgucacuccugcuagugcggcccagcgccgagggagaaucggaaggaauccagcacaagaggaugaccaguauguguuuuccggugauccccugaaaaacgacgaagaucacgcucauuggaccgaggccaagaugcucuuagacaauaucuacacaccugagggcauuaucccgacucuguucgggccagaacgggagaaaacgcaggcaauugacggagaauuucgccuuagaggcgagcagaggaagaccuucguugagcugaugcggcgaggugaucuccccgugugguugagcuauaaagucgccucugcugggauaucauacaaggacagagaaugguguuuuacaggcgagcgcaacaaucaaauccuggaagagaacauggaaguagagauuuggacuagggagggagaaaagaaaaagcuccggccuaaauggcuggaugcccguguguaugcggaccccauggcacuuaaggauuucaaagaguuugccuccggcagaaagaguaucacccuagacauccugacagaaauugcuaccuugccaacuuacuuaagcucgaaggccaaacuggcucucgauaauauaguuaugcugcacacgaccgagaaaggugggagggcauaccagcacgcccuuaacgaacugccugagucucucgagacauugaugcugguggcucuacugggggccaugacugcaggcaucuuccucuuuuucaugcaggggaaaggaauuggcaaacuuuccaugggucugaucgcgauugccgucgcuagcggguuauuguggguggccgaaauccagccccaauggauagcagcuucaaucauucuggaguucuuucucaugguccugcuuaucccagaaccugagaaacagcgcaccccgcaggacaaucagcugauuuaugugauccucacaauauugaccauuaucggccugauugccgcaaacgaaaugggauuaaucgagaagacuaaaacagauuucggcuuuuaccaaguuaagacggagaccacuauacuagacguggaucugcggcccgccagugcuuggacacucuaugcgguagccaccaccauccuuacaccaaugcugcgacauacuauugaaaauacgucugcaaacuugucccuggcugccaucgccaaucaggcagcugugcucauggggcugggaaagggcuggccucuucacagaauggaccucggugucccccuguuggccauggggugcuacagccagguuaacccaaccacacugacugcgucauuagugaugcuacugguccauuaugcuauuaucggaccuggccuccaggccaaagcaaccagggaggcccaaaagcgcacagcugcagguauaaugaaaaaucccaccguggauggcauuacuguaaucgaccuugaaccgaucaguuacgacccaaaguucgagaaacagcugggacaggugauguugcugguucucugugugggacaacugcuuuuaaugcggacgacaugggcccugugcgagguccucaccuuggcgacuggcccugugaugacccugugggaagggaaccccggaagauuuuggaacacaacuauugcugucagcaccgccaauaucuuccguggcuccuaucuagccggugcagggcuggcuuuuucucucauaaagaacgcccagacaccaaggcggggaacgggcaccacuggugagacacuuggcgaaaaguggaaacgccagcugaauagcuuggaucgaaaggaguucgaagaguacaaaagauccgggauucuggagguggacaggaccgaagcaaagucagcucuccgggauggaucuaaaaucaaguacgccguuagucgcggcucgagcaagauuagauggaucguagagagggggaugauaaaacccaagggaaaaguggucgaccugggcuguggucgagggggaugguccuauuacauggcgacuuuaaagaacgugacagaaguuaaaggcuauaccaagggcgggccuggacacgaggaaccgauccccauggccacguacgguuggaaucuugugaagcugcauucuggcgucgauguguuuuauaaaccaaccgagcagguagacacacuccuaugcgauauuggggagucaagcuccaacccuacuaucgaagagggacggacccugcguguguugaagaugguugaacccuggcugaguucuaaaccugaguucuguauuaagguccucaauccauacaugcccacagugaucgaagaacuugagaaacugcaaagacgccacggcgguagcuuggugaggugcccucugucacggaacuccacucacgaaauguauugggucaguggggcaagcggaaauauuguuucuuccgugaacaccaucucaaagaugcucuuaaauagauuuacaacccgccauaggaaaccaacuuacgagaaggacguagaucugggcgcuggcacgcgaagcgugucgacagaaaccgagaagcccgacaugacuauaauugggcggagacuucagaggcugcgcgaggaacacaaagagaccuggcauuacgaucaggaaaacccguaucguacaugggccuaccacggaucuuaugaggcaccuaguacggguuccgcuagcucaauggucaauggcgugguuaagcuacucaccaaaccaugggacgugauccccauggucacucagcuggccaugacagacaccacuccuuucgggcaacagcggguguuuaaggaaaaaguagauacaagaaccccacagcccaagccgggaacaaggaugaucaugacuaccacggccaacugguugugggcgcugcucggcaagaaaaaguccccucgccuuuguacccgagaggaguucauuucuaaaguucggagcaaugcugcaauaggugccguguuccaggaggaacagggguggacaagugcuuccgaagccgucaacgacagcagauuuugggagcugguggauaaggaaagggcauuacaccaggagggaaaaugcgagucuugcguguacaauaugaugggcaagcgcgaaaagaaacugggcgaguucgggagagccaagggaucacgggcuaucugguauaugugguugggugcgagguuucucgaguucgaggcccugggcuuucuaaacgaagaccauugguucagucgugagaacuccuggagcggggucgagggagaaggccuucaccgacuggguuacauucucgaggauaucgacaaaaaggauggggaccugauuuaugcagaugacacugcuggaugggauacccgcaucacagaagacgauuugcugaaugaggagcucauaacugaacagauggccccacaucacaaaacccuugcaaaggccaucuuuaagcugacguaccaaaacaaaguugugaagguauuaagaccaacaccuaaaggcgcugugauggacauuaucucucggaaggaccagaggggcucggggcaggucggaaccuacggucugaauacuuucacaaacauggaggugcaguugauucgccaaauggaagccgagggcguuaucacccaggaugacaugcagaaucccaaagggcucaaggaaagaguggagaaauggcugaaggaguguggagucgaucggcuaaagaggauggcgauaucaggcgacgauugcgugguaaaaccacuugacgaacgauuuagcacuucccuacucuuccugaacgauauggguaagguucguaaagacauuccccagugggagccuaguaagggguggaaaaauuggcaagaagugccauuuuguucucaucacuuccacaagaucuuuaugaaggauggaaggagcuuggucgugccgugccgcaaccaggacgaguuaaucggccgggcaaggauuucccagggcgccggguggucacugagagaaaccgcuugucucggaaaagccuaugcacagauguggagucuuauguacuuccaucgccgggaucugaggcuagcuucuauggccauaugcagcgcuguucccacagagugguucccuacgucccgaaccacuuggucaauccacgcccaucaccaauggaugacaaccgaggacaugcugaagguguggaauagagucuggauugaagacaacccaaauaugacugauaaaacacccgugcacagcugggaggacaucccuuaucucgguaagcgggaagauuugugguguggcucucugauugggcuuuccaguagggcaaccugggcgaaaaacauccauacggccauaacacagguacgcaaucugaucggaaaggaggaauacguggacuauaugccagcuaugaagcguuacagcgcccccuuugagucggagggcguccucuga

SEQ ID NO: 15756 - RNA, 9867 nt, Artificial Sequence
  derived and/or modified CDS sequence (opt3) from DENV-4__KC762695__SS-prME
ucgaccaugacacugcucugccuuauccccacugccauggcuuuccaccuguccacgagagacggagagccuuugaugauuguggcaaagcaugaaagggggcggccauuacuguuuaaaaccacagagggaauaaacaaguguacuuuaaucgccauggaucucggugaaaugugcgaggacaccgucacauacaaauguccgcugcuuguuaauaccgaacccgaggauauugacucuuggugcaaccugacuucaacaugggugauguauggaaccuguacgcagaguggggagcgccgacgugaaaagagaagcguagcguugacuccucacuccggaaugggccucgagaccagggcugaaacauggaugucuucggagggugccuggaaacaugcacaacggguggagucauggauccugcgcaauccaggguucgcccugcucgcuggauuuauggcauacaugauuggccagacuggcauccagagaaccgucuucuuuguguuaaugaugcugguugcccccagcuaugggaugaggugcgugggagucgguaaccgggauuucguggaaggcguaagugggggagcuuggguugaccuuguguuggagcacggcgguugugucacaaccauggcccaggggaagccuacgcuggauuuugaacugacuaagacaaccgcgaaagagguggcacuccugcgcacuuacugcauagaagccuccaucucuaauauuacaaccgcuacgcgauguccaacccaaggagagcccuaucuuaaggaggaacaggaccagcaguacaucugcagaagggauguggucgaccggggcuggggcaacggguguggacuguucgguaaaggcgggguugugacaugcgccaaguuuuugugcagcggaaaaauuacuggcaaucucguacaaaucgagaaccuggaauauaccguggucgugacaguucauaauggugauacucacgcaguggggaacgacaccuccaaucacggcgucacagcuaccauaacuccucguucaccaaguguggagguaaaguuaccggauuacggagaacugacgcucgacugugagccccgcagcggcauugacuucaacgagaugauccuuaugaagaugaaaaagaaaacauggcugguucauaagcagugguuuuuggaucugccucugccauggaccgccggggcggacacuucugaagugcacuggaauuacaaagagagaauggucaccuucaaggugccccaugccaaaaggcaggaugucacagugcucggaucccaggaaggugcaaugcacucagcucuggccggcgcuaccgagguugacagcgggaacggaaaucacauguuugccggccaucuuaagugcaaggugcggauggaaaaacugcgaauuaaggguaugaguuauacuauguguucugggaaauucuccaucgauaaggagauggcagagacacaacacggcacgaccguagucaaagugaaguacgaaggagccggcgcuccuugcaagguuccaaucgagauucgcgacgugaacaaagaaaaggucguggggagaauaaucagcucgacucccuucgcggagaacacaaauucuguaaccaacauugaguuggaaccgccuuuuggagauuccuauaucgugauagguguuggcgacucagcacucacacugcauugguucaggaaagggaguagcauuggaaagauguuugaguccacuuaccggggcgccaaacgcauggcuaucuuaggugaaaccgccugggauuucgggucugucggcggacuguuuacgagccuaggcaaggcaauccaccagguguucgggucaguguauaccacaauguuuggaggcgucaguuggaugauuagaauccucauuggucugcuuguuuuguggauagggacuaauuccaggaacaccagcauggccaugacauguaucgcugugggaggcauuacucuguuccucgguuuuaccgugcaggccgacaugggcugcguagucucuuggaaugggaaggagcugaaauguggaucaggcaucuucgugguugauaacgugcauacguggacagaacaauacaaguuucagcccgagaguccagcacgucuugcgagcgcuauccugaaugcccacaaagacggggucugcggcauucgguccaccacucgauuggagaacgugauguggaagcagauaacaaaugaacucaacuauguucugugggagggcggucacgacuuaaccgugguagcaggggaugucaaaggagugcugacuaagggcaagagagcccuaaccccucccgugaaugaccucaaauacucuuggaagacaugggguaaagcuaagaucuucacgccagaagccaggaacucgaccuuucugauugauggccccgacacuagcgaguguccuaaugaacgccgggcauggaacuuccuugaggucgaggauuacggguucggaauguuuuccacaaauaucuggaugaaauucagagaaggcucaagugagguuugcgaccauagguugaugucugcugccauuaaggaucagaaagcggugcacgccgacaugggguauuggaucgaaagcuccaagaaccaaaccuggcagauagagaaggcuucacugaucgaaguaaaaacaugucucuggccaaagacucauacccuguggagcaacggaguguuagagucucagaugcugauuccgcgcuccuacgcaggccccuuuagucagcacaauuaucgacaagguuacgccacgcagaucgcugggccuuggcaccuuggaaaauuggagauugauuucggcgaaugcccagguacaaccgucacuauccaggaggacugcgaucaucggggccccagccuccguaccacaacugccucugggaagcuggugacccagugguguugcagauccuguacaaugccuccacuaagguuucugggagaagacggcugcugguaugggauggagauacgcccccucucagagaaagaagagaacaugguuaagagucaagugacggcaggacagggcaccagcgaaacuuucucgaugggucugcuuuguuugacacuguuugucgaggaaugcuuacggagaagggugacccgaaagcacaugauucucguugugacuaucacauucugugcgauuauccuagggggacuuaccuggauggaucuguugcgcgcccucauaaugcugggcgacacgauguccggccggaucgggggacagauucaucuagcuaucauggccgucuuuaaaaugucuccggguuacguacugggcguguuccucagaaagcugacuagcagggagaccgcacuuaugguuauugggauggcuaugacaaccguguuuucaaucccucacgacuugauggagcugauagauggaauuaguuuaggccucauccugcuuaaaaucgucacucauuucgacgauacacagguggguacccuggcccuaucccucacauuuauucguucuacuaccccacugguaauggcauggcgcacgaucauggccguguucuucgucguuacauugauuccccugugccggaccagcuguuuacaaaagcagucccacuggguggaaauaacugcucucauccugggggcgcaggcccuuccuguguaucugaugaccuugaugaaaggagcaucaagaaggagcuggccccucaaugagggcauuauggcugucggccuggugagucuacuggggucugcccuucucaagaacgacguuccacuggccggaccuaugguagcugguggcuugcuguuagcagccuacgugauguccgggagcucggcggaucucucacuggaaaaggcugccaauguccaaugggacgagauggcagauaucacaggaucuagucccauuaucgaagugaaacaggacgaggauggcuccuuuagcauacgagacguugaggaaacuaacaugaucacccuucuggugaaguuggcccucauuacggucucuggucuguacccacuagcuaucccggugacaauggcacugugguauauuuggcagguaaaaacccagcggagcggggcccuuugggaugucccuucccccguggcgacucaaaaggcuacacucucagagggaguuuaccgcaucaugcagagaggccuguucggcaaaacccaggugggggucggaauacacauggaagguguguuucauacuauguggcacguuacaaggggcagugugauuugccaugagaccgggcgguuggaaccaagcugggccgacguccgaaaugauaugaucucuuauggaggcgguuggagauuaggggacaagugggacaaggaggaggaugugcagguacuggcaaucgaacccggcaagaacccuaagcacgugcaaacgaaaccaggccucuucaagacucugaccggcgagauuggggccguuacacuugacuuuaaacccggaaccuccgguucaccuauaaucaauaagaaaggcaaggucauugggcuguacggaaacggcguggugacaaagaguggugauuaugucagcgcuaucacucaggccgaacgcauuggggagccggacuacgagguagaugaagacaucuucaggaaaaagcguuugaccauaauggaucuacauccaggagcaggcaaaacgaagcggauccugcccuccauugugagagaggcucucaaaaggcgccugcgaacacuuaucuuagccccuacuagaguuguggcggccgaaauggaggaagcacugcggggccucccaauuagguaucagacccccgcugucaagucugagcacacagggcgcgagaucguggacuugaugugucacgccaccuuuacuacccgucugcucucgagcacaagaguuccuaauuacaaccugauagugauggaugaagcucauuucacggacccgugcucagucgcagcccggggauacauuuccacuaggguggagaugggugaagccgcugcgaucuuuaugaccgcaacacccccaggcaguaccgauccuuucccccagucuaauagcccaaucgaggacauugaacgcgagaucccugagcgauccuggaacacuggguuugacuggauaacagauuaucaaggaaagaccguaugguucgugcccucaauuaaagccggcaaugacaucgcuaacugccuuagaaagucugguaaacggguuauucagcugagcaggaagacguucgauacugaauacccaaaaacaaaguugaccgacugggauuuugucgugaccacugacaucagugagaugggggccaacuuccgcgcaggcagagugauagauccgaggcggugucuaaagccugucauucugacagacggacccgaacguguuauccucgccggcccaauccccgugaccccugcuuccgcggcccagcgccgagggagaauuggaaggaauccagcacaagaggaugaccaguauguauuuagcggugauccccuaaagaacgacgaagaucacgcucauuggacagaggccaagaugcugcuugacaauaucuacacuccugagggcauuauaccgacgcuguucgggccagaacgggagaaaacccaggcaaucgacggagaauuucgccucagaggcgagcagaggaagacauucguggaguugaugcggcgaggugaucugcccgucuggcucucuuauaaaguggccucagcugggauuuccuacaaggacagagaauggugcuuuacuggcgagcgcaacaaucaaauccuggaagagaacauggaaguugagaucuggaccagggagggagaaaagaagaaacuucggccuaaauggcuagaugcccguguguaugcggaccccauggcacugaaagauuucaaagaguuugccaguggcagaaagagcauuacauuggacauauuaaccgaaaucgcuacucugccaacguaccucucgucuaaggccaaacuggcucuugauaauauugucaugcugcacaccacagagaaagggggaagggcauaccagcacgcccucaacgaauugccugagucccuggagacucuaaugcugguagcucuccuuggugccaugaccgcaggcaucuuccuguuuuucaugcaggggaaaggaauuggcaaguuaagcaucgguuugauagcgaucgccguggcuucagggcugcucuggguugccgaaauucagccccaauggaucgcagcuaguauuauccuggaguuuuuccuuauggugcugcucauaccagaaccugagaaacagcgcacaccgcaggacaaucaguugauuuaugucauccugaccauuuuaacuaucauaggccuaaucgccgcaaacgaaaugggacugauugagaagacaaaaacggauuucggcuuuuaccaagugaagaccgagacuacaauccucgacgucgaucuucggcccgccucugcuuggacccuguaugcgguggccaccacaauuuugacuccaaugcugcgacauacgaucgaaaauaccuccgcaaaccucagccuggcugccauagccaaucaggcagcuguucuuauggggcucggaaagggcuggccucugcacagaauggacuugggugugccccuguuagccaugggguguuacucacagguaaacccaacaacucuaaccgcgagucuggugaugcuccuuguccauuaugcuauuaucggaccuggccugcaggccaaagcaacaagggaggcccaaaagcgcaccgcugcagguaucaugaaaaaucccacuguugauggcauuacggugaucgacuuggaaccgauaagcuacgacccaaaguucgagaaacagcuggggcaggucaugcuccuggugcuuugcguaggacaauuacugcucaugcggacaaccugggccuugugugaggugcugacucuagcgaccggcccuauuaugacacugugggaagggaaccccggaagauuuuggaacacuaccaucgcuguuuccacagccaauauuuuccguggcucuuaucucgccggugccgggcuugcuuuuagccugaucaagaacgcccagacgccaaggcggggaaccggcacuacaggugagaccuugggcgaaaaguggaaacgccagcuaaauucccucgaucgaaaggaguucgaagaguacaaaagaucagggauacuggagguggacaggacugaagcaaagucugcuuuacgggauggaaguaaaaucaagcacgccgucucgcgcggcagcuccaagauuagauggaucguggagagggggaugauuaaacccaagggaaaagucguggaccuuggcugcggucgagggggauggucuuacuauauggcgacacugaagaacguuaccgaaguaaaaggcuacacgaagggcgggccuggacaugaggaaccgauccccauggccaccuaugguuggaaucucgugaagcuacacucaggcgucgauguguuuuacaaaccaacagagcagguugacacucuguugugugauauuggggagagcuccaguaacccuaccaucgaagagggacggacacugcgugugcucaagauggucgaacccuggcuuucuagcaaaccugaguucugcauaaaggugcugaauccauauaugcccacuguaauugaagaguuggagaaacugcaaagacgccacggcgguucacucgugagguguccuuuaucccggaacaguacccaugaaauguacuggguuagcggggcaucuggaaauaucgucuccucagugaacacaaucagcaagaugcugcuuaauagauuuaccacucgccacaggaaaccaacguaugagaaggacguggaucugggcgcuggcacacgaucggucucuaccgaaacugagaagcccgacaugaccauuauagggcggagacuacagaggcuccgcgaggaacauaaagagacauggcacuacgaucaggaaaacccguaccguacgugggccuaucacggaaguuacgaggcaccuuccaccgguagcgcuucauccaugguuaauggcgugguaaagcuguugacuaaaccaugggacgugauccccauggucacacagcuggccaugaccgacacuacaccuuucgggcaacagcggguguuuaaggaaaaaguugauaccagaacaccacagcccaagccgggaacuaggaugauuaugaccacgaccgccaacuggcucugggcgcuucugggcaagaaaaagucuccucgcuuaugcacacgagaggaguucaucagcaaagugcggaguaaugcugcaauuggugccgucuuucaggaagaacaaggguggacuuccgcuagcgaagccgugaacgacucuagauucugggagcugguagauaaggaaagggcauugcaucaggagggaaaaugugagucaugcguuuauaauaugaugggcaagcgcgaaaagaaacucggcgaguucgggagagccaagggaagucgggcuaucugguacauguggcugggugcgagguuucuagaguucgaggcccuuggcuuucugaacgaagaccacugguucucccgugagaacagcuggucugggguggagggagaaggccuccaucgacuggguuauauauuggaggauaucgacaaaaaggauggggaccugauuuacgcagaugacaccgcuggaugggauacacgcaucacugaagacgaucuccuuaaugaggagcugauuaccgaacagauggcaccccaccauaaaacguuagcaaaggccaucuuuaagcugacauaucaaaacaaagucgugaagguguugagaccaaccccuaaaggcgcugucauggacauaauuucgcggaaggaccagaggggcucagggcagguuggaacuuacggucucaauacauucaccaacauggaggugcagcugauccgccaaauggaagccgagggcguaaucacucaggaugacaugcagaaucccaaagggcuagaagagagaguggagaaguggcuuaaagaaugcggagucgaucggcugaagaggauggcgauuagcggcgacgauugugugguuaagccacucgacgagcgauuuuccaccagucuguuguucuuaaacgauauggguaaagugcguaaggacauaccccagugggaaccuucuaaaggguggaagaauuggcaagaggucccauuuugcagccaccacuuccauaaaaucuuuaugaaggauggaagaucccuggugguaccgugucgcaaccaggacgaacucauuggccgggcaaggaucucacagggcgccggguggagucuuagagagacagcuugccugggaaaggccuacgcacagauguggucucuaauguauuuccaccgccgggaucugaggcucgcuagcauggccauuuguuccgcuguucccacggagugguuuccuaucucacgaaccacuuggagcauacaugcccaccaccaauggaugacaaccgaagacauguugaaaguguggaauagagucuggaucgaggacaacccaaauaugacugauaagacacccauucauucuugggaagacaucccuuaccuggguaaacgggaggaucuuuggugcggcucccugauugggcucaguagcagggcaaccugggcgaagaacauccacacggccauuagccaggugcgcaauuuaauaggaaaagaagaguauguugacuacaugccagugaugaagcguuauuccgcucccucugagucagaaggcguccuguga

SEQ ID NO: 15757 - RNA, 9867 nt, Artificial Sequence
  derived and/or modified CDS sequence (opt3) from DENV-4__KC762696__SS-prME
agcaccaugacacugcucugccuuauccccacugugauggccuuccaccuguccacgagagacggagagccuuugaugauugucgcuaagcaugaaagggggcggccauuacuguuuaagaccaccgagggaauaaacaaguguacucuaaucgcaauggaucucggugaaaugugcgaggacaccguuacauacaaauguccgcugcuugugaauaccgaacccgaggauauugacugcugguguaaccugacuucuacaugggugauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaaggugccaaucgagauucgcgaugucaauaaagaaaaggugguagggagaauaaucuccagcacucccuucgcugagaacacaaacucggugaccaauauugaguuggaaccgccuuuuggagacucuuauaucguuauaggugucggcgauuccgcgcucacacugcauugguucaggaaagggucaaguauuggaaagauguuugagagcacuuaccggggcgcaaaacgcauggccaucuuaggugaaaccgcuugggacuucggguccgugggcggacuguuuacgucucuaggcaaggccgugcaccaggucuucgggagcguuuauaccacaauguuuggaggcgugucauggaugaucaggauucucaucgguuuccuggugcuuuggauugggacuaacaguaggaauaccuccauggcaaugacaugcauagccguaggaggcaucacuuuguuucuggguuucaccguccaggcugauaugggcugugugguuagcuggaacgggaaggagcucaaaugcggaucuggcauuuuuguggucgacaaugugcauacguggacagaacaauacaaguuccagcccgagucaccagcccgucuggcaagugcgauccuuaacgcucacaaagacgggguuuguggaauccggagcaccacucgacuggagaaugugauguggaagcagauuacaaacgaauugaauuauguacucugggagggcggucacgaucugaccgucguggccggggacgugaaaggagucuuaacuaagggcaagagagcacugaccccucccguuaacgaucuaaaauacuccuggaagacaugggguaaagccaagauauuuacgccagaagcuagaaauucuaccuuccucaucgacggccccgauacuucggagugcccuaacgaacgccgggccuggaauuucuuugagguggaggacuacggguucggaauguuuacaaccaacauuuggaugaaauucagagaaggcagcuccgagguaugugaucauaggcugaugucagcagcuaucaaggaccagaaagccgugcacgcggauaugggguauuggauugaaaguucuaagaaucaaacauggcagaucgagaaggccagccuuauagaagucaaaacuugcuuguggccaaagacccauacgcugugguccaacggagugcucgagucacagaugcugaucccgcgcagcuacgcuggccccuuuucucagcacaacuaucgacaagguuacgcaacacagaccgccgggccuuggcacuuaggaaaacuggagauugacuucggcgaaugcccagguacuaccguuacaauccaggaggauugugaccaucggggccccucccuucguacuaccacagcuagugggaaguuggugacgcaguggugcuguagaagcugcaccaugccuccacucagguuucugggagaagauggcuguugguaugggauggagauucgcccccuaucugagaaagaagagaauauggucaagucccaagugacugccggacagggcacaucagaaaccuucaguaugggucugcucugccugacucuuuuuguugaggaauguuugcggagaagggugacacgaaagcacaugauccuggucguagugauaaccuucugcgcaauuaucuuagggggacucacguggauggaccugcuucgcgcgcugauuauguugggcgacacuaugagcggccggaucgggggacagauacaucucgccaucauggcuguuuuuaaaaugucgccggguuacgugcugggcgucuuccuaagaaagcugaccuccagggagacagcccucauggugauugggauggcaaugaccacuguauuuucuaucccucacgaucugauggagcuuauugacggaaucagcuugggccugauaauuuuaaaaaucgugacacauuucgauaacacccaggucgguacacucgcucugucacuuacuuucauccguaguaccacgccacugguuauggccuggcgcacaauuauggcaguguuuuucguggucacccuaaucccccucugucggacuuccugccugcaaaagcagucucacuggguggaaauuaccgccuugauacugggggcucaggcguuaccuguuuaucucaugacacugaugaaaggagccagcagaagguccuggccccuuaaugagggcaucauggcaguaggccuggugucauugcucgggagcgcucugcuaaagaacgacgucccacuggccggaccuaugguggccgguggccuucuccuggcugcauacguuaugagugggucuuccgccgauuugagccuggaaaaggcggcuaaugugcaaugggacgagauggccgauauuacuggaucgucacccaucauugaagucaaacaggacgaggauggcucuuuuaguauccgagacguggaggaaaccaacaugauaacguuacucguaaagcuggcacuuaucacagucuccggucuguacccauuggccauuccggugaccauggcucucugguauguuuggcaagugaaaacucagcggagcggggcacugugggaugucccuucucccgccgcgacacaaaaggcuacccuaagcgagggaguguaccgcaucaugcagagaggccuguucggcaaaacucagguuggggugggcauucacauggaaggugucuuucauacaauguggcacgugaccaggggcuccguaaucugucaugagacggggcggcuugaaccaucaugggccgacgugcgaaaugauaugauaaguuauggaggcgguuggagacucggggacaagugggacaaggaggaggauguucagguccuggcaauugaacccggcaagaacccuaagcacgugcaaacuaaaccaggcuuguucaagaccuuaacaggcgagaucggggccgugacccuggacuuuaaacccggaacaagcgguucuccuaucauuaauaagaaaggcaaggucauagggcucuacggaaacggcguagugacuaaguccggugauuauguuucagcuaucacccaggccgaacgcauuggggagccggacuacgagguggaugaagacaucuucaggaaaaagcgucugacgauuauggaucuucauccaggagcaggcaaaacaaagcggauccugcccaguauagucagagaggcuuugaaaaggcgccuacgaacucugauccucgccccuaccagagugguugcggccgaaauggaggaagcacugcggggccuuccaauuagguaucagacacccgcuguaaagagcgagcacaccgggcgcgagaucgucgacuuaaugugccacgccacuuuuaccacacgucugcucuccucuacgagagugccuaauuacaacuugauuguaauggaugaagcucauuucacugacccgugcucgguggcagcccggggauacaucagcaccaggguugagaugggugaagccgcugcgauauuuaugacagcaacacccccaggcucaauugauccuuucccccaguccaauaguccaaucgaggacaucgaacgcgagauuccugagcgaucuuggaacacuggguucgacuggaucacagauuaucaaggaaagaccgucugguuugugcccagcauaaaagccggcaaugacauugcuaacugucugagaaaguccgguaaacgggugauccagcucucaaggaagacguucgauacugaauacccaaaaacaaagcugaccgacugggauuuugucguuaccacugacauuucugagaugggggccaacuuccgcgcaggcagagugaucgauccgaggcggugccuuaagccuguaauacugacagacggacccgaacgugugauuuuggccggcccaauccccgucaccccugcuagcgcggcccagcgccgagggagaaucggaaggaauccagcacaagaggaugaccaguauguguuuaguggugaucccuuaaagaacgacgaagaucacgcucauuggacagaggccaagaugcugcucgacaauauuuacacuccugagggcaucauuccgacguuauucgggccagaacgggagaaaacccaggcaauagacggagaauuucgccugagaggcgagcagaggaagacauucguugagcuuaugcggcgaggugaucugcccguguggcucuccuauaaagucgccagcgcugggaucucuuacaaggacagagaaugguguuuuacuggcgagcgcaacaaucaaauuuuggaagagaacauggaaguagagaucuggaccagggagggagaaaagaaaaagcugcggccuaaauggcucgaugcccguguguaugcggaccccauggcacugaaggauuucaaagaguuugccucaggcagaaaguccaucacacuugacauucuaaccgaaauagcuacucugccaacguacuugaguagcaaggccaaauuagcucuggauaauaucguuaugcuccacaccacagagaaaggugggagggcauaccagcacgcccugaacgaacuuccugagucgcuggagacucucauguugguggcucugcuaggggccaugaccgcaggcauuuuccuguuuuucaugcaggggaaaggaaucggcaagcucucuaugggucuuauugcgaucgccgucgcuuccgggcuguuauggguggccgaaauacagccccaauggaucgcagcuagcauuaucuuggaguucuuucugaugguccuccugauuccagaaccugagaaacagcgcacaccgcaggacaaucagcuuaucuaugugauacugaccauucucacuaucauuggcuugaucgccgcaaacgaaaugggacugauagagaagacaaaaacggauuucggcuuuuaccaaguuaagaccgagacuacaaucuuagacguggaucuacggcccgccucagcuuggacccuguaugcgguagccaccacaauucucacuccaaugcuucgacauacgaucgaaaauaccagugcaaaccugucuuuggcugccauugccaaucaggcagcugugcugauggggcucggaaagggcuggccucugcacagaauggaccuuggugucccccuccuggccauggggugcuacucccagguuaacccaacaacuuugaccgcgagccuggugaugcugcuaguccauuaugcuaucauaggaccuggccuacaggccaaagcaacaagggaggcccaaaagcgcaccgcugcagguauuaugaaaaaucccacuguggauggcaucacgguaaucgaccucgaaccgauuucauacgacccaaaguucgagaaacagcuuggacaggugaugcuguugguucugugugugggacaacuccugcuuaugcggacaaccugggccuuaugcgagguccugacucucgcgaccggcccugugaugacauugugggaagggaaccccggaagauuuuggaacacuaccaucgcugucaguacagccaauauauuccguggcagcuaucuggccggugccgggcuagcuuuuucccugauuaagaacgcccagacgccaaggcggggaaccggcacuacaggugagacccucggcgaaaaguggaaacgccagcuuaauucucuggaucgaaaggaguucgaagaguacaaaagaagcgggaucuuggagguggacaggacugaagcaaaguccgcucugcgggauggaucaaaaauuaaguacgccguuucucgcggcaguucgaagaucagauggauaguagagagggggaugaucaaacccaagggaaaaguggucgaccucggcuguggucgagggggauggagcuauuacauggcgacacugaagaacgugaccgaaguuaaaggcuauacgaagggcgggccuggacacgaggaaccgauucccauggccaccuacgguuggaauuuagugaaacuucauuccggcgucgauguguuuuauaaaccaacagagcagguagacacucugcucugcgauaucggggagucuucaagcaacccuaccauugaagagggacggacacuacgugugcugaagaugguugaacccugguuguccaguaaaccugaguucuguaucaagguccugaauccauacaugcccacugugauugaagaacucgagaaacuucaaagacgccacggcgguucucuggugaggugcccuuugagccggaacucaacccacgaaauguauugggucuccggggcaaguggaaauaucguuagcucugugaacacaauauccaagaugcugcucaauagauuuaccacucgccauaggaaaccaacguacgagaaggacguagauuuaggcgcuggcacacgaucagugagcaccgaaacugagaagcccgacaugaccauuaucgggcggagacugcagaggcuucgcgaggaacacaaagagacauggcauuacgaucaggaaaacccguaucguacgugggccuaccacggaucguaugaggcaccuucuaccgguagugcuuccagcauggucaauggcgugguuaagcugcuaacuaaaccaugggacgugauccccauggucacacagcucgccaugaccgacacuacaccuuucgggcaacagcggguguuuaaggaaaaaguagauaccagaacaccacagcccaagccgggaacuaggaugauuaugaccacgaccgccaacuggcugugggcguugcugggcaagaaaaagucaccucgccucuguacacgagaggaguucauauccaaaguucggucuaaugcugcaaucggugccguguuccaggaggaacagggguggacuagcgcuagugaagccgucaacgacuccagauuuugggagcuuguggauaaggaaagggcacugcaccaggagggaaaaugcgagagcugcguguacaauaugaugggcaagcgcgaaaagaaauuaggcgaguucgggagagccaagggaucucgggcuauuugguauauguggcugggugcgagguuuuuggaguucgaggcccucggcuuucugaacgaagaccauugguucucacgugagaacaguugguccggggucgagggagaaggccuacaccgacuugguuacauccuggaggauauugacaaaaaggauggggaccucaucuaugcagaugacaccgcuggaugggauacacgcauaacugaagacgaucuguugaaugaggagcugaucaccgaacagauggcaccccaucacaaaacgcucgcaaaggccauuuuuaaacuuacauaccaaaacaaaguugugaagguacugagaccaaccccuaaaggcgcugugauggacaucauuagccggaaggaccagaggggcucugggcaggucggaacuuacgguuuaaauacauucaccaacauggaggugcagcugauccgccaaauggaagccgagggcguuauaacucaggaugacaugcagaaucccaaaggguugaaggaaagaguggagaaauggcucaaggaguguggagucgaucggcugaagaggauggcgauuucgggcgacgauugcgugguaaaaccacuagacgaacgauuuucaaccagccuucuguuccucaacgauauggguaagguucguaaagacaucccccagugggagccuuccaagggguggaaaaauuggcaagaagugccauuuuguagucaucacuuccacaagaucuuuaugaaggauggaagaucucuggucgugccgugccgcaaccccgacgaguugauuggccgggcaaggauaagccagggcgccgggugguccuuaagagaaacagcuugucugggaaaagccuaugcacagauguggucacucauguacuuccaucgccgggaucuuaggcuggcuaguauggccaucugcucugcuguuccuacggagugguucccaaccagccgaacuacaugguccauucacgcccaucaccaguggaugaccacugaggacaugcuaaagguguggaauagagucuggaucgaagacaaccccaauaugacagauaaaaccccugugcacucaugggaggacauuccauaucuggguaagcgggaagaucucugguguggcagcuugaucgggcugucuuccagggcaacgugggcgaaaaacauacauacagccaucacccaaguacgcaaucuuauuggaaaggaggaauacguggacuauaugcccgcuaugaagcguuacagugccccuuuugagagcgagggcguccuguga

SEQ ID NO: 15758 - RNA, 9867 nt, Artificial Sequence
  derived and/or modified CDS sequence (opt3) from DENV-4__KC762697__SS-prME
agcaccaugacccugcucugccuuauccccacugccauggcuuuccaccuguccacgcgggacggcgagccuuugaugauuguggcaaagcaugaaagggggcggccauuacuguuuaaaaccacagagggaauaaacaaguguacucuaaucgccauggaucucggugaaaugugcgaggacaccgucacauacaaauguccgcugcuuguuaauaccgaacccgaggauauugacugcugguguaaccugacuucuacaugggugauguauggaaccugcacgcagucaggggagcgccgacgugaaaagagaaguguagcguugacuccucacagcggaaugggccucgagaccagggcugaaacauggauguccucugagggugccuggaaacaugcacaacggguggagucguggauccugcgcaauccaggguucgcccugcucgcuggauuuauggcauacaugauuggccagacuggcauccagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguauagaagccaguaucuccaauauuacaaccgcuacgcgaugcccaacccaaggagagcccuaucuuaaggaggaacaggaccagcaguacaucuguagaagggauguggucgaccggggcuggggcaacgggugcggacuguucgguaaaggcgggguugugacaugcgccaaguuuuuguguucuggaaaaauuacuggcaaucucguacaaaucgagaaccuggaauauaccguggucgugacaguucauaauggugauacucacgcaguggggaacgacaccagcaaucacggcgucacagcuaccauaacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgccggggcggacacuagcgaagugcacuggaauuacaaagagagaauggucaccuucaaggugccccaugccaaaaggcaggaugucacagugcucggaucucaggaaggugcaaugcacuccgcucuggccggcgcuaccgagguugacucaggggauggaaaccacauguuugccggccaucuuaaguguaaggugcggauggaaaaacugcgaauuaaggguaugagcuauacuaugugcagugggaaauucucuaucgacaaggagauggcagagacacaacacggcacgaccguagucaaagugaaguacgaaggagccggcgcuccuuguaagguuccaaucgagauucgcgaugugaauaaagaaaaggucguggggagaauaaucuccagcacucccuucgcggagaacacaaacucgguaaccaauauugaguuggaaccgccuuuuggagacucuuauaucgugauagguguuggcgauuccgcacucacacugcauugguucaggaaagggucaaguauuggaaagauguuugagagcacuuaccggggcgccaaacgcauggcuaucuuaggugaaaccgccugggacuucggguccgucggcggacuguuuacgucucuaggcaaggcagugcaccagguguucgggagcgucuauaccacaauguuuggaggcguuucauggaugaucaggauucucaucggucugcuuguguuguggauugggacuaacaguaggaauaccuccauggccaugacaugcauagcugugggaggcaucacucuguuccucgguuuuaccguacaggccgauaugggcugugucgugagcuggaacgggaaggagcugaaaugcggaucuggcauuuucguuguggacaauguccauacguggacagaacaauacaaguuucagcccgagucaccagcacgucuugcgagugcuauccugaacgcccacaaagacgggguguguggaauccggagcaccacucgauuggagaauguuauguggaagcagauuacaaacgaacucaauuaugugcugugggagggcggucacgauuuaaccguagucgcaggggacgugaaaggagugcugacuaagggcaagagaguccuaaccccucccguuaacgaucucaaauacuccuggaagacaugggguaaagccaagauauucacgccagaagcuagaaauucuaccuuucugaucgacggccccgauacuucggagugcccuaacgaacgccgggccuggaauuucuucgagguggaggacuacggguuuggaauguucagcacaaacauuuggaugaaauuuagagaaggcuccucagagguaugugaucauaggcuuaugagugcagcuaucaaggaccagaaagccgugcacgcggauaugggguauuggauugaaucuagcaagaaucaaaccuggcagaucgagaaggccuccuugauagaagucaaaacaugccuguggccaaagacucauacccucuggucaaacggagugcuggagagccagauguuaaucccgcgcucuuacgcuggccccuucucccagcacaacuaucgacaagguuacgcaacgcagauugccgggccuuggcaccugggaaaacuugagaucgacuuuggcgaaugcccagguacaaccguuacuauucaggaggauugugaccaucggggccccaguuugcguaccacaacugcuagcgggaagcucgugacccaguggugcuguagaucuugcacaaugccuccacugagguuccuaggagaagauggcuguugguaugggauggagauccgcccccuguccgagaaagaagagaauauggucaagucacaagugacggccggacagggcaccagugaaacuuuuagcaugggucuccugugccuuacauuguucguugaggaaugucugcggagaagggugacccgaaagcacaugauauuagucguagcaauuacuuuuugcgcgaucauucucgggggacugacauggauggaccuucugcgcgccuugaucaugcucggcgacaccaugucgggccggauagggggacagauccaucuggcuauuauggccguguucaaaauguccccggguuacguucuaggcguguuucugagaaagcucacgucuagggagacugcacugauggucaucgggauggcuaugaccacaguguucagcauuccucacgaucuuauggaguugaucgacggaauaucacugggcuuaauucuccugaaaaucguaacccauuuugaugacacucagguggguacacuugcccugagucuaaccuucauccguuccacaacuccacucgucauggcauggcgcaccauuauggccguuuucuuuauggugacgcugauccccuugugucggacaucuugccugcaaaagcagagccacuggguggaaauuaccgcuuuaauacucggggcgcaggcccugccugucuaucuuaugacucugaugaaaggagcauccagaaggucauggcccuugaacgagggcaucauggcugugggccucguuagccugcuagggagugcccugcuuaagaaugauguaccacucgccggaccuaugguggcugguggccuguugcuggcagccuacgucaugucuggguccagcgcggacuuaucgcucgaaaaggcugccaacgugcaaugggaugagauggcagacauuaccggaucaucucccaucauugaaguuaaacaggaugaggacggcaguuucuccauccgagauguggaggaaacaaauaugauaacucugcuugucaagcuggccuugaucaccgugagcggucucuacccacuggcuauuccgguaacgauggcacuaugguauaucuggcaggucaaaacacagcggucuggggcccugugggacgugccuagccccgcggcuacccaaaaggccacucuuuccgagggaguuuaccgcauuaugcagagaggccucuuuggcaaaacacaggugggggucggaauccacauggaagguguguuccauaccauguggcacguuacuaggggcucagugauaugucaugagacagggcggcuggaaccaaguugggcagauguccgaaacgacaugauuagcuauggaggcgguuggagauugggggacaagugggauaaggaggaggacgugcagguauuagccaucgaacccggcaagaauccuaagcacgugcaaaccaaaccaggccuguuuaagacgcucacuggcgagaucggggcuguuacccuggauuucaaacccggaacaucugguuccccuauuauaaacaagaaaggcaaggucaucgggcuuuacggaaauggcguggugaccaagucaggugacuaugucagugccauuacacaggcagaacgcaucggggagccggauuacgagguagacgaagauauuuuuaggaaaaagcgucugacuaucauggacuugcauccaggagcuggcaaaaccaagcggauacuacccagcaucgugagagaggcccugaaaaggcgccuccgaacgcugauucuugcgccuacaagaguuguggccgcagaaauggaggaggcuuuacggggccugccaaucagguaucagacucccgccgucaaggcugagcacaccgggcgcgagauuguggaucucaugugccacgcaacauucaccacucguuugcuguccucuaccagaguuccuaacuacaaucucaucgugauggacgaagcccauuuuacagauccgugcucggucgccgcucggggauacauaagcacgaggguggagaugggugaagcggcagccauuuucaugacugcuacacccccaggcucaacagacccuuuuccccaguccaacaguccaaucgaggacaucgaacgcgagauuccugagcgaucuuggaauaccggguucgauuggaucacugacuaucaaggaaagacaguaugguucgugcccagcauaaaagccggcaacgauauugcaaauugucugagaaaguccgguaaacggguuauccagcuuucaaggaagaccuuugacacggaauacccaaaaacuaagcugacagauugggacuucgucgugaccaccgauauuucugagaugggggccaacuuucgcgcuggcagagugaucgacccgaggcggugcuugaagccugucauacuaacugauggacccgaacguguuauucuggcgggcccaauccccgugaccccugccagcgcagcucagcgccgagggagaaucggaaggaacccagcccaagaggacgaucaguauguauucaguggugacccccucaaaaaugaugaagaccacgcacauuggacagaggccaagauguuacuggacaacauuuacacaccugagggcaucauuccgacucuuuuugggccagaacgggagaaaacgcaggcuauagauggagaguuccgccugagaggcgagcagaggaagaccuuuguggagcucaugcggcgaggugacuugcccgucuggcuguccuauaaaguggccagcgcggggaucucuuacaaggauagagaaugguguuucacaggcgagcgcaauaaccaaauucucgaagagaauauggaaguugagaucuggacuagggagggagaaaagaaaaagcugcggccuaaauggcuugacgcacguguguaugccgaucccauggcucuaaaggacuuuaaagaguucgccucaggcagaaaguccaucacccuggauauuuugacagaaauagcuaccuuaccaacuuaccugaguagcaaggcaaaacucgcccuggacaacaucgucaugcuucacacgaccgagaaaggugggagggcuuaccagcacgcccugaaugaacucccugagucguuggagacacugaugcuaguagcacugcucggggcgaugacugccggcauuuuucuuuucuuuaugcaggggaaaggaaucggcaagcugucuauggguuuaauugcuaucgccguggcauccggguugcuguggguugcugaaauacagccccaauggaucgccgcaagcauuauccucgaguucuuccugauggugcuucugauuccagaaccugagaaacagcgcaccccgcaggauaaccagcucaucuaugucauauugacaauucugaccaucauuggcuuaaucgccgcuaaugaaaugggacuaauagagaagacuaaaacagacuuuggcuucuaccaagcgaagacggagaccacuauccuggauguggaccuccggcccgccucagcauggacacuuuaugcugucgccaccaccauucugacaccaauguugcgacauacuaucgaaaacacgagugccaaucugucucucgcagcuauugccaaccaggcggcugugcugauggggcuuggaaagggcuggccucuccacagaauggaucuggguguucccuugcuggccauggggugcuacucccaggugaauccaaccacauuaacugcaagccuaguaaugcugcucgugcauuaugccaucauaggaccuggccuucaggcuaaagcaaccagggaggcccaaaagcgcacagcggcugguauuaugaaaaaccccaccgucgacggcaucacuguuaucgaccuggaaccgauuucauacgauccaaaguuugagaaacaguugggacaggugaugcugcucguccugugugugggacaacuuuuacugaugcggacgacaugggcccucugcgagguauugacccuggcaacuggcccuaucaugacccuaugggaagggaaucccggaagauucuggaacacaacuauagccgugaguaccgcuaacauuuuucguggcagcuaucuggccggugcagggcucgcuuucucccuuaucaagaaugcccagacaccaaggcggggaacgggcaccacuggugagacacugggcgaaaaguggaaacgccaguugaacucucuggaccgaaaggaguuugaagaguacaaaagaagcgggauucucgagguugauaggaccgaagcgaaguccgcccugcgggacggaucaaaaaucaaguacgcagugucucgcggcaguucgaagauaagauggaucgucgagagggggauggugaaacccaagggaaaagucguggauuuaggcuguggucgagggggauggagcuauuacauggcuacucuuaagaauguuacagaaguaaaaggcuauaccaagggcgggccuggacacgaggaaccgauucccauggccacguacgguuggaaccuggugaagcuccauuccggcgucgacguguucuauaaaccaaccgagcagguugauacacuacugugcgacaucggggagucuucaagcaauccuacuauugaagagggacggaccuugcgugugcugaagauggucgaacccuggcucuccaguaaaccugaguuuuguaucaaggugcuuaacccauacaugcccacaguaauugaagaacuggagaaauugcaaagacgccacggcgguucucuggugaggugcccucucagcagaaauucaacucacgaaauguauuggguuuccggggcaaguggaaacaucgucagcucugugaauaccauauccaagauguuacugaacagauucacaacccgccauaggaaaccaacuuacgagaaggauguggaccuuggcgcuggcacgcgaucagucagcacagaaaccgagaagcccgauaugacuauuaucgggcggagacugcagaggcuacgcgaggaacacaaagagaccuggcauuacgaccaggaaaauccguaucguacaugggccuaccacggaucguaugaggccccuucuacggguagugcguccagcaugguuaacggcgugguaaagcuccugaccaaaccaugggacgugauccccauggucacucaguuggcuaugacagauaccacuccuuuugggcaacagcggguguucaaggaaaaaguugacacaagaaccccacagcccaagccgggaacaaggaugauuaugacuaccacggcaaauuggcugugggcccuccuuggcaagaaaaagucaccucgccuguguacccgagaggaguuuauauccaaagugcggucuaacgcugccaucggugcagucuuccaggaagaacaaggguggacaagcgccagugaagcugugaaugauuccagauucugggaguuaguagacaaggaaagggcgcugcaccaggagggaaaaugcgagagcugcguuuacaacaugaugggcaagcgcgaaaagaaauugggcgaguuugggagagccaagggaucucgggcaauuugguauauguggcucggugcuagguuccuggaauuugaggcccuaggcuuccuuaaugaagaucauugguuuucacgugagaacaguugguccgggguggagggagaaggccugcaccgacucgguuacauccuggaggacauugauaaaaaggacggggauuugaucuaugcagacgauacugccggaugggacacccgcauaacagaagaugaccugcucaacgaggagcuuaucacugaacagauggcuccccaucacaaaacccuggccaaggcgauuuucaaguuaacguaccaaaauaaagucgugaaggugcugagaccaacaccuaaaggcgcagucauggacaucauuagccggaaggaucagaggggcucugggcagguuggaaccuacgguuugaacacuuuuacaaauauggaggugcagcucauccgccaaauggaagccgagggcguaauaacccaggacgauaugcagaaccccaaagggcuggaagagagaguggagaaguggcuaaaagaauguggagucgaccggcuuaagaggauggcuauuucgggcgaugacugcgugguuaagccacuggaugagcgauucucaacuagccuccuguuuuugaaugacauggguaaagugcguaaggauaucccccagugggaaccuuccaaaggguggaagaacuggcaagaggucccauucuguagucaucacuuucacaaaaucuucaugaaggacggaagaucuuuagugguaccgugccgcaaucaggaugaacugauuggccgggccaggauaagccagggcgcaggguggucccucagagagaccgcuugucuuggaaaggccuaugcucagauguggucacugauguacuuucaucgccgggaccuaaggcuggccaguauggcaaucugcucugcgguucccacagagugguucccuacgagccgaaccacuugguccauucacgcccaucaccaauggaugacaaccgaagacaugcucaaaguguggaacagagucuggaucgaggauaauccaaacaugacugacaagacacccauucacucaugggaagauaucccuuauuuggguaaacgggaggaccugugguguggcagccuuauagggcugucuuccagggcuaccugggccaagaauauccauacggcaauuacacaggugcgcaaccucaucggaaaagaagaguacguugauuauaugccagugaugaagcguuacagugcucccagcgagucggaaggcgucuuauga

SEQ ID NO: 15759 - RNA, 9867 nt, Artificial Sequence
  derived and/or modified CDS sequence (opt3) from DENV-4__KC762698__SS-prME
agcaccaugacccugcucugccuuauccccacugugauggccuuccaccuguccacgagggacggcgaaccuuugaugauugucgcuaagcaugaaagggggcggccauuacuguuuaaaaccacagagggaauaaacaaguguacucugaucgcuauggaucucggugaaaugugcgaggacaccguuacauacaaauguccgcugcuugugaauaccgaacccgaggauauugugugcugguguaaccugacuucuacaugggugauguauggaaccugcacgcagucaggggagcgccgacgugaaaagagaagugucgccuugacuccucacagcggaaugggccucgagaccagggcggaaacauggauguccucugagggugcuuggaaacaugcccaacggguggagucguggauccugcgcaauccaggguucgcacugcucgccggauuuauggcuuacaugauuggccagacuggcauccagagaaccguuuucuuuguguuaaugaugcuggucgcacccucauaugggaugaggugugugggaguagguaaccgggacuucguugaaggcgugagcgggggagccugggucgaucuuguguuggagcacggcgguugcgugacaaccauggcucaggggaagccuacgcuggacuuugaacuaacuaagacaaccgccaaagaggucgcgcuccugcgcacuuacuguauagaagcaaguaucuccaauauuacaaccgccacgcgaugcccaacccaaggagagcccuaucuuaaggaggaacaggaucagcaguacaucuguagaagggacguuguggaucggggcuggggcaacgggugcggacuguucgguaaaggcgggguagugacaugcgcuaaguuuuuguguucuggaaaaauuacuggcaaucucguccaaaucgagaaccuggaauauaccgugguugugacaguccauaauggugacacucacgccguggggaacgauaccagcaaucacggcguaacagcaaccauaacuccucguuccccaucaguugaggugaaguuaccggacuacggagaacugacgcucgauugcgagccccgcaguggcauugacuucaacgagaugauccuuaugaagaugaaaaagaaaacauggcugguccauaagcagugguuuuuggaccuaccucugccauggaccgcuggggccgauacuagcgaagugcacuggaauuacaaagagagaauggucaccuucaaggugccccaugcgaaaaggcaggacguuacagugcucggaucucaggaaggugccaugcacuccgcacuggcuggcgccaccgagguagauucaggggacggaaaccacauguuugcuggccaucuuaaguguaagguccggauggaaaaacugcgaauuaaggguaugagcuauacuaugugcagugggaaauucucuaucgauaaggagauggccgagacacaacacggcacgaccgugguuaaagugaaguacgaaggagcaggcgccccuuguaaggucccaaucgagauucgcgacgugaauaaagaaaagguaguggggagaauaaucuccagcacucccuucgcugagaacacaaacucgguuaccaauauugaguuggaaccgccuuuuggagauucuuauaucgucauaggugcgggcgacuccgcacucacacugcauugguucaggaaagggucaaguauuggaaagauguuugagagcacuuaccggggcgccaaacgcauggcuaucuuaggugaaaccgccugggauuucggguccgugggcggacuguuuacgucucuaggcaaggcagugcaccaggucuucgggagcguuuauaccacaauguuuggaggcgugucauggaugaucaggauucucaucgguuuccuggugcuuuggauugggacuaacaguaggaauaccuccauggccaugacaugcauagcuguaggaggcaucacuuuguuucuggguuucaccguccaggccgacaugggcugugugguuagcuggaacgggaaggagcucaaaugcggaucuggcauuuuuguggucgauaaugugcauacguggacagaacaauacaaguuccagcccgagucaccagcacgucuggcgagugcuauccuuaacgcccacaaagacgggguuuguggaauccggagcaccacucgacuggagaaugugauguggaagcagauuacaaacgaauugaauuauguacucugggagggcggucacgaccugaccgucguggcaggggaugugaaaggagucuuaacuaagggcaagagagcccugaccccucccguuaacgaccuaaaauacuccuggaagacaugggguaaagcuaagauauuuacgccagaagccagaaauucuaccuuccucaucgauggccccgacacuucggagugcccuaacgaacgccgggcauggaauuucuuugagguggaggauuacggguucggaauguuuacaaccaacauuuggaugaaauucagagaaggcagcuccgagguaugugaccauaggcugaugucagcugccaucaaggaucagaaagcggugcacgccgacaugggguauuggauugaaaguucuaagaaucaaacauggcagaucgagaaggcuagccuuauagaagucaaaacuugcuuguggccaaagacccauacgcugugguccaacggagugcucgagucacagaugcugaucccgcgcagcuacgcaggccccuuuucucagcacaacuaucgacaagguuacgccacacagaccgcugggccuuggcacuuaggaaaacuggagauugauuucggcgaaugcccagguacuaccguuacaauccaggaggacugugaucaucggggccccucccuucguacuaccacagccagugggaaguuggugacgcaguggugcuguagaagcugcaccaugccuccacucagguuucugggagaagacggcuguugguaugggauggagauucgcccccuaucugagaaagaagagaauauggucaagucccaagugacugcaggacagggcacaucagaaaccuucaguaugggucugcucugccugacucuuuuuguugaggaauguuugcggagaagggugacacgaaagcacaugauccuggucguagugauaaccuucugcgcgauuaucuuagggggacucacguggauggaucugcuucgcgcccugauuauguugggcgacacuaugagcggccggaucgggggacagauacaucucgcuaucauggccguuuuuaaaaugucgccggguuacgugcugggcgucuuccuaagaaagcugaccuccagggagacagcacucauggugauugggauggcuaugaccacuguauuuucuaucccucacgaccugauggagcuuauugauggaaucagcuugggccugauauuacucaaaauugugacacauuucgacaacacccaggucgguacacuggcccuuucacugacuuucauccguaguaccacgcccuuaguuauggcauggcgcacaaucauggccguguuuuucguggucacccucauuccccugugucggacuuccugcuugcaaaagcagucucacuggguggaaaucaccgcucugauuuuaggggcgcaggcccucccuguuuaucugaugacacuuaugaaaggagcaagcagaagguccuggccccugaaugagggcauaauggcuguaggcuuggugucacuccuggggagcgcccuacugaagaacgaugucccacuugccggaccuaugguggcugguggccuccuguuggcagccuacguuaugagugggucuuccgcggaccugagcuuagaaaaggcugccaaugugcaaugggaugagauggcagacaucacuggaucgucacccauuaucgaagucaaacaggaugaggacggcucuuuuaguauucgagauguggaggaaaccaacaugaucacgcuccugguaaaacuugcccugauaacagucuccgguuuguacccacucgcuaucccggugaccauggcacugugguauguuuggcaagugaaaacucagcggagcggggcccuaugggacgucccuucucccgcggcuacacaaaaggccacccugagcgagggaguguaccgcauuaugcagagaggccuuuucggcaaaacucagguuggggugggaauccacauggaaggugucuuucauacaauguggcacgugaccaggggcuccguaauuugucaugagacggggcggcucgaaccaucaugggcagaugugcgaaaugacaugaucaguuauggaggcgguuggagacugggggauaagugggacaaggaggaggacguucaggucuuggccauagaacccggcaagaacccuaagcacgugcaaacuaaaccaggcuuauucaagacccugacaggcgagauuggggcugugacccucgauuuuaaacccggaacaagcgguucuccuaucaucaauaagaaaggcaaggucauugggcuguacggaaacggcguagugacuaaguccggugacuauguuucagccauaacccaggcagaacgcaucggggagccggauuacgagguggacgaagauauuuucaggaaaaagcgucuuacgaucauggaccugcauccaggagcuggcaaaacaaagcggauuuugcccaguaucgucagagaggcccuaaaaaggcgccugcgaacucucauacuggcgccuaccagagugguugccgcagaaauggaggaagcacuucggggcuuaccaaucagguaucagacacccgccguaaagagcgagcacaccgggcgcgagauugucgaucugaugugccacgcuacuuuuaccacacgucucuuguccucuacgagagugccuaauuacaaccugaucguaauggacgaagcacauuucacugauccgugcucgguggccgcccggggauacauuagcaccaggguugagaugggugaagcugcggcaaucuuuaugacagccacaccaccaggcucaauagacccuuucccccaguccaauaguccaauugaggauaucgaacgcgagaucccugagcgaucuuggaacacuggguucgacuggauuacagacuaucaaggaaagaccgucugguuugugcccagcaucaaagcuggcaaugauauagccaacugucucagaaaguccgguaaaaaggugauucagcugucacggaaaacguucgacacugaauacccaaagacaaaacuuaccgauugggacuuugucguuaccacugauaucucugagaugggggcaaacuucagggccggccgcgugauugacccgagaaggugccugaaaccuguaaucuugacagauggacccgaacgggugauacuagcuggcccaauucccgucaccccugcgagcgccgcacagcgucgcgggcgaaucggaagaaauccagcucaagaggacgaucaguauguguuuaguggugacccccugaagaacgaugaagaccacgcccauuggacagaggcaaaaaugcucuuagauaauaucuacacuccugagggcauuaucccgacgcuguucgggccagaaagggagaagacccaggccauugacggagaauuucggcuucgcggcgagcagagaaaaacauucguugagcugaugaggcggggugaccuccccgugugguuguccuauaaggucgcuagcgccgggauaucuuacaaggaucgagaaugguguuuuacuggcgagagaaacaaucaaauccuggaagagaacauggaaguagagauuuggacccgcgagggagagaagaagaaacucaggccuaaguggcuggacgcgcggguguaugcagaucccauggcccuuaaagacuucaaggaguuugcuucaggccguaaguccaucacacuagauauccugaccgaaauugccacuuugccaacguacuuaaguagcaaagcuaagcuggcacucgacaauauaguuaugcugcacaccacagagaaaggugggagggccuaccagcacgcucuuaacgaacugccugagucgcucgagacuuugaugcugguggcccuacugggggcaaugaccgcgggcaucuuccucuuuuucaugcaggggaagggaauuggcaaacuuucuaugggucugaucgccauugcugucgccuccggguuauuguggguggcagaaauccagccccaauggauagcugccagcaucauucuggaguucuuucucaugguccugcuuaucccagaaccugagaagcagaggacaccgcaggauaaucagcugauuuaugugauccucaccauauugacuauuaucggccugauugcagccaacgaaaugggauuaaucgagaaaacaaagacggacuucggcuuuuaccaaguuaagaccgagaauacuauacuagauguggaccugcgccccgcuucagcguggacacucuaugccguagcaaccaccauccuuacaccaaugcugcggcauacuauugaaaacacgagugcuaauuugucucuggccgccaucgcaaaccaggcugccgugcucauggggcugggaaaaggcuggccucuucaccgaauggaucucggugucccccuguuggcgauggggugcuacucccagguuaauccaaccacacugacugcuagcuuagugaugcuacugguccauuaugccauuaucggaccuggccuccaggcaaaggccaccagagaggcucagaaaaggacagcagccgguauaaugaagaaccccaccguggacggcauuacuguaaucgaucuugaaccgaucucauacgacccaaaauucgagaagcagcugggacaggugauguugcugguucucugugugggacaacugcuuuuaaugcgcacgacaugggcgcugugcgagguccucaccuuggcuacuggcccugugaugacccugugggaagggaaccccggacgguuuuggaauacaacuauugccgucaguaccgcaaacaucuucagaggcagcuaucuagccggugcugggcuggccuuuucccucauaaagaaugcacagacaccacguaggggaacgggcaccacuggugagacacuuggcgaaaaauggaagcggcagcugaacucuuuggaccgcaaagaguucgaagaguacaagcgaagcgggauucuggagguggauagaaccgaagcuaaauccgcccucagggacggaucaaagaucaaguacgcgguuucucggggcaguucgaaaauucgcuggaucguagagagagggaugauaaagcccaaaggaaagguggucgaucugggcugugguagaggcggguggagcuauuacauggccacucuuaaaaaugugacagaaguuaagggguauaccaagggcgggccuggacacgaggaaccgauccccauggcaacguacgguuggaaccuagugaaacugcauuccggcgucgacguguuuuauaagccaaccgagcagguagauacacuccuaugcgacauuggggagucuucaagcaauccuacuaucgaagagggacgaacccugcggguguugaaaaugguugaacccuggcuguccaguaagccugaguucuguauuaaaguccucaacccauacaugcccacagugaucgaagaacuugagaagcugcaacguagacacggcgguucuuuggugcgcugcccucugagcagaaauucaacucacgaaauguauugggucuccggggcuaguggaaacauuguuagcucugugaauaccaucuccaaaaugcucuuaaaccgguuuacaaccagacaucgcaagccaacuuacgagaaggauguagaccugggcgccggcacgaggucagugagcacagaaauagagaaacccgauaugaccauuaucgggcgacggcuucagagacugagggaggaacacaaggagacuuggcauuacgaccacgaaaauccguaucgcaccugggcauaccacggaucguaugaggcuccuucuacagguagugccuccagcauggucaacggcaucgugaaacuacucacgaagccaugggauguuauucccauggugacccagcuggccaugacugacacaaccccuuucgggcagcaacgugucuuuaaagaaaagguggacacucggacaccacagcccaagccgggaaccagaaugauaaugacaacuaccgcgaauugguugugggcucugcucggcaaaaagaaaucaccuaggcuuuguacgcgcgaggaguucaucuccaagguacgaucuaacgcagccauuggugcuguuuuccaggaagaacagggguggaccagcgccagugaagcagugaaugauucccgguuuugggagcuggucgacaaagaaagagccuuacaucaagagggaaagugcgagagcugcguguacaacaugaugggcaagagggagaaaaagcugggcgaguucgggcgcgcuaaaggaucuagagcgaucugguauaugugguugggugcccgguuucucgaguucgaggcacugggcuuucuaaacgaagaucacugguucucaagggagaauaguugguccgggguggagggagaaggccuucaucgucuggguuacauucucgaggacaucgauaagaaagacggggaucugauauaugcugacgauacagccggaugggacacucgaaucaccgaagaugacuugcugaacgaggagcucauuacagaacagauggcaccccaccauaagacucuugccaaggcuaucuuuaaacugaccuaccagaauaaggucguuaaaguguuacgcccaacgccuaagggcgccguaauggauauuaucagcagaaaagaccaacggggcucuggacaggugggaacauacggucugaacaccuucacuaauauggagguccaguugauaaggcagauggaagcggagggcgugauuacacaagacgauaugcagaaccccaaggggcucaaagaacgcguugagaaguggcugaaggaguguggaguggacagacuagaacggauggcaaucucgggcgaugacugcgucgugaaaccacuugaugagagguuuucaaccagccuacucuuccugaaugacauggguaagguacgaaaagauaucccccagugggaaccuuccaagggguggaaaaacuggcaggagguuccauuuuguagucaccacuuccauaagauuuuuaugaaggacggacguucuuugguggucccgugcagaaaucaagaugaauuaauaggccgcgcccggaucagccagggcgcuggguggucccugagggagacugccugucucggaaaagcauaugcucagauguggcuucugauguacuuccacagacgcgaccuacggcuggccucaauggcuauuugcagugccgugcccaccgagugguucccuacaucuaggacgaccuggagcauccaugcacaccaccaguggaugacuacagaagauaugcucaagguuuggaaccgaguguggauugaggacaauccaaacaugaccgacaaaacucccguccauuccugggaagauaucccuuauuuggguaagagagaggaccugugguguggcucacuuauagggcugagcucucgggcgacaugggccaaaaauauccacaccgcuauuacgcaagugaggaaccucaucggaaaggaagaguacguagauuauaugccagccaugaagcgcuacuccgcacccuuugagagugaaggcguguuauga

SEQ ID NO: 15760 - RNA, 9867 nt, Artificial Sequence
  derived and/or modified CDS sequence (opt3) from DENV-4__KC762699__SS-prME
agcaccaugacccugcucugccuuauccccacugugauggccuuccaccuguccacgagagacggcgaaccuuugaugauugucgcuaagcaugaaagggggcggccauuacuguuuaagaccacagaaggaauaaacaaguguacucuaaucgcaauggaucucggugaaaugugcgaagacaccguuacauacaaguguccgcugcuugugaauaccgaacccgaggauauugacugcugguguaaccugacuucuacaugggugauguauggaaccugcacgcagucaggggagcgccgacgugaaaagagaaguguggccuugacuccucacagcggaaugggccucgagaccagggcggaaacauggauguccucugagggugcuuggaaacaugcccagcgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaaggugccaaucgagauucgcgaugucaauaaagaaaaggugguagggagaauaaucuccagcacucccuucgcugagaacacaaacucggugaccaauauugaguuggaaccgccuuuuggagacucuuauaucguuauaggugucggcgauuccgcgcucacacugcauugguucaggaaagggucaaguauuggaaagauguuugagagcacuuaccggggcgcaaaacgcauggccaucuuaggugaaaccgcuugggacuucggguccgugggcggacuguuuacgucucuaggcaaggccgugcaccaggucuucgggagcguuuauaccacaauguuuggaggcgugucauggaugaucaggauucucaucgguuuccuggugcuuuggauugggacuaacaguaggaauaccuccauggcaaugacaugcauagccguaggaggcaucacuuuguuucuggguuucaccguccaggcugauaugggcugugugguuagcuggaacgggaaggagcucaaaugcggaucuggcauuuuuguggucgacaaugugcauacguggacagaacaauacaaguuccagcccgagucaccagcccgucuggcaagugcgauccuuaacgcucacaaagacgggguuuguggaauccggagcaccacucgacuggagaaugugauguggaagcagauuacaaacgaauugaauuauguacucugggagggcggucacgaucugaccgucguggccggggacgugaaaggagucuuaacuaagggcaagagagcacugaccccucccguuaacgaucuaaaauacuccuggaagacaugggguaaagccaagauauuuacgccagaagcuagaaauucuaccuuccucaucgacggccccgauacuucggagugcccuaacgaacgccgggccuggaauuucuuugagguggaggacuacggguucggaauguuuacaaccaacauuuggaugaaauucagagaaggcagcuccgagguaugugaucauaggcugaugucagcagcuaucaaggaccagaaagccgugcacgcggauaugggguauuggauugaaaguucuaagaaucaaacauggcagaucgagaaggccagccuuauagaagucaaaacuugcuuguggccaaagacccauacgcugugguccaacggagugcucgagucacagaugcugaucccgcgcagcuacgcuggccccuuuucucagcacaacuaucgacaagguuacgcaacacagaccgccgggccuuggcacuuaggaaaacuggagauugacuucggcgaaugcccagguacuaccguuacaauccaggaggauugugaccaucggggccccucccuucguacuaccacagcuagugggaaguuggugacgcaguggugcuguagaagcugcaccaugccuccacucagguuucugggagaagauggcuguugguaugggauggagauucgcccccuaucugagaaagaagagaauauggucaagucccaagugacugccggacagggcacaucagaaaccuucaguaugggucugcucugccugacucuuuuuguugaggaauguuugcggagaagggugacacgaaagcacaugauccuggucguagugauaaccuucugcgcaauuaucuuagggggacucacguggauggaccugcuucgcgcgcugauuauguugggcgacacuaugagcggccggaucgggggacagauacaucucgccaucauggcuguuuuuaaaaugucgccggguuacgugcugggcgucuuccuaagaaagcugaccuccagggagacagcccucauggugauugggauggcaaugaccacuguauuuucuaucccucacgagcugauggaacuuauugauggaaucagcuugggccugauauuacucaaaauugugacacauuucgacaacacccaggucgguacacuggcucuuucacugacuuucauccguaguaccacgccccugguuauggccuggcgcacaaucauggcaguguuuuucguggucacccucauuccccugugucggacuuccugcuugcaaaagcagucucacuggguggagaucaccgcccugauuuuaggggcucaggcgcucccuguuuaucugaugacacuuaugaaaggagccagcagaagguccuggccccugaaugaaggcauaauggcaguaggcuuggugucacuccuggggagcgcucuacugaagaacgaugucccacuugccggaccuaugguggccgguggccuccuguuggcugcauacguuaugagugggucuuccgccgaccugagcuuagagaaggcggcuaaugugcaaugggaugaaauggccgacaucacuggaucgucacccauuaucgaggucaaacaggaugaggacggcucuuuuaguauucgagauguggaagagaccaacaugaucacgcuccugguaaaacuugcacugauaacagucuccgguuuguacccacucgccaucccggugaccauggcucugugguauguuuggcaagugaaaacucagcggagcggggcacuaugggacgucccuucucccgccgcgacacaaaaggcuacccugagcgaaggaguguaccgcauuaugcagagaggccuuuucggcaaaacucagguuggggugggaauccacauggagggugucuuucauacaauguggcacgugaccaggggcuccguaauuugucaugaaacggggcggcucgagccaucaugggccgaugugcgaaaugacaugaucaguuauggaggcgguuggagacugggggauaagugggacaaggaggaagacguucaggucuuggcaauagagcccggcaagaacccuaagcacgugcaaacuaaaccaggcuuauucaagacccugacaggcgaaauuggggccgugacccucgauuuuaaacccggaacaagcgguucuccuaucaucaauaagaaaggcaaggucauugggcuguacggaaacggcguagugacuaaguccggugacuauguuucagcuauaacccaggccgagcgcaucggggagccggauuacgaaguggacgaggauauuuucaggaaaaagcgucuuacgaucauggaccugcauccaggagcaggcaaaacaaagcggauuuugcccaguaucgucagagaagcucuaaaaaggcgccugcgaacucucauacuggccccuaccagagugguugcggccgagauggaagaggcacuucggggcuuaccaaucagguaucagacacccgcuguaaagagcgagcacaccgggcgcgaaauugucgaucugaugugccacgccacuuuuaccacacgucucuuguccucuacgagagugccuaauuacaaccugaucguaauggacgaggcucauuucacugauccgugcucgguggcagcccggggauacauuagcaccaggguugaaaugggugaggccgcugcgaucuuuaugacagcaacaccaccaggcucaauagacccuuucccccaguccaauaguccaauugaagauaucgagcgcgagaucccugaacgaucuuggaacacuggguucgacuggauuacagacuaucaaggaaagaccgucugguuugugcccagcaucaaagccggcaaugauauagcuaacugucucagaaaguccgguaaacgggugauucagcugucaaggaagacguucgacacugaguacccaaaaacaaaacuuaccgauugggacuuugucguuaccacugauaucucugaaaugggggccaacuuccgcgcaggcagagugauugacccgaggcggugccugaagccuguaaucuugacagauggacccgagcgugugauacuagccggcccaauucccgucaccccugcuagcgcggcccagcgccgagggagaaucggaaggaauccagcacaagaagacgaucaguauguguuuaguggugacccccugaaaaacgaugaggaccacgcucauuggacagaggccaagaugcucuuagauaauaucuacacuccugaaggcauuaucccgacgcuguucgggccagagcgggagaagacccaggcaauugacggagaguuucgccuuagaggcgagcagaggaagacauucguugaacugaugcggcgaggugaccuccccgugugguuguccuauaaagucgccagcgcugggauaucuuacaaggauagagagugguguuuuacuggcgaacgcaacaaucaaauccuggaggaaaacauggagguagagauuuggaccagggaaggagagaagaaaaagcuccggccuaaauggcuggacgcccguguguaugcggaucccauggcacuuaaggacuucaaagaauuugccucaggcagaaaguccaucacacuagauauccugaccgagauugcuacuuugccaacguacuuaaguagcaaggccaaacuggcucucgacaauauaguuaugcugcacaccacagaaaaaggugggagggcauaccagcacgcccuuaacgagcugccugagucgcucgaaacuuugaugcugguggcucuacugggggccaugaccgcaggcaucuuccucuuuuucaugcaggggaaaggaauuggcaaacuuucuaugggucugaucgcgauugccgucgcuuccggguuauuguggguggccgagauccagccccaauggauagcagcuagcaucauucuggaguucuuucucaugguccugcuuaucccagagccugaaaaacagcgcacaccgcaggauaaucagcugauuuaugugauccucaccauauugacuauuaucggccugauugccgcaaacgagaugggauuaaucgagaagacaaaaacggacuucggcuuuuaccaaguuaagaccgaaacuacaauacuagauguggaccugcggcccgccucagcuuggacccucuaugcgguagccaccacaauccuuacuccaaugcugcgacauacgauugagaauaccagugcaaacuugucucuggcugccaucgccaaucaggcagcugugcucauggggcugggaaagggcuggccucuucacagaauggaucucggugucccccuguuggccauggggugcuacucccagguuaacccaacaacucugaccgcgagcuuagugaugcuacugguccauuaugcuauuaucggaccuggccuccaggccaaagcaacaagggaagcccaaaagcgcaccgcugcagguauaaugaaaaaucccacuguggacggcauuacgguaaucgaucuugagccgaucucauacgacccaaaguucgagaaacagcugggacaggugauguugcugguucucugugugggacaacugcuuuuaaugcggacaaccugggcccugugcgaaguccucacuuuggcgaccggcccugugaugacacugugggaggggaaccccggaagauuuuggaacacuaccauugcugucaguacagccaauaucuuccguggcagcuaucuagccggugccgggcuggcuuuuucccucauaaagaacgcccagacgccaaggcggggaaccggcacuacaggugaaacccuuggcgagaaguggaaacgccagcugaacucuuuggaccgaaaggaguucgaagaguacaaaagaagcgggauucuggaaguggauaggacugaggcaaaguccgcucuccgggacggaucaaaaaucaaguacgccguuucucgcggcaguucgaagauuagauggaucguagaaagggggaugauaaaacccaagggaaaaguggucgaucugggcuguggucgagggggauggagcuauuacauggcgacauuaaagaaugugaccgagguuaaaggcuauacgaagggcgggccuggacacgaagaaccgauccccauggccaccuacgguuggaaucuugugaagcugcauuccggcgucgacguguuuuauaaaccaacagagcagguagauacucuccuaugcgacauuggggaaucuucaagcaacccuaccaucgaggaaggacggacacugcguguguugaagaugguugagcccuggcuguccaguaaaccugaguucuguauuaagguccucaauccauacaugcccacugugaucgaggagcuugaaaaacugcaaagacgccacggcgguucuuuggugaggugcccucugagccggaacucaacccacgagauguauugggucuccggggcaaguggaaauauuguuagcucugugaacacaaucuccaagaugcucuuaaauagauuuaccacucgccauaggaaaccaacguacgaaaaggauguagaccugggcgcuggcacacgaucagugagcaccgagacugagaagcccgauaugaccauaauugggcggagacuucagaggcugcgcgaagaacacaaagaaacauggcauuacgaccaggagaacccguaucguacgugggccuaccacggaucguaugaagcaccuucuaccgguagugcuuccagcauggucaauggcgugguuaagcuacucacuaaaccaugggaugugauccccauggucacacagcuggccaugaccgacacuacaccuuucgggcaacagcggguguuuaaggagaaaguagacaccagaacaccacagcccaagccgggaacuaggaugaucaugaccacgaccgccaacugguugugggcgcugcucggcaagaaaaagucaccucgccuuuguacacgagaggaguucauuuccaaaguucggucuaaugcugcaauaggugccguguuccaggaggaacaaggguggacuagcgcuagugaggccgucaacgauuccagauuuugggaacugguggacaaggagagggcauuacaccaggagggaaaaugcgaaagcugcguguacaauaugaugggcaagcgcgagaagaaacugggcgaguucgggagagccaagggaucucgggcuaucugguauaugugguugggugcgagguuucucgaguucgaagcccugggcuuucuaaacgaggaucauugguucucacgugagaacaguugguccggggucgaaggagagggccuucaccgacuggguuacauucucgaagacaucgauaaaaaggacggggaucugauuuaugcagacgauaccgcuggaugggacacacgcaucacugaggaugacuugcugaaugaggaacucauaaccgagcagauggcaccccaucacaaaacgcuugcaaaggccaucuuuaagcugacauaccaaaacaaaguugugaagguauuaagaccaaccccuaaaggcgcugugauggauauuaucagccggaaggaccagaggggcucugggcaggucggaacuuacggucugaauacauucaccaacauggaagugcaguugauucgccaaauggaggccgaaggcguuaucacucaggacgauaugcagaaucccaaagggcucaaggagagaguggagaaauggcugaaggaauguggagucgaccggcuaaagaggauggcgauaucgggcgaugacugcgugguaaaaccacuugaugagcgauuuucaaccagccuacucuuccugaacgacauggguaagguucguaaagauauuccccagugggaaccuuccaagggguggaaaaauuggcaagaggugccauuuuguagucaucacuuccacaagaucuuuaugaaggacggaagaucuuuggucgugccgugccgcaaccaggaugaauuaaucggccgggcaaggauuagccagggcgccggguggucccugagagagacagcuugucucggaaaagccuaugcacagauguggucacuuauguacuuccaucgccgggaccugaggcuagcuaguauggccauaugcucugcuguucccacggagugguucccuaccagccgaacuacaugguccauccacgcccaucaccaauggaugaccacugaagauaugcugaagguguggaauagagucuggauugaggacaacccaaauaugacagacaaaacccccgugcacucaugggaagauaucccuuaucucgguaagcgggaggacuugugguguggcagccugauugggcuuucuuccagggcaacgugggcgaaaaacauccauacagccauaacccagguacgcaaucugaucggaaaggaagaguacguggauuauaugccagcuaugaagcguuacagugcccccuuugagagcgaaggcguccucuga

SEQ ID NO: 15761 - RNA, 9867 nt, Artificial Sequence
  derived and/or modified CDS sequence (opt3) from DENV-4__JQ915085__SS-prME
agcaccaugacacugcucugccuuauacccacugugauggccuuccaccuguccacgagggacggagaaccuuugaugauugucgcuaagcaugaaagggggcggccauuacuguuuaaaaccacagagggaauaaacaaguguacucugaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaaggugccaaucgagauucgcgaugucaauaaagaaaaggugguagggagaauaaucuccagcacucccuucgcugagaacacaaacucggugaccaauauugaguuggaaccgccuuuuggagacucuuauaucguuauaggugucggcgauuccgcgcucacacugcauugguucaggaaagggucaaguauuggaaagauguuugagagcacuuaccggggcgcaaaacgcauggccaucuuaggugaaaccgcuugggacuucggguccgugggcggacuguuuacgucucuaggcaaggccgugcaccaggucuucgggagcguuuauaccacaauguuuggaggcgugucauggaucauuagaauccucauugguuuccuggugcuuuggauagggacuaacaguaggaauaccuccauggcaaugacaugcaucgccguaggaggcauuacuuuguuucuggguuucaccguccaggcugauaugggcugugugguuagcuggaacgggaaggagcucaaaugcggaucuggcaucuuuguggucgacaaugugcauacguggacagaacaauacaaguuccagcccgagucaccagcccgucuggcaagugcgauccuuaacgcucacaaagacgggguuuguggcauucggagcaccacucgacuggagaaugugauguggaagcagauaacaaacgaauugaauuauguacucugggagggcggucacgaucugaccgucguggccggggacgugaaaggagucuuaacuaagggcaagagagcacugaccccucccguuaacgaucuaaaauacuccuggaagacaugggguaaagccaagaucuuuacgccagaagcuagaaauucuaccuuccucauugacggccccgauacuucggagugcccuaacgaacgccgggccuggaauuucuuugagguggaggacuacggguucggaauguuuacaaccaacaucuggaugaaauucagagaaggcagcuccgagguaugugaucauaggcugaugucagcagcuauuaaggaccagaaagccgugcacgcggauaugggguauuggaucgaaaguucuaagaaucaaacauggcagauagagaaggccagccuuaucgaagucaaaacuugcuuguggccaaagacccauacgcugugguccaacggagugcucgagucacagaugcugauuccgcgcagcuacgcuggccccuuuucucagcacaacuaucgacaagguuacgcaacacagaccgccgggccuuggcacuuaggaaaacuggagaucgacuucggcgaaugcccagguacuaccguuacaauucaggaggauugugaccaucggggccccucccuucguacuaccacagcuagugggaaguuggugacgcaguggugcuguagaagcugcaccaugccuccacucagguuucugggagaagauggcuguugguaugggauggagauccgcccccuaucugagaaagaagagaauauggucaagucccaagugacugccggacagggcacaucagaaaccuucaguaugggucugcucugccugacucuuuuuguugaggaauguuugcggagaagggugacacgaaagcacaugauacuggucguagugauuaccuucugcgcaaucauuuuagggggacucacguggguugaccugcuucgcgcgcugaucauguugggcgacacuaugagcggccggauagggggacagauccaucucgccauuauggcuguguuuaaaaugucgccggguuacguccugggcguguuccuaagaaagcugaccuccagggagacagcccucaugguaaucgggauggcaaugaccacuguguuuucuauuccucgugaucugauggagcuuaucgacggaaucagcuugggccugauuuuacucaaaaucgucacacacuucgauaacacccagguugguacacuggcucuuucacugacuuucauccgcaguaccacgcccuuagugauggccuggcggacaauuaugguggucuuuuucgugguuacccucaucccccuguguagaacuuccugcuugcaaaagcagucucauuggguagaaauuaccgcacugauauuaggggcccaggcucucccuguguaucugaugacacuuaugaaaggagcgagcaggcgauccuggccccugaaugagggcaucauggccgucggcuuggugucacuccuggggagcgcacuacugaagaacgacguuccacuugcuggaccuaugguggccgguggccuccuguuggccgcuuacgucaugagugggucuuccgcagaucugagcuuagaaaaggccgcgaaugugcaaugggacgagauggcugauauuacuggaucgucacccaucauugaaguaaaacaggacgaggauggcucuuuuaguauccgggacgucgaggaaaccaacaugauaacgcuccuggugaaacuugcccugaucacaguuuccgguuuguacccacucgcaauuccggugaccauggcccugugguauaucuggcaggucaaaacucagcgcagcggggcucuaugggaugugccuucucccgcagccauucaaaaggcgacacugagcgagggaguuuacagaaucaugcagaggggccuuuucggcaaaacccaggugggggucggaauacacauggaagguguguuucacacuauguggcauguaacacggggcuccgugauuugucacgagaccgggcgacucgaaccaucaugggcugacguuagaaaugauaugaucaguuauggaggcgguuggcgccugggggacaagugggacaaggaggaggauguccagguguuggccaucgaacccggcaagaacccuaagcaugugcaaacgaaaccaggcuuauucaagacucugaccggcgagauuggggcagucacacucgacuuuaaacccggaaccagcgguucuccuauaaucaauaagaaaggcaagguaauugggcuguacggaaacggcgugguuacaaaguccggugauuaugugucagccaucacucaggcugaaaggauuggggagccggacuacgaggucgaugaagacaucuuccguaaaaagcggcuuaccauaauggaucugcacccaggagccggcaaaacgaagagaaucuugcccaguauugugagggaggcacuaaaacgccgacugagaacacucauccuggcuccuacucggguuguggccgcggaaauggaggaagcccuuaggggcuuaccaauucgcuaucagacccccgcagucaagagcgagcauacagggcgugagaucguggaccugaugugccacgcuaccuuuacuaccagacucuuguccucuacacggguaccuaauuacaaccugauagugauggaugaagcccacuucacggacccgugcucgguugcugcaaggggauacauuagcacucgcgucgagaugggugaagccgccgcuaucuuuaugaccgcgacacccccaggcucaaucgauccuuucccccaguccaauaguccaauugaggacaucgaacgagagauaccugagagaucuuggaacaccggguucgacuggauuacugauuaucaaggaaagacagugugguuugugcccagcaucaaagcaggcaaugacauugccaacugucuccggaaguccgguaaaaaggucauccagcugucaaggaaaaccuucgauacggaauacccaaagacuaaacuuacagacugggauuuuguugugaccaccgacauaucugagaugggggcuaacuuccgcgccggcagaguaauugauccgaggcggugccugaaaccugugaucuugacugacggacccgaacgugucauccuagcaggcccaauucccgugacuccugcaagcgcugcgcagcgccgagggagaaucggaaggaauccagcccaagaggaugaccaguauguuuuuaguggugauccccugaagaacgacgaagaucaugcacacuggaccgaggcuaaaaugcucuuagacaauauuuacacaccugagggcauaaucccgacucuguucgggccagaacgggagaagacgcaggccauugacggagaauuucgccuuagaggcgagcagaggaaaaccuucguggagcugaugcggcgaggugaucuccccgucugguuguccuauaagguagcaagcgccgggaucucuuacaaggacagagaaugguguuuuacaggcgagcgcaacaaucaaauccuggaagagaacauggaaguggagauuuggacuagggagggagagaagaagaaacuccggccuaaguggcuggaugcucguguuuaugccgaccccauggcgcuuaaagauuucaaggaguuugcaucaggcagaaaguccauaacccuagacauccugacagaaauugccaccuugccaacuuacuuaaguagcaaagcuaagcuggcccucgauaauaucgugaugcugcauacggcugagaaagggggaagggcauaccagcacgcccuuaacgaacugccugagucgcucgagaccuugaugcuggucgcucuacugggugccaugacagcaggcauuuuccucuuuuucaugcaggggaagggaaucggcaaacuuucuaugggucugauagcgaucgccguggcuuccggguuauugugggucgccgaaauucagccccaauggaucgcagcuagcauuauccuggaguucuuucucauggugcugcuuauaccagaaccugagaagcagcgcacuccgcaggacaaucagcugauuuauguuauccucaccauuuugacaaucauaggccugaucgccgcaaacgaaaugggauuaauugagaaaaccaagacugauuucggcuuuuaccaagugaagacagagacgaccauccuagacguagaucugcggcccgccucagcuuggacucucuaugcgguggccacaaccauucuuaccccaaugcugcgacacacaaucgaaaauacaagugcaaacuugucucuggcugccauagccaaucaggcagcuguccucauggggcugggaaaaggcuggccucuucauagaauggaccucgguguuccccuguuggccauggggugcuacucccaggugaacccaacgacccugacagcgagcuuagucaugcuacuggugcacuaugcuauuaucggaccuggccuccaggccaaggcaacuagggaggcccaaaaacgcaccgcugcagguaucaugaagaaucccacaguagauggcauuaccgugaucgaccuugaaccgauaucauacgacccaaaauucgagaagcagcuggggcagguuauguugcuggugcucugugucggacaacugcuuuuaaugcggacuacgugggcccugugcgaggugcucacauuggcgaccggcccuauuaugacucugugggaagggaaccccggaagauuuuggaacaccacaaucgcugucaguacugccaauauuuuccguggcagcuaucuagccggugccgggcuggcuuuuucccucaucaagaacgcccagaccccaaggcggggaacaggcacgaccggugagacucuuggcgaaaaauggaagcgccagcuaaauucuuuggaucgaaaagaguucgaagaguacaagagaagcgggauacuggagguggacaggacagaagcaaaauccgcucuccgggauggaucaaagaucaagcaugccguuucucgcggcaguucgaaaauuagauggaucguagagagggggaugauuaagcccaaaggaaagguggucgaccugggcuguggucgagggggauggagcuacuauauggcgacccugaaaaacgugacugaaguuaagggcuacacaaagggcgggccuggacacgaggaaccgauccccauggccaccuaugguuggaaucuugugaaacugcauuccggcgucgauguguuuuacaagccaacggagcagguagacacccuccuaugcgauauuggggagucuucaagcaacccuacaaucgaagagggacggacucugcguguguugaaaaugguugaacccuggcuguccaguaagccugaguucuguauaaaaguccucaauccauauaugcccaccgugauugaagaacuugagaagcugcaaagacgccacggcgguucuuuggugaggugcccucugagccggaacucaacacacgaaauguacugggucuccggggcaaguggaaauaucguuagcucugugaacacuaucuccaaaaugcucuuaaauagauuuaccacacgccauaggaagccaaccuaugagaaggacguagaucugggcgcuggcacucgaucagugagcacggaaacagagaaacccgacaugaccauuauagggcggagacuucagaggcugcgcgaggaacacaaggagacuuggcauuacgaucaggaaaacccguaccguaccugggccuaucacggaucguacgaggcaccuucuacagguagugcuuccagcauggucaauggcgugguuaaacuacucacgaagccaugggacgugauccccauggucacccagcuggccaugacugacacaaccccuuucgggcaacagcggguguuuaaagaaaagguagauacuagaacaccacagcccaagccgggaaccaggaugauuaugacaacuaccgccaacugguugugggcgcugcucggcaaaaagaaaucaccucgccuuuguacgcgagaggaguucaucuccaagguucggucuaaugcugcaauuggugccguguuccaggaagaacaaggguggaccagcgcuagugaagccgucaacgacuccagauuuugggagcugguggauaaagaaagggcauuacaccaggagggaaagugcgagagcugcguguauaauaugaugggcaagcgcgagaaaaagcugggcgaguucgggagagccaaaggaucucgggcuaucugguacaugugguugggugcgagguuucucgaguucgaggcccugggcuuucuaaacgaagaccauugguucucacgugagaacaguugguccggggucgagggagaaggccuucaccgacuggguuauauacucgaggauaucgacaagaaagauggggaccugauuuacgcagaugacacagcuggaugggauacucgcaucaccgaagacgauuugcugaaugaggagcucauuacagaacagauggccccacaucacaagacucuugcaaaggccaucuuuaaacugaccuaucaaaacaagguugugaaaguauuaagaccaacgccuaagggcgcugugauggacauaauuagccggaaagaccagaggggcucugggcaggucggaacauacggucugaauaccuucacuaacauggaggugcaguugauccgccaaauggaagccgagggcguuaucacacaggaugacaugcagaaucccaaggggcucaaagaaagaguggagaaguggcugaaggaguguggagucgaucggcuaaaaaggauggcgauuucgggcgacgauugcgugguaaagccacuugacgaacgauuuucaaccagccuacucuuccugaacgauauggguaaaguucguaaggacauaccccagugggagccuuccaaaggguggaagaauuggcaagaagugccauuuuguagucaucacuuccacaagaucuuuaugaaagauggaagaucuuuggucgugccgugccgcaaccaggacgaguuaauuggccgggcaaggaucagccagggcgccggguggucccugagagaaacugcuugucucggaaaggccuacgcacagauguggucacuuauguauuuccaucgccgggaucugaggcuagcuaguauggccauuugcucugcuguucccaccgagugguucccuacaagccgaacgaccugguccauccacgcccaucaccaauggaugacuacagaggacaugcugaaaguguggaauagagucuggauagaagacaacccaaauaugaccgauaagacucccgugcacucaugggaggacaucccuuaccucgguaaacgggaagauuugugguguggcagccugauugggcuuucuuccagggcaacaugggcgaagaacauccauaccgccauuacgcagguacgcaaucugaucggaaaggaggaauauguggacuacaugccagcuaugaaacguuauagugcccccuuugagagcgagggcguccucuga

SEQ ID NO: 15762 - RNA, 9867 nt, Artificial Sequence
  derived and/or modified CDS sequence (opt3) from DENV-4__JQ915088__SS-prME
agcaccaugacccugcucugccuuauccccacugugauggcauuccaccuguccacgcgggacggcgagccuuugaugauugucgcuaagcaugaaagggggcggccauuacuguuuaagaccacagagggaauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguagaaggcguuagcgggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauuuguagaagggaugucguugaccggggcuggggcaacgggugcggacuguucgguaaaggcggggugguaaccugcgcuaaguuuuuguguucuggaaaaaucacaggcaaucucgugcaaauagagaaccuggaauauacugucgugguuaccgugcauaauggugauacacacgccgucgggaacgacacuagcaaucacggcgugaccgcaacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacagcuggggccgacaccagcgaaguccacuggaauuacaaagagagaauggugacuuucaaggucccccaugcgaaaaggcaggaugugaccguucucggaucucaggaaggugccaugcacuccgcacuggcuggcgccacagagguggacucaggggauggaaaccacauguuugcuggccaucuuaaguguaagguacggauggaaaaacugcgaaucaaggguaugagcuauaccaugugcagugggaaauucucuaucgacaaggagauggccgagacucaacacggcacaacggucgugaaaguuaaguacgaaggagcaggcgccccuuguaagauuccaauagagauccgcgaugugaauaaagaaaaggucguggggagaauuaucuccagcacccccuucgcugagaacacuaacucgguaauaaauauugaguuggaaccgccuuuuggagacucuuauaucgugaucgguguuggcgauuccgcgcucacacugcauugguucaggaaagggucaaguauuggaaagauguuugagagcaccuaccggggcgcaaaacgcauggccaucuuaggugaaacagcuugggacuucggguccgucggcggacuguuuacuucucuaggcaaggccgugcaccagguguucgggagcgucuauaccacgauguuuggaggcguuucauggaugauuagaauacucaucgguuuccuggugcuuuggauugggaccaacaguaggaauacauccauggcaaugacuugcaucgccgugggaggcaucaccuuguuucuggguuucacaguacaggcugauaugggcugugucgugagcuggaacgggaaggagcucaaaugcggaucuggcauuuuuguuguggacaauguccauacuuggaccgaacaauacaaguuccagcccgagucaccagcccgucuggcaagugcgauacuuaacgcucacaaagacgggguguguggaauccggagcacgacacgacuggagaauguuauguggaagcagauuaccaacgaauugaauuaugugcucugggagggcggucacgaucugacuguagucgccggggacgugaaaggaguguuaacaaagggcaagagagcacugaccccucccgucaacgaucuaaaauacuccuggaagacuugggguaaagccaagaucucuaccccagaagcuagaaauucgacauuucucauugacggccccgauacgagcgagugcccuaacgaacgccgggccuggaauuucuucgagguugaggacuacggguuuggaauguucaccacuaacaucuggaugaaauuuagagaaggcuccucagaggugugugaucauaggcugaugagugcagcuauaaaggaccagaaagccguacacgcggauaugggguauuggaucgaaucuagcaagaaucaaacauggcagauugagaaggccucccuuaucgaagugaaaaccugcuuguggccaaagacacauacucuguggucaaacggaguccucgagagccagaugcugauuccgcgcucuuacgcuggccccuucucccagcacaacuaucgacaagguuacgcaacccagacggccgggccuuggcacuuaggaaaacuggagaucgacuuuggcgaaugcccagguacaaccgugaagauacaggaggauugugaccaucggggccccagucuucguacuaccacagcuagcgggaaauugguuacucaguggugcuguagaucuugcaccaugccuccacucagguuccugggagaagauggcuguugguaugggauggagauucgcccccuauccgagaaggaagagaauauggugaagucacaagucacagccggacagggcacgagugaaaccuuuagcaugggucugcucugccugacucuuuucguggaggaauguuugcggagaaggguuacacgaaaacacaugauccugguggucguaauuaccuuuugcgcaaucauauuagggggacucacuuggauggaccugcuucgcgcgcugaucauguugggcgacacaaugucgggccggauugggggacagauccaucucgccauuaugaccguguucaagauguccccggguuacguucugggcguguuucuaagaaaacugacgucuagggagacugcucucauggucaucgggauggccaugaccacaguguucagcauaccucacgaucugauggagcuuauugacggaaucucauugggccugaucuuacucaagauuguaacccauuuugauaacacucagguggguacacuggcacuuagucugaccuucaugcguuccacaacuccccuagucauggcuuggcgcaccaucauggccguuuucuuugugauuacgcucauaccccugugucggacaucuugcuugcaaaaacagagccacuggguggaaaucaccgcacugauuuuaggggcccaggcucucccugucuaucugaugacucuuaugaagggagcguccagaaggucauggccccugaaugagggcaucauggccgugggcuugguuagccuccuggggagugcacuacugaagaacgacguaccacuugcuggaccuaugguggccgguggccuccuguuggccgcuuacgucaugucuggguccagcgcagaucugucguuagaaaaagccgcgaaugugcaaugggacgagauggcugauauuaccggaucaucucccaucauagaaguuaagcaggacgaggauggcaguuucuccauccgagacguggaggaaacaaacaugauuacucuccuggucaaacuugcccugaucaccgugagcgguuuguacccacucgcaauuccgguaacgauggcccugugguauaucuggcaggucaagacacagcggucuggggcucuaugggaugugccuagccccgcagccacccaaaaagcgacucuguccgagggaguuuaccgcauaaugcagagaggccuuuuuggcaagacacaggugggggucggcauucacauggaagguguguuccauaccauguggcacguuacuaggggcucagugaucugucaugagacagggcggcucgaaccaaguugggcugacguccgaaaugauaugaucagcuauggaggcgguuggagacugggggacaagugggacaaagaggaggaugugcagguauuggccauugaacccggaaagaacccucgccacgugcaaaccaaaccaggcuuauuuaagacgcugacuggcgagauaggggcaguuacccucgacuucaaacccggaacaucugguuccccuaucauuaauaagaaaggcaaggucaucgggcuguacggaaacggcguggugaccaagucaggugauuaugucagugccauuacacaggcugaaaggaucggggagccggacuacgagguagaugaagacauauuucguaaaaagcggcuuacuaucauggaucugcauccaggagccggcaaaaccaagagaauuuugcccagcaucgugagggaggcacuaaaacgccgacugagaacgcucauucuggcuccuacacggguuguggccgcggaaauggaggaagcccuuaggggcuuaccaauccgcuaucagacucccgcagucaaguccgagcacaccgggcgugagauaguggaccugaugugccacgcuacauucaccacuagacucuugucuucgacccggguuccuaauuacaaccugauugugauggaugaagcccauuuuacagacccgugcagcgucgcugcaaggggauacaucucaacgcgcguggagaugggugaagccgccgcuaucuucaugacugcgacaccaccaggcuccauugauccuuuuccccagaguaauucuccaaucgaggacauagaacgagagauuccugagagaagcuggaacacaggguucgacuggaucaccgauuaucaaggaaagacuguaugguucgugcccuccauuaaagcaggcaaugacaucgccaacugucuccggaagucagguaaaaggguuauacagcugucucgcaagacauuugauaccgaauacccaaaaacgaaacuuacugacugggauuucgucgugacaaccgacauuagcgagaugggggcuaacuuuagagccggcagggugaucgauccgcggcguugccugaagccugucaucuugaccgacggacccgaacgcguuauucuagcaggcccaauccccgugacuccugccagugcugcgcagcgaagagggaggauuggacggaauccagcccaagaggaugaccaguauguauucuccggugauccccugaaaaacgacgaagaucacgcacauuggacagaggcuaagaugcucuuagacaauauauacaccccugagggcaucauuccgacacuguuugggccagaacgcgagaaaacucaggccaucgacggagaguucagacuuaggggcgagcagcggaagacguuuguggagcugaugcgaagaggugaucuccccgucugguugagcuauaaaguggcaucugccgggaucucauacaaggaccgcgaaugguguuucaccggcgagaggaacaaucaaauucuggaagagaacauggaaguugagauauggacacgggagggagaaaagaaaaagcuccguccuaaauggcuggaugcuagaguguaugccgaccccauggcgcuuaaggauuuuaaagaguucgcauccggcaggaagaguacuacccuagacauccugacagaaauugccaccuugccaacuuacuuaagcucgaaggcuaaacuggcccucgauaauaucgucaugcugcacacgaccgagaaaggugggcgcgcuuaccagcacgcacuuaacgaacugccugagucucucgagacauugaugcugguagcccuacugggggcuaugacugccggcauuuuucucuucuuuaugcaggggaaaggaaucggcaaacuuuccaugggucugauagcaauggcgguggccagcggguuauuguggguugcugaaauccagccccaauggauugccgcaucaaucauucuggaguucuuccucauggugcugcuuaucccagaaccugagaaacagcggaccccgcaggacaaucagcugauauaugucauucucacaaucuugaccauuaucggccugauagcugccaacgaaaugggauuaaucgagaagacuaaaacagauuuuggcuucuaccaagugaagacggagaccacuauucuagacgucgaucugcgacccgcaagugccuggacacucuaugcuguggcgaccaccauccuuacaccaaugcugagacauacuauugaaaauacgucugccaacuugucccuggcagcuaucgccaaucaggccgcaguucucauggggcugggaaagggcuggccucuucacaggauggaccucggugugccccuguuggcuauggggugcuacagccagguaaacccaaccacacugacugccucauuagugaugcuacugauacauuaugcgauuaucggaccuggccuccaggcuaaagccacccgcgaggcacaaaagcggacagccgcugguaucaugaaaaaucccaccgucgauggcauuacuguuaucgaccuugaaccgauaaguuacgacccaaaguuugagaaacagcugggacaggugauguugcugguccucugugugggacaacugcuuuuaaugagaacgacaugggcacugugcgagguacucaccuuggccacuggcccuauuaugacccugugggaagggaaccccggacguuucuggaacacaacuaucgcggugagcaccgcuaauauuuuuaggggcuccuaucuagccggugcagggcuggccuucucucucaucaagaacgcucagacaccacggcgcggaacgggcaccacuggugagacacuuggcgaaaaguggaaacgacagcugaauagcuuggauagaaaggaguuugaagaguacaaaagguccgggauacuggagguugaccggaccgaagccaagucagcacuccgcgauggaucuaaaaucaagcacgcugugaguagaggcucgagcaagauuagguggaucgucgagcgagggaugauuaaacccaagggaaaaguggucgaccugggcugugguagaggcgggugguccuacuauauggccacuuuaaagaacgugacagaaguuaaaggguacaccaagggcgggccuggacaugaggaaccgauccccauggcgacguaugguuggaaucuuguaaagcugcacucuggcguggaugucuucuacaaaccaaccgaacagguggacacacuccuaugcgauauuggggagucaagcuccaacccuacuaucgaagagggacguacccugagaauauugaagaugguugaacccuggcugaguucuaaaccugaguuuuguauuaaggugcucaauccauauaugcccacagucaucgaggaacuugagaaacugcaacgcaggcacggcgguagcuuggugcggugcccucugucaagaaacuccacucaugaaauguacuggguaaguggggccagcggaaauaucgugucuuccguuaacaccauuucaaagaugcucuuaaaucgcuucacaaccaggcaccgaaaaccaacuuaugagaaggacgucgaucugggcgcaggcacgcggagcgugucgacagaaaccgagaagcccgacaugacuauaaucgggagaaggcuucagcgccugcaggaggaacauaaagagaccuggcacuacgaucaggaaaacccguaccguacaugggcuuaucacggaucuuacgaggccccuaguacggguuccgcaagcucaauggugaauggcgucguuaagcuacucaccaaaccaugggacgugauucccaugguaacucaacuggcuaugacagacaccacuccuuuugggcagcagcggguguucaaggaaaaagucgauacaagaaccccacagcccaaguugggaacaaggaugaucaugacuaccacggccaacuggcugugggcccuccuuggcaagaaaaaguccccgcgccuguguacccgagaggaguuuauuucuaaagugcggagcaaugcggcuaucggugcaguuuuccaagaggaacagggguggacaagugccuccgaagcugugaacgacagcagauucugggaguuagucgauaaggaaagggcccugcaucaggagggaaaaugcgagucuugcguguauaauaugaugggcaagcgcgaaaagaaauugggcgaguuugggagagcaaagggaucacgggccauaugguacauguggcucggugcuagguuccuggaauuugaggcgcuaggcuuccuuaacgaagaccacugguuuagucgugagaacuccuggagcgggguagagggagaaggccugcaucgacucgguuauauccuggaggauauugacaaaaaggauggggacuugaucuacgccgaugacacugcaggaugggauacccgcauuacagaagacgaucugcucaaugaggagcuuaucacugaacaaauggcuccucaccauaaaacccuggccaaggcaauauucaaguuaacguaucagaacaaaguugugaagguccugagacccacaccaaaaggcgccgugauggacauuaucucucggaaggaccagaggggcucgggacaggugggaaccuacgguuugaauacuuuuacaaacauggagguccaacucauccgccagauggaagcugagggcguuauuacccaggaugacaugcagaauccuaaagggcugaaggaaagaguggagaaauggcuaaaggaguguggaguagaucggcuuaagaggauggccauaucaggcgacgauugcguggucaaaccccuggacgaacgauucagcacuucccuccuguuuuugaacgauauggguaaggugcguaaagacguuccacaaugggagcccaguaagggguggaaaaauuggcaggaagugccuuucuguucucaccacuuucauaagaucuucaugaaggauggaaggagcuuagucgugccaugccgcaaccaggacgagcugauuggccgggcgaggaucucccagggcgcaggguggucacucagagaaaccgccugucuuggaaaggcuuacgcccaaauguggagucugauguauuuucaccgccgggaucuaaggcuggcaucuauggcuauuugcagcgccguaccgacagagugguuccccacgucccgaaccacuuggucaauccaugcucagcaccaguggaugacaaccgaggacaugcucaagguuuggaauagaguguggauagaagacaacccuaauaugacugauaaaacaccaguccacagcugggaggacauccccuacuuggguaagcgggaagaucugugguguggcucucuuauugggcuguccaguagggccaccugggccaagaacauccauacggcgauuacacaggugcgcaaucucaucggaaaggaggaauauguugacuacaugccugugaugaagcguuauagcucgccauccgagucugagggcgucuuauga

SEQ ID NO: 15763 - RNA, 9867 nt, Artificial Sequence
  derived and/or modified CDS sequence (opt3) from DENV-4__JQ915086__SS-prME
agcaccaugacacugcucugccuuaucccaacugugauggccuuccaccuguccacgcgggacggcgagccuuugaugauugucgcuaagcaugaaagggggcggccauuacuguuuaagaccacagagggaauaaacaaguguacucuaaucgcaauggaucucggugaaaugugcgaggacaccguuacauacaaguguccgcugcuugugaauaccgaacccgaggauauugacugcugguguaaccugacuucuacaugggugauguauggaacaugcacgcagucaggggagcgccgacgugaaaagagaaguguggccuugacuccucacagcggaaugggccucgagaccagggcggaaacauggauguccucugagggugcuuggaagcaugcccagcgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaagaucccaauugagauacgcgaugugaauaaagaaaaggucguggggagaaucauuuccagcacucccuucgcugagaacacaaacucgguaaucaauauagaguuggaaccgccuuuuggagacucuuauauugugaucgguguuggcgauuccgcgcucacccugcauugguucaggaaagggucaaguaucggaaagauguuugagagcacauaccggggcgcaaaacgcauggccauuuuaggugaaacugcuugggacuucggguccgucggcggacuguuuaccucucuaggcaaggccgugcaccagguguucgggagcgucuauacgaccauguuuggaggcguuucauggaugaucaggauucucauagguuuccuggugcuuuggaucgggacaaacaguaggaauacuuccauggcaaugaccugcauugccgugggaggcaucacauuguuucuggguuucacuguacaggcugauaugggcugugucgugagcuggaacgggaaggagcucaaaugcggaucuggcaucuuuguuguggacaauguccauaccuggacggaacaauacaaguuccagcccgagucaccagcccgucuggcaagugcgauucuuaacgcucacaaagacgggguguguggaauacggagcacaacccgacuggagaauguuauguggaagcagaucacuaacgaauugaauuaugugcucugggagggcggucacgaucugacaguagucgccggggacgugaaaggaguguuaaccaagggcaagagaguccugacuccucccguuaacgaucuaaaauacuccuggaagaccugggguaaagcaaagauuuuuacaccagaagccagaaauucuacguuccucaucgacggccccgauaccucggagugcccuaacgaacgccgggcuuggaauuucuuugagguggaggacuacggguucggaauguuuacuacaaacauuuggaugaaauucagagaaggcagcuccgagguaugugaucauaggcugaugucagccgcaaucaaggaccagaaagcugugcacgccgauaugggguauuggauagaaaguucuaagaaucaaaccuggcagaucgagaaggcgagccuuauugaagucaaaacaugcuuguggccaaagacucauacccugugguccaacggagugcucgagucacagaugcugaucccgcgcagcuacgccggccccuuuucucagcacaacuaucgacaagguuacgcuacgcagacagcagggccuuggcacuuaggaaaacuggagauugacuucggcgaaugcccagguaccacuguuaagauccaggaggauugugaccaucggggccccucccuucguaccacaacugccagugggaaauuggugacccaguggugcuguagaagcugcacaaugccuccacucagguuucugggagaagauggcuguugguaugggauggagauacgcccccuaucugagaaggaagagaauauggucaagucccaagugacggcuggacagggcaccucagaaacuuucaguaugggucugcucugccugacacuuuuuguugaggaauguuugcggagaagggugacccgaaaacacaugauucuggucguagugaucacuuucugcgccauuaucuuagggggacucacauggauggaccugcuucgcgcacugauaauguugggcgacaccaugagcggccggaucgggggacagauucaucucgcgaucaugacgguuuuuaagaugucgccggguuacgugcugggcgucuuccuaagaaaacugacuuccagggagaccgcccucauggugauugggauggcuaugacaaccguauuuucuaucccucacgaucugauggagcuuauagacggaauuagcuugggccugaucuuacucaagaucgugacucauuucgauaacacacaggucgguacccuggcccuuucacugacauucauucguaguacuacgccccuaguuauggcauggcgcaccaucauggcuguguuuuucgugauuacacucauaccccugugucggaccuccugcuugcaaaaacagucucacugggucgaaaucacugcccugauuuuaggggcacaggcccucccuguguaucugaugacccuuaugaagggagcuagcagaagguccuggccccugaaugagggcaucauggcgguuggcuugguaucacuccuggggagcgcccuacugaagaacgacgugccacuugcaggaccuauggucgcugguggccuccuguuggccgccuacgugaugagugggucuuccgcugaucugagcuuagaaaaagcagccaauguucaaugggacgagauggcggauauuacaggaucgucacccaucauagaagugaagcaggacgaggauggcucuuuuaguauccgagacgucgaggaaacuaacaugauuacccuccuggugaaacuugcucugaucacgguauccgguuuguacccacucgccauuccggucacaauggcacugugguauaucuggcaagugaagacccagcggagcggggcccuaugggauguuccuucucccgcugcaacucaaaaagccacacugagcgagggaguguaccgcauaaugcagagaggccuuuucggcaagacccaggucggggugggcauucacauggaagguguuuuucauacuauguggcacgugacaaggggcuccgucaucugucaugagaccgggcggcucgaaccaucaugggcggacgugcgaaaugauaugaucaguuauggaggcgguuggagacugggggacaagugggacaaagaggaggauguacagguguuggcuauugaacccggaaagaacccucgccacguucaaacgaaaccaggcuuauucaagacucugaccggcgagauaggggccgucacacucgacuuuaaacccggaaccagcgguucuccuaucauuaauaagaaaggcaaggugaucgggcuguacggaaacggcguggucacaaaguccggugauuauguaucagcaauuacucaggccgaaaggaucggggagccggacuacgagguggaugaagacauauuccguaaaaagcggcuuaccaucauggaucugcauccaggagcuggcaaaacgaagagaauuuugcccaguaucguuagggaggcccuaaaacgccgacugagaacacucauucuggcaccuacucggguggucgcugccgaaauggaggaagcgcuuaggggcuuaccaauccgcuaucagacccccgccguaaagagcgagcacacagggcgugagauaguugaccugaugugccacgcaaccuuuacuaccagacucuuguccucuacacgggugccuaauuacaaccugauugucauggaugaagcucauuucacggacccgugcucgguggccgcuaggggauacaucagcacucgcguagagaugggugaagcagccgccaucuuuaugaccgcuacacccccaggcucaauugauccuuucccccaguccaauaguccaaucgaggacauagaacgagagauuccugagagaucuuggaacaccggguucgacuggaucacugauuaucaaggaaagacagugugguuuguucccagcauuaaagcgggcaaugacaucgcaaacugucuccggaaguccgguaaaagggucauacagcugucacgcaagaccuucgauacggaauacccaaaaacuaaacuuacagacugggauuuuguggugaccaccgacauuucugagaugggggccaacuucagagcuggcagggucaucgauccgcggcguugccugaagccuguuaucuugacugacggacccgaacgcgugauucuagccggcccaauccccguaaccccugcaagcgccgcucagcgaagagggaggauuggacggaauccagcgcaagaggaugaccaguauguguuuaguggugauccccugaaaaacgacgaagaucacgcccauuggaccgaggcaaagaugcucuuagacaauauauacacaccugagggcaucauuccgacucuguucgggccagaacgcgagaaaacgcaggcuaucgacggagaauuuagacuuaggggcgagcagcggaagaccuucgucgagcugaugcgaagaggugaucuccccgugugguuguccuauaaaguugccagcgcagggaucucuuacaaggaccgcgaaugguguuuuacaggcgagaggaacaaucaaauucuggaagagaacauggaaguggagauauggacucgggagggagaaaagaaaaagcuccguccuaaauggcuggaugccagagucuaugcugaccccauggcccuuaaggauuucaaagaguuugcgucaggcaggaaguccaccacacuagacauccugaccgaaauugcaacuuugccaacguacuuaaguagcaaggccaaacuggcucucgauaauaucguaaugcugcacaccacagagaaagggggacgcgccuaccagcacgcucuuaacgaacugccugagucgcucgagacuuugaugcugguggcacuacugggugccaugaccgcuggcauuuuccucuuuuucaugcaggggaaaggaaucggcaaacuuucuaugggucugauagccaucgcaguugcguccggguuauuguggguggccgaaauucagccccaauggaucgcugccagcauuauccuggaguucuuucucaugguccugcuuauaccagaaccugagaaacagcggacaccgcaggacaaucagcugauuuaugugauccucaccauuuugacuaucauaggccugaucgcagcuaacgaaaugggauuaauugagaagacaaaaacggauuucggcuuuuaccaagucaagaccgagacuacaauccuagacguggaucugcgacccgccucagcauggacccucuaugccguugcuaccacaauucuuacuccaaugcugagacauacgaucgaaaauaccagugcgaacuugucucuggccgcaauagcuaaucaggccgccgugcucauggggcugggaaagggcuggccucuucacaggauggaccucgguguaccccuguuggcaauggggugcuacucccaggugaacccaacaacucugaccgcuagcuuagucaugcuacugauucauuaugccaucaucggaccuggccuccaggcgaaagcuacacgcgaggcccaaaagcggaccgcagccgguauuaugaaaaaucccacuguugauggcaucacggugauagaccuugaaccgauuucauacgacccaaaguucgagaaacagcuggggcaggucauguugcuggugcucuguguaggacaacugcuuuuaaugagaacaaccugggcucugugcgaggugcucacuuuggcaaccggcccuaucaugacacugugggaagggaaccccggacguuuuuggaacacuaccauugccguuaguacagcgaauaucuucaggggcagcuaucuagcuggugccgggcuggcauuuucccucauaaagaacgcccagacgccacggcgcggaaccggcacuacaggugagacccuuggcgaaaaguggaaacgacagcugaacucuuuggauagaaaggaguucgaagaguacaaaaggagcgggauccuggagguggaccggacugaagcuaaguccgcccuccgcgauggaucaaaaauuaagcacgcagucucuagaggcaguucgaagaucagguggauuguggagcgagggaugaucaaacccaagggaaaagucguggaccugggcugugguagagggggauggagcuacuauauggcuacauuaaagaauguuaccgaaguaaaaggcuacacgaagggcgggccuggacaugaggaaccgauucccauggccaccuaugguuggaaucuugugaagcugcacuccggcgucgauguguuuuacaaaccaacagagcagguugacacucuccuaugcgauaucggggagucuucaagcaacccuaccauagaagagggacguacacugagaauuuugaagaugguggaacccuggcuguccaguaaaccugaguucuguaucaagguccucaauccauauaugcccacugugaucgaagaacuugagaaacugcaacgcaggcacggcgguucuuugguacggugcccucugagcagaaacucaacccaugaaauguacuggguguccggggcgaguggaaauauuguuagcucugucaacacaauauccaagaugcucuuaaaucgcuuuaccacuaggcaccgaaaaccaacguaugagaaggacguggaucugggcgccggcacacggucagugagcaccgaaacugagaagcccgacaugaccaucauugggagaaggcuucagcgccugcaggaggaacauaaagagacauggcacuacgaucaggaaaacccguaccguacgugggcauaucacggaucguacgaggcuccuucuaccgguagugccuccagcauggucaauggcguugugaagcuacucacuaaaccaugggacguaauccccauggugacacaacuggcaaugaccgacacuacaccuuucgggcagcagcgggucuuuaaggaaaaaguggauaccagaacaccacagcccaaguugggaacuaggaugauuaugaccacgaccgcuaacuggcugugggcccuccuuggcaagaaaaagucaccgcgccuguguacacgagaggaguucaucuccaaaguucggucuaaugccgcgauaggugcuguguuccaagaggaacagggguggacuagcgcaagugaagccgucaacgacuccagauuuugggaguuaguggauaaggaaagggcucugcaucaggagggaaaaugcgagagcugcguauauaauaugaugggcaagcgcgaaaagaaauugggcgaguucgggagagccaagggaucucgggcaaucugguacauguggcucggugccagguuucuggaguucgaggcucuaggcuuucuuaacgaagaccacugguucucacgugagaacaguugguccgggguugagggagaaggccugcaucgacucgguuauauucuggaggauaucgacaaaaaggauggggacuugauuuacgcggaugacaccgccggaugggauacacgcaucacugaagacgaucugcucaaugaggagcuuauaaccgaacaaauggcaccucaccauaaaacgcuggcuaaggccauuuuuaaguuaacauaucagaacaaaguggucaaggugcugagacccaccccaaaaggcgcagugauggacaucaucagccggaaggaccagaggggcucugggcaggucggaacuuacgguuugaauacauucaccaacauggagguucaacucauucgccagauggaagccgagggcgugauaacucaggaugacaugcagaauccuaaagggcugaaggaaagaguagagaaauggcuaaaggaguguggaguggaucggcuuaagaggauggcuaucucgggcgacgauugcgucgugaaaccccuggacgaacgauuuucaaccagccuccuguucuugaacgauauggguaagguucguaaagacgugccacaaugggagcccuccaagggguggaaaaauuggcaggaagucccuuuuuguagucaccacuuccauaagauuuuuaugaaggauggaagaucuuuagugguaccaugccgcaaccaggacgagcugaucggccgggccaggauuagccagggcgcgggguggucccucagagaaacagcaugucuuggaaaagccuacgcucaaauguggucacugauguauuuccaccgccgggaucuaaggcuggccaguauggcaaucugcucugcuguuccgacggagugguuccccaccagccgaacuacaugguccauacaugcccagcaccaguggaugaccacugaggacaugcucaagguguggaauagagucuggaucgaagacaacccuaauaugacagauaaaaccccagugcacucaugggaggacauucccuacuuggguaagcgggaagaucugugguguggcagccuuaucgggcugucuuccagggcuacgugggccaaaaacauucauacagcaaucacccagguucgcaaucucauuggaaaggaggaauauguggacuacaugccugucaugaagcguuauagugcgccaagcgagucggagggcguguuauga

SEQ ID NO: 15764 - RNA, 9867 nt, Artificial Sequence
  derived and/or modified CDS sequence (opt3) from DENV-4__JQ915087__SS-prME
agcaccaugacccugcucugccuuauccccacugugauggcauuccaccuguccacgagggacggcgagccuuugaugauugucgcuaagcaugaaagggggcggccauuacuguuuaagaccacagaggggauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguugaaggcguuagcgggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauuuguagaagggaugucguugaccggggcuggggcaacgggugcggacuguucgguaaaggcggggugguaaccugcgcuaaguuuuuguguucuggaaaaaucacaggcaaucucgugcaaauagagaaccuggaauauacugucgugguuaccgugcauaauggugauacacacgccgucgggaacgacacuagcaaucacggcgugaccgcaacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacagcuggggccgacaccagcgaaguccacuggaauuacaaagagagaauggugacuuucaaggucccccaugcgaaaaggcaggaugugaccguucucggaucucaggaaggugccaugcacuccgcacuggcuggcgccacagagguggacucaggggauggaaaccacauguuugcuggccaucuuaaguguaagguacggauggaaaaacugcgaaucaaggguaugagcuauaccaugugcagugggaaauucucuaucgacaaggagauggccgagacucaacacggcacaacggucgugaaaguuaaguacgaaggagcaggcgccccuuguaagauuccaauagagauccgcgaugugaauaaagaaaaggucguggggagaauuaucuccagcacccccuucgcugagaacacuaacucgguaauaaauauugaguuggaaccgccuuuuggagacucuuauaucgugaucgguguuggcgauuccgcgcucacacugcauugguucaggaaagggucaaguauuggaaagauguuugagagcaccuaccggggcgcaaaacgcauggccaucuuaggugaaacagcuugggacuucggguccgucggcggacuguuuacuucucuaggcaaggccgugcaccagguguucgggagcgucuauaccacgauguuuggaggcguuucauggaugauuagaauacucaucgguuuccuggugcuuuggauugggaccaacaguaggaauacauccauggcaaugacuugcaucgccgugggaggcaucaccuuguuucuggguuucacaguacaggcugauaugggcugugucgugagcuggaacgggaaggagcucaaaugcggaucuggcauuuuuguuguggacaauguccauacuuggaccgaacaauacaaguuccagcccgagucaccagcccgucuggcaagugcgauacuuaacgcucacaaagacgggguguguggaauccggagcacgacacgacuggagaauguuauguggaagcagauuaccaacgaauugaauuaugugcucugggagggcggucacgaucugacuguagucgccggggacgugaaaggaguguuaacaaagggcaagagagcacugaccccucccgucaacgaucuaaaauacuccuggaagacuugggguaaagccaagaucuuuaccccagaagcuagaaauucuacauuccucauugacggccccgauacgucggagugcccuaacgaacgccgggccuggaauuucuuugagguugaggacuacggguucggaauguuuaccacuaacaucuggaugaaauucagagaaggcagcuccgaggugugugaucauaggcugaugucagcagcuauaaaggaccagaaagccguacacgcggauaugggguauuggaucgaaaguucuaagaaucaaacauggcagauugagaaggccagccuuaucgaagugaaaaccugcuuguggccaaagacacauacucugugguccaacggaguccucgagucacagaugcugauuccgcgcagcuacgcuggccccuuuucucagcacaacuaucgacaagguuacgcaacccagacggccgggccuuggcacuuaggaaaacuggagaucgacuucggcgaaugcccagguacaaccgugaagauacaggaggauugugaccaucggggccccucccuucguacuaccacagcuagugggaaauugguuacucaguggugcuguagaagcugcaccaugccuccacucagguuucugggagaagauggcuguugguaugggauggagauucgcccccuaucugagaaggaagagaauauggugaagucccaagucacagccggacagggcacgucagaaaccuucaguaugggucugcucugccugacucuuuuuguggaggaauguuugcggagaaggguuacacgaaaacacaugauccugguggucguaauuaccuucugcgcaaucauauuagggggacucacuuggauggaccugcuucgcgcgcugaucauguugggcgacacaaugagcggccggauugggggacagauccaucucgccauuaugaccguguuuaagaugucgccggguuacguucugggcguguuccuaagaaaacugacguccagggagacugcucucauggucaucgggauggccaugaccacaguguuuucuauaccucacgaucugauggagcuuauugacggaaucagcuugggccugaucuuacucaagauuguaacccauuucgauaacacucagguggguacacuggcacuuucacugaccuucauccguaguacaacuccccuagucauggcuuggcgcaccauuauggccguauuuuucgugauaacgcucaucccccugugucggacauccugcuugcaaaaacagucucacuggguggaaauuaccgcacugaucuuaggggcccaggcucucccugucuaucugaugacucuuaugaagggagcgagcagaagguccuggccccugaaugagggcauuauggccgugggcuugguuucacuccuggggagcgcacuacugaagaacgacguaccacuugcuggaccuaugguggccgguggccuccuguuggccgcuuacgucaugagugggucuuccgcagaucugagcuuagaaaaagccgcgaaugugcaaugggacgagauggcugauaucaccggaucgucacccauaaucgaaguuaagcaggacgaggauggcucuuuuaguauucgagacguggaggaaacaaacaugaucacucuccuggucaaacuugcccugauuaccguguccgguuuguacccacucgcaaucccgguaacgauggcccugugguauauauggcaggucaagacacagcggagcggggcucuaugggaugugccuucucccgcagccacccaaaaagcgacucugagcgagggaguuuaccgcauuaugcagagaggccuuuucggcaagacacaggugggggucggaauccacauggaagguguguuucauaccauguggcacguuacuaggggcuccgugaucugucaugagacagggcggcucgaaccaucaugggcugacguccgaaaugauaugauuaguuauggaggcgguuggagacugggggacaagugggacaaagaggaggaugugcagguauuggccauagaacccggaaagaacccucgccacgugcaaaccaaaccaggcuuauucaagacgcugacuggcgagaucggggcaguuacccucgacuuuaaacccggaacaagcgguucuccuauuaucaauaagaaaggcaaggucauugggcuguacggaaacggcguggugaccaaguccggugauuaugucucagccaucacacaggcugaaaggauaggggagccggacuacgagguagaugaagacaucuuccguaaaaagcggcuuacuauuauggaucugcauccaggagccggcaaaaccaagagaaucuugcccaguauugugagggaggcacuaaaacgccgacugagaacgcucauccuggcuccuacacggguuguggccgcggaaauggaggaagcccuuaggggcuuaccaauacgcuaucagacucccgcagucaagagcgagcacaccgggcgugagauuguggaccugaugugccacgcuacauuuaccacuagacucuuguccucuacccggguuccuaauuacaaccugaucgugauggaugaagcccauuucacagacccgugcucggucgcugcaaggggauacaucagcacgcgcguggagaugggugaagccgccgcuauuuuuaugacugcgacaccaccaggcucaaucgauccuuucccccaguccaauaguccaauagaggacauugaacgagagaucccugagagaucuuggaacacaggguucgacuggauuaccgauuaucaaggaaagacuguaugguuugugcccagcaucaaagcaggcaaugacauagccaacugucuccggaaguccgguaaaaggguuauucagcugucacgcaagacauucgauaccgaauacccaaaaacgaaacuuacugacugggauuuugucgugacaaccgacaucucugagaugggggcuaacuucagagccggcagggugaucgauccgcggcguugccugaagccugucauuuugaccgacggacccgaacgcguuauccuagcaggcccaauucccgugacuccugccagcgcugcgcagcgaagagggaggauaggacggaauccagcccaagaggaugaccaguauguauuuaguggugauccccugaaaaacgacgaagaucacgcacauuggacagaggcuaagaugcucuuagacaauaucuacaccccugagggcauuaucccgacacuguucgggccagaacgcgagaaaacucaggccaucgacggagaauuuagacuuaggggcgagcagcggaagacguucguggagcugaugcgaagaggugaucuccccgucugguuguccuauaaaguggcaagcgccgggauuucuuacaaggaccgcgaaugguguuuuaccggcgagaggaacaaucaaauacuggaagagaacauggaaguugagaucuggacacgggagggagaaaagaaaaagcuccguccuaaauggcuggaugcuagaguguaugccgaccccauggcgcuuaaggauuucaaagaguuugcaucaggcaggaaguccacuacccuagacauucugacagaaaucgccaccuugccaacuuacuuaaguagcaaggcuaaacuggcccucgauaauauugucaugcugcacacgaccgagaaagggggccgcgcuuaccagcacgcacuuaacgaacugccugagucgcucgagacauugaugcugguagcccuacugggugcuaugacugccggcaucuuccucuuuuucaugcaggggaaaggaauaggcaaacuuucuaugggucugaucgcaauugcgguggccuccggguuauuguggguugcugaaauccagccccaauggauugccgcaagcaucauacuggaguucuuucucauggugcugcuuauuccagaaccugagaaacagcggaccccgcaggacaaucagcugaucuaugucauucucacaaucuugaccauaaucggccugauugcugccaacgaaaugggauuaaucgagaagacuaaaacagauuucggcuuuuaccaagugaagacggagaccacuauucuagacgucgaucugcgacccgcaucagccuggacacucuaugcuguggcgaccaccauccuuacaccaaugcugagacauacuauagaaaauacgagugccaacuugucucuggcagcuauugccaaucaggccgcaguucucauggggcugggaaagggcuggccucuucacaggauggaccucggugugccccuguuggcuauggggugcuacucccagguaaacccaaccacacugacugccagcuuagugaugcuacugauccauuaugcgaucauuggaccuggccuccaggcuaaagccacccgcgaggcacaaaagcggacagccgcugguaucaugaaaaaucccaccgucgauggcauaacuguuauugaccuugaaccgaucucauacgacccaaaguucgagaaacagcugggacaggugauguugcugguccucugugugggacaacugcuuuuaaugagaacgacaugggcacugugcgagguacucaccuuggccacuggcccuauuaugacccugugggaagggaaccccggacguuuuuggaacacaacuaucgcggugaguaccgcuaauauauucaggggcagcuaucuagccggugcagggcuggccuuuucccucaucaagaacgcucagacaccacggcgcggaacgggcaccacuggugagacacuuggcgaaaaguggaaacgacagcugaacucuuuggauagaaaggaguucgaagaguacaaaaggagcgggauucuggagguugaccggaccgaagccaaguccgcacuccgcgauggaucaaaaaucaagcacgcugugucuagaggcaguucgaagauuagguggaucgucgagcgagggaugauuaaacccaagggaaaaguggucgaccugggcugugguagaggcggguggagcuacuauauggccacuuuaaagaaugugacagaaguuaaaggguacaccaagggcgggccuggacaugaggaaccgauccccauggcgacguaugguuggaaucuuguaaagcugcacuccggcguggaugucuuuuacaaaccaaccgaacagguggacacacuccuaugcgauauaggggagucuucaagcaacccuacuauugaagagggacguacccugagaaucuugaagaugguugaacccuggcuguccaguaaaccugaguucuguaucaaggugcucaauccauauaugcccacagucauugaggaacuugagaaacugcaacgcaggcacggcgguucuuuggugcggugcccucugagcagaaacucaacucaugaaauguacuggguauccggggccaguggaaauauagugagcucuguuaacaccaucuccaagaugcucuuaaaucgcuuuacaaccaggcaccgaaaaccaacuuaugagaaggacgucgaucugggcgcaggcacgcggucagugagcacagaaaccgagaagcccgacaugacuauuaucgggagaaggcuucagcgccugcaggaggaacauaaagagaccuggcacuacgaucaggaaaacccguaccguacaugggcuuaucacggaucguacgaggccccuucuacggguagugcauccagcauggugaauggcgucguuaagcuacucaccaaaccaugggacgugauucccaugguaacucaacuggcuaugacagacaccacuccuuucgggcagcagcggguguuuaaggaaaaagucgauacaagaaccccacagcccaaguugggaacaaggaugaucaugacuaccacggccaacuggcugugggcccuccuuggcaagaaaaagucaccgcgccuguguacccgagaggaguucauauccaaagugcggucuaaugcggcuaucggugcaguuuuccaagaggaacagggguggacaagcgccagugaagcugugaacgacuccagauuuugggaguuagucgauaaggaaagggcccugcaucaggagggaaaaugcgagagcugcguguauaauaugaugggcaagcgcgaaaagaaauugggcgaguucgggagagcaaagggaucucgggccauuugguacauguggcucggugcuagguuucuggaguucgaggcgcuaggcuuucuuaacgaagaccacugguucucacgugagaacaguugguccgggguagagggagaaggccugcauagccucgguuauauccuggaggauauugacaaaaaggauggggacuugaucuacgccgaugacacugcaggaugggauacccgaauaacagaagacgaucugcucaaugaggagcuuauuacugaacaaauggcuccucaccauaaaacccuggccaaggcaaucuuuaaguuaacguaucagaacaaaguugugaagguccugcgccccacaccaaaaggcgccgugauggacaucauuucuagaaaggaccagcggggcucgggacaggugggaaccuacgguuugaauacuuucacaaacauggagguccaacucauaaggcagauggaagcugagggcguuaucacccaggaugacaugcagaauccuaaagggcugaaggaacgcguggagaaauggcuaaaggaguguggaguagauagacuuaagcggauggccauuucaggcgacgauugcguggucaaaccccuggacgaaagguuuagcacuucccuccuguucuugaacgauauggguaaggugcgaaaagacguuccacaaugggagcccaguaagggguggaaaaauuggcaggaagugccuuuuuguucucaccacuuccauaagaucuuuaugaaggauggacguagcuuagucgugccaugcagaaaccaggacgagcugauuggccgcgcgcggaucucccagggcgcaggguggucacucagggaaaccgccugucuuggaaaggcuuacgcccaaauguggagucugauguauuuccacagacgcgaucuacggcuggcaucuauggcuauaugcagcgccguaccgacagagugguuccccacguccaggaccacuuggucaauccaugcucagcaccaguggaugacaaccgaggacaugcucaagguuuggaaucgaguguggauugaagacaacccuaauaugacugauaaaacaccaguccacagcugggaggacauccccuacuuggguaagagagaagaucugugguguggcucucuuauugggcuguccagucgggccaccugggccaagaacauccauacggcgauuacacaggugaggaaucucauaggaaaggaggaauauguugacuacaugccugugaugaagcgcuauagcgccccaucggaguccgagggcgucuuauga

SEQ ID NO: 15765 - RNA, 9867 nt, Artificial Sequence
  derived and/or modified CDS sequence (opt3) from DENV-4__JQ915089__SS-prME
agcaccaugacacugcucugccuuaucccaacugugauggccuuccaccuguccacgagagacggcgagccuuugaugauugucgcuaagcaugaaagggggcggccauuacuguuuaagaccacagaggggauaaacaaguguacucuaaucgcaauggaucucggugaaaugugcgaggacaccguuacauacaaguguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaagcaugcccagcgggucgagucguggauccugcgcaauccaggguucgcacugcucgccggauuuauggcuuacaugauuggccagacuggcauccagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaaguaucuccaauauuacaaccgccacgcgaugcccaacccaaggagagcccuaucuuaaggaggaacaggaccagcaguacaucuguagaagggaugucguugaccggggcuggggcaacgggugcggacuguucgguaaaggcggggugguaacaugcgcuaaguuuuuguguucuggaaaaauuacuggcaaucucgugcaaaucgagaaccuggaauauaccgucgugguuacagugcauaauggugauacucacgccgucgggaacgacaccagcaaucacggcgugacagcaaccauaacuccucguuccccaucaguagagguuaaguuaccggauuacggagaacugacgcucgacugcgagccccgcaguggcauugacuucaacgagaugauccuuaugaagaugaaaaagaaaacauggcuggugcauaagcagugguuuuuggaucuaccucugccauggaccgcuggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaauuaaggguaugagcuauacuaugugcagugggaaauucucuaucgacaaggagauggccgagacacaacacggcacgaccgucgugaaaguuaaguacgaaggagcaggcgccccuuguaagaucccaauugagauacgcgaugugaauaaagaaaaggucguggggagaaucauuuccagcacucccuucgcugagaacacaaacucgguaaucaauauagaguuggaaccgccuuuuggagacucuuauauugugaucgguguuggcgauuccgcgcucacccugcauugguucaggaaagggucaaguaucggaaagauguuugagagcacauaccggggcgcaaaacgcauggccauuuuaggugaaacugcuugggacuucggguccgucggcggacuguuuaccucucuaggcaaggccgugcaccagguguucgggagcgucuauacgaccauguuuggaggcguuucauggaugaucaggauucucauagguuuccuggugcuuuggaucgggacaaacaguaggaauacuuccauggcaaugaccugcauugccgugggaggcaucacauuguuucuggguuucacuguacaggcugauaugggcugugucgugagcuggaacgggaaggagcucaaaugcggaucuggcaucuuuguuguggacaauguccauaccuggacggaacaauacaaguuccagcccgagucaccagcccgucuggcaagugcgauucuuaacgcucacaaagacgggguguguggaauacggagcacaacccgacuggagaauguuauguggaagcagaucacuaacgaauugaauuaugugcucugggagggcggucacgaucugacaguagucgccggggacgugaaaggaguguuaaccaagggcaagagaguccugacuccucccguuaacgaucuaaaauacuccuggaagaccugggguaaagcaaagauuuuuacaccagaagccagaaauucuacguuccucaucgacggccccgauaccucggagugcccuaacgaacgccgggcuuggaauuucuuugagguggaggacuacggguucggaauguuuacuacaaacauuuggaugaaauucagagaaggcagcuccgagguaugugaucauaggcugaugucagccgcaaucaaggaccagaaagcugugcacgccgauaugggguauuggauagaaaguucuaagaaucaaaccuggcagaucgagaaggcgagccuuauugaagucaaaacaugcuuguggccaaagacucauacccugugguccaacggagugcucgagucacagaugcugaucccgcgcagcuacgccggccccuuuucucagcacaacuaucgacaagguuacgcuacgcagacagcagggccuuggcacuuaggaaaacuggagauugacuucggcgaaugcccagguaccacuguuaagauccaggaggauugugaccaucggggccccucccuucguaccacaacugccagugggaaauuggugacccaguggugcuguagaagcugcacaaugccuccacucagguuucugggagaagauggcuguugguaugggauggagauacgcccccuaucugagaaggaagagaauauggucaagucccaagugacggcuggacagggcaccucagaaacuuucaguaugggucugcucugccugacacuuuuuguugaggaauguuugcggagaagggugacccgaaaacacaugauucuggucguagugaucacuuucugcgccauuaucuuagggggacucacauggauggaccugcuucgcgcacugauaauguugggcgacaccaugagcggccggaucgggggacagauucaucucgcgaucaugacgguuuuuaagaugucgccggguuacgugcugggcgucuuccuaagaaaacugacuuccagggagaccgcccucauggugauugggauggcuaugacaaccguauuuucuaucccucacgaucugauggagcuuauagacggaauuagcuugggccugaucuuacucaagaucgugacucauuucgauaacacacaggucgguacccuggcccuuucacugacauucauucguaguacuacgccccuaguuauggcauggcgcaccaucauggcuguguuuuucgugauuacacucauaccccugugucggaccuccugcuugcaaaaacagucucacugggucgaaaucacugcccugauuuuaggggcacaggcccucccuguguaucugaugacccuuaugaagggagcuagcuccagaucauggccccugaaugagggcaucauggcgguuggcuugguaagccuccuggggagugcccuacugaagaacgacgugccacuugcaggaccuauggucgcugguggccuccuguuggccgccuacgugaugucuggguccagcgcugaucugucguuagaaaaagcagccaauguucaaugggacgagauggcggauauuacaggaucaucucccaucauagaagugaagcaggacgaggauggcaguuuuuccaucagggacgucgaggaaacuaacaugauuacccuccuggugaaacuugcucugaucacgguaagcgguuuguacccacucgccauuccggucacaauggcacugugguauaucuggcaagugaagacccagcgaucuggggcccuaugggauguuccuagccccgcugcaacucaaaaagccacacuguccgagggaguguaccggauaaugcagcgcggccuuuucggcaagacccaggucggggugggcauucacauggaagguguuuuucauacuauguggcacgugacaagaggcucagucaucugucaugagaccgggaggcucgaaccaaguugggcggacgugcggaaugauaugaucagcuauggaggcgguuggcgacugggggacaagugggacaaagaggaggauguacagguguuggcuauugaacccggaaagaacccuagacacguucaaacgaaaccaggcuuauucaagacucugaccggcgagauaggggccgucacacucgacuuuaaacccggaaccucugguuccccuaucauuaauaagaaaggcaaggugaucgggcuguacggaaacggcguggucacaaagucaggugauuauguaagugcaauuacucaggccgaacgcaucggggagccggacuacgagauagaugaagacaucuucaggaaaaagcgucuuaccauuauggaucugcauccaggagcuggcaaaacgaagcggaucuugcccagcauugugagagaggcccuaaaaaggcgccugcgaacacucauccuggcaccuacuagaguuguggcugccgaaauggaggaagcgcuucggggcuuaccaauaagguaucagacccccgccgucaaguccgagcacacagggcgcgagauuguggaccugaugugccacgcaaccuuuacuacccgucucuugucuucgacaagaguuccuaauuacaaccugaucgugauggaugaagcucauuucacggacccgugcagcgucgccgcucggggauacaucucaacuaggguggagaugggugaagcagccgccauuuuuaugaccgcuacacccccaggcuccaucgauccuuucccccagaguaauucuccaauagaggacauugaacgcgagaucccugagcgaagcuggaacaccggguucgacuggauuacugauuaucaaggaaagacaguaugguuugugcccuccaucaaagcgggcaaugacauagcaaacugucucagaaagucagguaaacggguuauucagcugucuaggaagaccuucgauacggaauacccaaaaacuaaacuuacagacugggauuuugucgugaccaccgacaucagcgagaugggggccaacuuccgcgcuggcagagugaucgauccgaggcggugccugaagccugucauuuugacugacggacccgaacguguuauccuagccggcccaauucccgugacuccugcaagugccgcucagcgccgagggagaauaggaaggaauccagcgcaagaggaugaccaguauguauuuuccggugauccccugaaaaacgacgaagaucacgcccauuggaccgaggcaaagaugcucuuagacaauaucuacacaccugagggcauuaucccgacucuguucgggccagaacgggagaaaacgcaggcuaucgacggagaauuucgccuuagaggcgagcagaggaagaccuucguggagcugaugcggcgaggugaucuccccgucugguugagcuauaaaguggccucugcagggauuucauacaaggacagagaaugguguuuuacaggcgagcgcaacaaucaaauacuggaagagaacauggaaguugagaucuggacuagggagggagaaaagaaaaagcuccggccuaaauggcuggaugcccguguguaugcugaccccauggcccuuaaggauuucaaagaguuugcguccggcagaaagaguaccacacuagacauucugaccgaaaucgcaacuuugccaacguacuuaagcucgaaggccaaacuggcucucgauaauauugucaugcugcacaccacagagaaaggugggagggccuaccagcacgcucuuaacgaacugccugagucucucgagacuuugaugcugguagcacuacugggggccaugaccgcuggcaucuuccucuuuuucaugcaggggaaaggaauaggcaaacuuuccaugggucugaucgccauugcaguggcgagcggguuauuguggguugccgaaauccagccccaauggauugcugccucaaucauacuggaguucuuucucauggugcugcuuauuccagaaccugagaaacagcgcacaccgcaggacaaucagcugaucuaugucauucucaccaucuugacuauaaucggccugauugcagcuaacgaaaugggauuaaucgagaagacaaaaacggauuucggcuuuuaccaagugaagaccgagacuacaauucuagacgucgaucugcggcccgccagugcauggacccucuaugccguggcuaccacaauccuuacuccaaugcugcgacauacgauagaaaauaccucugcgaacuugucccuggccgcaauugcuaaucaggccgccguucucauggggcugggaaagggcuggccucuucacagaauggaccucggugugccccuguuggcaauggggugcuacagccagguaaacccaacaacucugaccgcuucauuagugaugcuacugauccauuaugccaucauuggaccuggccuccaggcgaaagcuacaagggaggcccaaaagcgcaccgcagccgguaucaugaaaaaucccacugucgauggcauaacgguuauugaccuugaaccgaucaguuacgacccaaaguucgagaaacagcugggacaggugauguugcugguccucugugugggacaacugcuuuuaaugcggacaaccugggcucugugcgagguacucacuuuggcaaccggcccuauuaugacacugugggaagggaaccccggaagauuuuggaacacuaccaucgccgugagcacagcgaauauauuccguggcuccuaucuagcuggugccgggcuggcauuuucucucaucaagaacgcccagacgccaaggcggggaaccggcacuacaggugagacccuuggcgaaaaguggaaacgccagcugaauagcuuggaucgaaaggaguucgaagaguacaaaagauccgggauucuggagguugacaggacugaagcuaagucagcccuccgggauggaucuaaaaucaagcacgcagugagucgcggcucgagcaagauuagauggaucgucgagagggggaugauuaaacccaagggaaaaguggucgaccugggcuguggucgagggggaugguccuacuauauggcuacauuaaagaacgugaccgaaguuaaaggcuacacgaagggcgggccuggacaugaggaaccgauccccauggccaccuaugguuggaaucuuguaaagcugcacucuggcguggaugucuuuuacaaaccaacagaacagguggacacucuccuaugcgauauaggggagucaagcuccaacccuaccauugaagagggacggacacugcguaucuugaagaugguugaacccuggcugaguucuaaaccugaguucuguaucaaggugcucaauccauauaugcccacugucauugaggaacuugagaaacugcaaagacgccacggcgguagcuuggugaggugcccucugucacggaacuccacccaugaaauguacuggguaaguggggcgagcggaaauauagugucuuccguuaacacaaucucaaagaugcucuuaaauagauuuaccacucgccacaggaaaccaacguaugagaaggacgucgaucugggcgccggcacacgaagcgugucgaccgaaacugagaagcccgacaugaccauuaucgggcggagacuucagaggcugcaggaggaacauaaagagacauggcacuacgaucaggaaaacccguaccgcacgugggcauaucacggaucuuacgaggcuccuaguaccgguuccgccagcucaauggugaauggcgucguuaagcuacucacuaaaccaugggacgugauucccaugguaacacaacuggcaaugaccgacacuacaccuuucgggcagcagcguguguuuaaggaaaaagucgauacccggacaccacagcccaaguugggaacuagaaugaucaugaccacgaccgcuaacuggcugugggcccuccuuggcaagaaaaaguccccgaggcuguguacacgcgaggaguucauaucuaaagugcgaagcaaugccgcgaucggugcuguuuuccaagaggaacagggguggacaagugcauccgaagccgugaacgacagccgguuuugggaguuagucgauaaggaaagagcucugcaucaggagggaaaaugcgagucuugcguguauaauaugaugggcaagagggaaaagaaauugggcgaguucgggcgcgccaagggaucaagagcaauuugguacauguggcucggugcccgguuucuggaguucgaggcucuaggcuuucuuaacgaagaccacugguucaguagggagaacuccuggagcgggguagagggagaaggccugcaucgucucgguuauauccuggaggauauugacaaaaaggauggggacuugaucuacgcggaugacaccgccggaugggauacacgaauaacugaagacgaucugcucaaugaggagcuuauuaccgaacaaauggcaccucaccauaaaacgcuggcuaaggccaucuuuaaguuaacauaucagaacaaaguugugaagguccugcgccccaccccaaaaggcgcagugauggacaucauuucuagaaaggaccagcggggcucgggacaggugggaacuuacgguuugaauacauucaccaacauggagguccaacucauaaggcagauggaagccgagggcguuaucacucaggaugacaugcagaauccuaaagggcugaaggaacgcguggagaaauggcuaaaggaguguggaguagauagacuuaagcggauggcuauuucaggcgacgauugcguggucaaaccccuggacgaaagguuuagcaccucccuccuguucuugaacgauauggguaaggugcgaaaagacguuccacaaugggagcccaguaagggguggaaaaauuggcaggaagugccuuuuuguucucaccacuuccauaagaucuuuaugaaggauggacguagcuuagucgugccaugcagaaaccaggacgagcugauuggccgcgcccggaucucccagggcgcgggguggucacucagggaaacagcaugucuuggaaaagccuacgcucaaauguggagucugauguauuuccacagacgcgaucuacggcuggccucuauggcaauaugcagcgcuguaccgacggagugguuccccaccuccaggacuacauggucaauccaugcccagcaccaguggaugaccacugaggacaugcucaagguuuggaaucgaguguggauugaagacaacccuaauaugacagauaaaaccccaguccacagcugggaggacauccccuacuuggguaagagagaagaucugugguguggcucucuuauugggcuguccagucgggcuacgugggccaaaaacauccauacagcaauuacccaggugaggaaucucauaggaaaggaggaauauguugacuacaugccugugaugaagcgcuauagcgcgccaucggaguccgagggcgucuuauga

SEQ ID NO: 15766 - RNA, 9867 nt, Artificial Sequence
  derived and/or modified CDS sequence (opt3) from DENV-4__JQ915082__SS-prME
agcaccaugacccugcucugccuuauccccacugugauggcauuccaccuguccacgagggacggcgagccuuugaugauugucgcuaagcaugaaagggggcggccauuacuguuuaagaccacggaggggauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguugaaggcguuagcgggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauuuguagaagggaugucguugaccggggcuggggcaacgggugcggacuguucgguaaaggcggggugguaaccugcgcuaaguuuuuguguucuggaaaaaucacaggcaaucucgugcaaauagagaaccuggaauauacugucgugguuaccgugcauaauggugauacacacgccgucgggaacgacacuagcaaucacggcgugaccgcaacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacagcuggggccgacaccagcgaaguccacuggaauuacaaagagagaauggugacuuucaaggucccccaugcgaaaaggcaggaugugaccguucucggaucucaggaaggugccaugcacuccgcacuggcuggcgccacagagguggacucaggggauggaaaccacauguuugcuggccaucuuaaguguaagguacggauggaaaaacugcgaaucaaggguaugagcuauaccaugugcagugggaaauucucuaucgacaaggagauggccgagacucaacacggcacaacggucgugaaaguuaaguacgaaggagcaggcgccccuuguaagauuccaauagagauccgcgaugugaauaaagaaaaggucguggggagaauuaucuccagcacccccuucgcugagaacacuaacucgguaauaaauauugaguuggaaccgccuuuuggagacucuuauaucgugaucgguguuggcgauuccgcgcucacacugcauugguucaggaaagggucaaguauuggaaagauguuugagagcaccuaccggggcgcaaaacgcauggccaucuuaggugaaacagcuugggacuucggguccgucggcggacuguuuacuucucuaggcaaggccgugcaccagguguucgggagcgucuauaccacgauguuuggaggcguuucauggaugauuagaauacucaucgguuuccuggugcuuuggauugggaccaacaguaggaauacauccauggcaaugacuugcaucgccgugggaggcaucaccuuguuucuggguuucacaguacaggcugauaugggcugugucgugagcuggaacgggaaggagcucaaaugcggaucuggcauuuuuguuguggacaauguccauacuuggaccgaacaauacaaguuccagcccgagucaccagcccgucuggcaagugcgauacuuaacgcucacaaagacgggguguguggaauccggagcacgacacgacuggagaauguuauguggaagcagauuaccaacgaauugaauuaugugcucugggagggcggucacgaucugacuguagucgccggggacgugaaaggaguguuaacaaagggcaagagagcacugaccccucccgucaacgaucuaaaauacuccuggaagacuugggguaaagccaagaucuuuaccccagaagcuagaaauucuacauuccucauugacggccccgauacgucggagugcccuaacgaacgccgggccuggaauuucuuugagguugaggacuacggguucggaauguuuaccacuaacaucuggaugaaauucagagaaggcagcuccgaggugugugaucauaggcugaugucagcagcuauaaaggaccagaaagccguacacgcggauaugggguauuggaucgaaaguucuaagaaucaaacauggcagauugagaaggccagccuuaucgaagugaaaaccugcuuguggccaaagacacauacucugugguccaacggaguccucgagucacagaugcugauuccgcgcagcuacgcuggccccuuuucucagcacaacuaucgacaagguuacgcaacccagacggccgggccuuggcacuuaggaaaacuggagaucgacuucggcgaaugcccagguacaaccgugaagauacaggaggauugugaccaucggggccccucccuucguacuaccacagcuagugggaaauugguuacucaguggugcuguagaagcugcaccaugccuccacucagguuucugggagaagauggcuguugguaugggauggagauucgcccccuaucugagaaggaagagaauauggugaagucccaagucacagccggacagggcacgucagaaaccuucaguaugggucugcucugccugacucuuuuuguggaggaauguuugcggagaaggguuacacgaaaacacaugauccugguggucguaauuaccuucugcgcaaucauauuagggggacucacuuggauggaccugcuucgcgcgcugaucauguugggcgacacaaugagcggccggauugggggacagauccaucucgccauuaugaccguguuuaagaugucgccggguuacguucugggcguguuccuaagaaaacugacguccagggagacugcucucauggucaucgggauggccaugaccacaguguuuucuauaccucacgaucugauggagcuuauugacggaaucagcuugggccugaucuuacucaagauuguaacccauuucgauaacacucagguggguacacuggcacuuucacugaccuucauccguaguacaacuccccuagucauggcuuggcgcaccauuauggccguauuuuucgugauaacgcucaucccccugugucggacauccugcuugcaaaaacagucucacuggguggaaauuaccgcacugaucuuaggggcccaggcucucccugucuaucugaugacucuuaugaagggagcgagcagaagguccuggccccugaaugagggcauuauggccgugggcuugguuucacuccuggggagcgcacuacugaagaacgacguaccacuugcuggaccuaugguggccgguggccuccuguuggccgcuuacgucaugagugggucuuccgcagaucugagcuuagaaaaagccgcgaaugugcaaugggacgagauggcugauaucaccggaucgucacccauaaucgaaguuaagcaggacgaggauggcucuuuuaguauucgagacguggaggaaacaaacaugaucacucuccuggucaaacuugcccugauuaccguguccgguuuguacccacucgcaaucccgguaacgauggcccugugguauauauggcaggucaagacacagcggagcggggcucuaugggaugugccuucucccgcagccacccaaaaagcgacucugagcgagggaguuuaccgcauuaugcagagaggccuuuucggcaagacacaggugggggucggaauccacauggaagguguguuucauaccauguggcacguuacuaggggcuccgugaucugucaugagacagggcggcucgaaccaucaugggcugacguccgaaaugauaugauuaguuauggaggcgguuggagacugggggacaagugggacaaagaggaggaugugcagguauuggccauagaacccggaaagaacccucgccacgugcaaaccaaaccaggcuuauucaagacgcugacuggcgagaucggggcaguuacccucgacuuuaaacccggaacaagcgguucuccuauuaucaauaagaaaggcaaggucauugggcuguacggaaacggcguggugaccaaguccggugauuaugucucagccaucacacaggcugaaaggauaggggagccggacuacgagguagaugaagacaucuuccguaaaaagcggcuuacuauuauggaucugcauccaggagccggcaaaaccaagagaaucuugcccaguauugugagggaggcacuaaaacgccgacugagaacgcucauccuggcuccuacacggguuguggccgcggaaauggaggaagcccuuaggggcuuaccaauacgcuaucagacucccgcagucaagagcgagcacaccgggcgugagauuguggaccugaugugccacgcuacauuuaccacuagacucuuguccucuacccggguuccuaauuacaaccugaucgugauggaugaagcccauuucacagacccgugcucggucgcugcaaggggauacaucagcacgcgcguggagaugggugaagccgccgcuauuuuuaugacugcgacaccaccaggcucaaucgauccuuucccccaguccaauaguccaauagaggacauugaacgagagaucccugagagaucuuggaacacaggguucgacuggauuaccgauuaucaaggaaagacuguaugguuugugcccagcaucaaagcaggcaaugacauagccaacugucuccggaaguccgguaaaaggguuauucagcugucacgcaagacauucgauaccgaauacccaaaaacgaaacuuacugacugggauuuugucgugacaaccgacaucucugagaugggggcuaacuucagagccggcagggugaucgauccgcggcguugccugaagccugucauuuugaccgacggacccgaacgcguuauccuagcaggcccaauucccgugacuccugccagcgcugcgcagcgaagagggaggauaggacggaauccagcccaagaggaugaccaguauguauuuaguggugauccccugaaaaacgacgaagaucacgcacauuggacagaggcuaagaugcucuuagacaauaucuacaccccugagggcauuaucccgacacuguucgggccagaacgcgagaaaacucaggccaucgacggagaauuuagacuuaggggcgagcagcggaagacguucguggagcugaugcgaagaggugaucuccccgucugguuguccuauaaaguggcaagcgccgggauuucuuacaaggaccgcgaaugguguuuuaccggcgagaggaacaaucaaauacuggaagagaacauggaaguugagaucuggacacgggagggagaaaagaaaaagcuccguccuaaauggcuggaugcuagaguguaugccgaccccauggcgcuuaaggauuucaaagaguuugcaucaggcaggaaguccacuacccuagacauucugacagaaaucgccaccuugccaacuuacuuaaguagcaaggcuaaacuggcccucgauaauauugucaugcugcacacgaccgagaaagggggccgcgcuuaccagcacgcacuuaacgaacugccugagucgcucgagacauugaugcugguagcccuacugggugcuaugacugccggcaucuuccucuuuuucaugcaggggaaaggaauaggcaaacuuucuaugggucugaucgcaauugcgguggccuccggguuauuguggguugcugaaauccagccccaauggauugccgcaagcaucauacuggaguucuuucucauggugcugcuuauuccagaaccugagaaacagcggaccccgcaggacaaucagcugaucuaugucauucucacaaucuugaccauaaucggccugauugcugccaacgaaaugggauuaaucgagaagacuaaaacagauuucggcuuuuaccaagugaagacggagaccacuauucuagacgucgaucugcgacccgcaucagccuggacacucuaugcuguggcgaccaccauccuuacaccaaugcugagacauacuauagaaaauaugagugccaacuugucucuggcagcuauugccaaucaggccgcaguucucauggggcugggaaagggcuggccucuucacaggauggaccucggugugccccuguuggcuauggggugcuacucccagguaaacccaacgacccugacagccagcuuagugaugcuacugauccauuaugcgaucauuggaccuggccuccaggcuaaagccacucgcgaggcacaaaagcggaccgccgcugguaucaugaaaaaucccacagucgauggcauaaccguuauugaccuugaaccgaucucauacgacccaaaguucgagaaacagcugggacaggugauguugcugguccucugugugggacaacugcuuuuaaugagaacuacgugggcacugugcgagguacucacauuggccaccggcccuauuaucacucugugggaagggaaccccggacguuuuuggaacaccacaauagcggugaguacugcuaauaucuucaggggcagcuaucuagccggugcagggcuggccuuuucccucauuaagaacgcucagaccccacggcgcggaacaggcacgaccggugagacucuuggcgaaaaguggaaacgacagcugaacucuuuggauagaaaggaguucgaagaguacaaaaggagcgggauccuggagguugaccggacagaagccaaguccgcacuccgcgauggaucaaaaauuaagcacgcugugucuagaggcaguucgaagaucagguggauugucgagcgagggaugaucaaacccaagggaaaaguggucgaccugggcugugguagaggcggguggagcuacuauauggccaccuuaaagaaugugacugaaguuaaaggguacacaaagggcgggccuggacaugaggaaccgauacccauggcgaccuaugguuggaaucuuguaaagcugcacuccggcguggaugucuuuuacaaaccaacggaacagguggacacccuccuaugcgauauuggggagucuucaagcaacccuacaaucgaagagggacguacucugagaaucuugaagaugguugaacccuggcuguccaguaaaccugaguucuguauuaaggugcucaauccauauaugcccaccgucauagaggaacuugagaaacugcaacgcaggcacggcgguucuuuggugcggugcccucugagcagaaacucaacacaugaaauguacuggguauccggggccaguggaaauaucgugagcucuguuaacacuauuuccaagaugcucuuaaaucgcuuuaccacaaggcaccgaaaaccaaccuaugagaaggacgucgaucugggcgcaggcacucggucagugagcacggaaacagagaagcccgacaugaccaucauugggagaaggcuucagcgccugcaggaggaacauaaagagacuuggcacuacgaucaggaaaacccguaccguaccugggcuuaucacggaucguacgaggccccuucuacagguagugcauccagcauggugaauggcgucguuaagcuacucacgaaaccaugggacgugauccccaugguaacccaacuggcuaugacugacacaaccccuuucgggcagcagcggguguuuaaggaaaaagucgauacuagaacaccacagcccaaguugggaaccaggaugauaaugacaacuaccgccaacuggcugugggcccuccuuggcaagaaaaagucaccgcgccuguguacgcgagaggaguucaucuccaaagugcggucuaaugcggcuauuggugcaguuuuccaagaggaacagggguggaccagcgccagugaagcugugaacgacuccagauuuugggaguuagucgauaaggaaagggcccugcaucaggagggaaaaugcgagagcugcguguauaauaugaugggcaagcgcgaaaagaaauugggcgaguucgggagagcaaagggaucucgggccaucugguacauguggcucggugcuagguuucuggaguucgaggcgcuaggcuuucuuaacgaagaccacugguucucacgugagaacaguugguccgggguagagggagaaggccugcaucgacucgguuauauucuggaggauaucgacaaaaaggauggggacuugauauacgccgaugacacagcaggaugggauacucgcauuaccgaagacgaucugcucaaugaggagcuuaucacagaacaaauggcuccucaccauaaaacucuggccaaggcaaucuuuaaguuaaccuaucagaacaaaguugugaagguccugagacccacgccaaaaggcgccgugauggacauuauaagccggaaggaccagaggggcucuggacaggugggaacauacgguuugaauaccuucacuaacauggagguccaacucauccgccagauggaagcugagggcguuauuacacaggaugacaugcagaauccuaaagggcugaaggaaagaguggagaaauggcuaaaggaguguggaguagaucggcuuaagaggauggccaucucgggcgacgauugcguggucaaaccccuggacgaacgauuuucaaccagccuccuguucuugaacgauauggguaaggugcguaaagacguuccacaaugggaucccuccaagggguggaaaaauuggcaggaggugccuuuuuguagucaccacuuccauaagauuuuuaugaaggacggaagaucuuuagucgugccaugccgcaaccaggaugaacugaucggccgggcgaggauaagccagggcgcaggguggucccucagagagacugccugucuuggaaaggcuuacgcccaaauguggucacugauguauuuccaccgccgggaccuaaggcuggcaaguauggcuaucugcucugccguaccgaccgaaugguuccccacaagccgaacgaccugguccauucaugcucagcaccaguggaugacuacagaggacaugcucaagguuuggaauagaguguggaucgaggauaacccuaauaugaccgacaaaacuccaguccacucaugggaagauauucccuacuuggguaagcgggaggaccugugguguggcagccuuaucgggcugucuuccagggccacaugggccaagaacauucauaccgcgauaacacaggugcgcaaucucaucggaaaggaagaguauguugauuacaugccugugaugaagcguuauagugccccaagcgaaucggagggcgucuuauga

SEQ ID NO: 15767 - RNA, 9867 nt, Artificial Sequence
  derived and/or modified CDS sequence (opt3) from DENV-4__JQ915081__SS-prME
agcaccaugacccugcucugccuuauccccacugugauggcauuccaccuguccacgagggacggcgagccuuugaugauugucgcuaagcaugaaagggggcggccauuacuguuuaagaccacagaggggauaaacaaguguacucuaaucgcaauggaucucggugaaaugugcgaggacaccguuacauacaaauguccgcugcuugugaauaccgaacccgaggauauugacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguugaaggcguuagcgggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauuuguagaagggaugucguugaccggggcuggggcaacgggugcggacuguucgguaaaggcggggugguaaccugcgcuaaguuuuuguguucuggaaaaaucacaggcaaucucgugcaaauagagaaccuggaauauacugucgugguuaccgugcauaauggugauacacacgccgucgggaacgacacuagcaaucacggcgugaccgcaacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacagcuggggccgacaccagcgaaguccacuggaauuacaaagagagaauggugacuuucaaggucccccaugcgaaaaggcaggaugugaccguucucggaucucaggaaggugccaugcacuccgcacuggcuggcgccacagagguggacucaggggauggaaaccacauguuugcuggccaucuuaaguguaagguacggauggaaaaacugcgaaucaaggguaugagcuauaccaugugcagugggaaauucucuaucgacaaggagauggccgagacucaacacggcacaacggucgugaaaguuaaguacgaaggagcaggcgccccuuguaagauuccaauagagauccgcgaugugaauaaagaaaaggucguggggagaauuaucuccagcacccccuucgcugagaacacuaacucgguaauaaauauugaguuggaaccgccuuuuggagacucuuauaucgugaucgguguuggcgauuccgcgcucacacugcauugguucaggaaagggucaaguauuggaaagauguuugagagcaccuaccggggcgcaaaacgcauggccaucuuaggugaaacagcuugggacuucggguccgucggcggacuguuuacuucucuaggcaaggccgugcaccagguguucgggagcgucuauaccacgauguuuggaggcguuucauggaugauuagaauacucaucgguuuccuggugcuuuggauugggaccaacaguaggaauacauccauggcaaugacuugcaucgccgugggaggcaucaccuuguuucuggguuucacaguacaggcugauaugggcugugucgugagcuggaacgggaaggagcucaaaugcggaucuggcauuuuuguuguggacaauguccauacuuggaccgaacaauacaaguuccagcccgagucaccagcccgucuggcaagugcgauacuuaacgcucacaaagacgggguguguggaauccggagcacgacacgacuggagaauguuauguggaagcagauuaccaacgaauugaauuaugugcucugggagggcggucacgaucugacuguagucgccggggacgugaaaggaguguuaacaaagggcaagagagcacugaccccucccgucaacgaucuaaaauacuccuggaagacuugggguaaagccaagaucuuuaccccagaagcuagaaauucuacauuccucauugacggccccgauacgucggagugcccuaacgaacgccgggccuggaauuucuuugagguugaggacuacggguucggaauguuuaccacuaacaucuggaugaaauucagagaaggcagcuccgaggugugugaucauaggcugaugucagcagcuauaaaggaccagaaagccguacacgcggauaugggguauuggaucgaaaguucuaagaaucaaacauggcagauugagaaggccagccuuaucgaagugaaaaccugcuuguggccaaagacacauacucugugguccaacggaguccucgagucacagaugcugauuccgcgcagcuacgcuggccccuuuucucagcacaacuaucgacaagguuacgcaacccagacggccgggccuuggcacuuaggaaaacuggagaucgacuucggcgaaugcccagguacaaccgugaagauacaggaggauugugaccaucggggccccucccuucguacuaccacagcuagugggaaauugguuacucaguggugcuguagaagcugcaccaugccuccacucagguuucugggagaagauggcuguugguaugggauggagauucgcccccuaucugagaaggaagagaauauggugaagucccaagucacagccggacagggcacgucagaaaccuucaguaugggucugcucugccugacucuuuuuguggaggaauguuugcggagaaggguuacacgaaaacacaugauccugguggucguaauuaccuucugcgcaaucauauuagggggacucacuuggauggaccugcuucgcgcgcugaucauguugggcgacacaaugagcggccggauugggggacagauccaucucgccauuaugaccguguuuaagaugucgccggguuacguucugggcguguuccuaagaaaacugacguccagggagacugcucucauggucaucgggauggccaugaccacaguguuuucuauaccucacgaucugauggagcuuauugacggaaucagcuugggccugaucuuacucaagauuguaacccauuucgauaacacucagguggguacacuggcacuuucacugaccuucauccguaguacaacuccccuagucauggcuuggcgcaccauuauggccguauuuuucgugauaacgcucaucccccugugucggacauccugcuugcaaaaacagucucacuggguggaaauuaccgcacugaucuuaggggcccaggcucucccugucuaucugaugacucuuaugaagggagcgagcagaagguccuggccccugaaugagggcauuauggccgugggcuugguuucacuccuggggagcgcacuacugaagaacgacguaccacuugcuggaccuaugguggccgguggccuccuguuggccgcuuacgucaugagugggucuuccgcagaucugagcuuagaaaaagccgcgaaugugcaaugggacgagauggcugauaucaccggaucgucacccauaaucgaaguuaagcaggacgaggauggcucuuuuaguauucgagacguggaggaaacaaacaugaucacucuccuggucaaacuugcccugauuaccguguccgguuuguacccacucgcaaucccgguaacgauggcccugugguauauauggcaggucaagacacagcggagcggggcucuaugggaugugccuucucccgcagccacccaaaaagcgacucugagcgagggaguuuaccgcauuaugcagagaggccuuuucggcaagacacaggugggggucggaauccacauggaagguguguuucauaccauguggcacguuacuaggggcuccgugaucugucaugagacagggcggcucgaaccaucaugggcugacguccgaaaugauaugauuaguuauggaggcgguuggagacugggggacaagugggacaaagaggaggaugugcagguauuggccauagaacccggaaagaacccucgccacgugcaaaccaaaccaggcuuauucaagacgcugacuggcgagaucggggcaguuacccucgacuuuaaacccggaacaagcgguucuccuauuaucaauaagaaaggcaaggucauugggcuguacggaaacggcguggugaccaaguccggugauuaugucucagccaucacacaggcugaaaggauaggggagccggacuacgagguagaugaagacaucuuccguaaaaagcggcuuacuauuauggaucugcauccaggagccggcaaaaccaagagaaucuugcccaguauugugagggaggcacuaaaacgccgacugagaacgcucauccuggcuccuacacggguuguggccgcggaaauggaggaagcccuuaggggcuuaccaauacgcuaucagacucccgcagucaagagcgagcacaccgggcgugagauuguggaccugaugugccacgcuacauuuaccacuagacucuuguccucuacccggguuccuaauuacaaccugaucgugauggaugaagcccauuucacagacccgugcucggucgcugcaaggggauacaucagcacgcgcguggagaugggugaagccgccgcuauuuuuaugacugcgacaccaccaggcucaaucgauccuuucccccaguccaauaguccaauagaggacauugaacgagagaucccugagagaucuuggaacacaggguucgacuggauuaccgauuaucaaggaaagacuguaugguuugugcccagcaucaaagcaggcaaugacauagccaacugucuccggaaguccgguaaaaggguuauucagcugucacgcaagacauucgauaccgaauacccaaaaacgaaacuuacugacugggauuuugucgugacaaccgacaucucugagaugggggcuaacuucagagccggcagggugaucgauccgcggcguugccugaagccugucauuuugaccgacggacccgaacgcguuauccuagcaggcccaauucccgugacuccugccagcgcugcgcagcgaagagggaggauaggacggaauccagcccaagaggaugaccaguauguauuuaguggugauccccugaaaaacgacgaagaucacgcacauuggacagaggcuaagaugcucuuagacaauaucuacaccccugagggcauuaucccgacacuguucgggccagaacgcgagaaaacucaggccaucgacggagaauuuagacuuaggggcgagcagcggaagacguucguggagcugaugcgaagaggugaucuccccgucugguuguccuauaaaguggcaagcgccgggauuucuuacaaggaccgcgaaugguguuuuaccggcgagaggaacaaucaaauacuggaagagaacauggaaguugagaucuggacacgggagggagaaaagaaaaagcuccguccuaaauggcuggaugcuagaguguaugccgaccccauggcgcuuaaggauuucaaagaguuugcaucaggcaggaaguccacuacccuagacauucugacagaaaucgccaccuugccaacuuacuuaaguagcaaggcuaaacuggcccucgauaauauugucaugcugcacacgaccgagaaagggggccgcgcuuaccagcacgcacuuaacgaacugccugagucgcucgagacauugaugcugguagcccuacugggugcuaugacugccggcaucuuccucuuuuucaugcaggggaaaggaauaggcaaacuuucuaugggucugaucgcaauugcgguggccuccggguuauuguggguugcugaaauccagccccaauggauugccgcaagcaucauacuggaguucuuucucauggugcugcuuauuccagaaccugagaaacagcggaccccgcaggacaaucagcugaucuaugucauucucacaaucuugaccauaaucggccugauugcugccaacgaaaugggauuaaucgagaagacuaaaacagauuucggcuuuuaccaagugaagacggagaccacuauucuagacgucgaucugcgacccgcaucagccuggacacucuaugcuguggcgaccaccauccuuacaccaaugcugagacauacuauagaaaauaugagugccaacuugucucuggcagcuauugccaaucaggccgcaguucucauggggcugggaaagggcuggccucuucacaggauggaccucggugugccccuguuggcuauggggugcuacucccagguaaacccaacgacccugacagccagcuuagugaugcuacugauccauuaugcgaucauuggaccuggccuccaggcuaaagccacucgcgaggcacaaaagcggaccgccgcugguaucaugaaaaaucccacagucgauggcauaaccguuauugaccuugaaccgaucucauacgacccaaaguucgagaaacagcugggacaggugauguugcugguccucugugugggacaacugcuuuuaaugagaacuacgugggcacugugcgagguacucacauuggccaccggcccuauuaucacucugugggaagggaaccccggacguuuuuggaacaccacaauagcggugaguacugcuaauaucuucaggggcagcuaucuagccggugcagggcuggccuuuucccucauuaagaacgcucagaccccacggcgcggaacaggcacgaccggugagacucuuggcgaaaaguggaaacgacagcugaacucuuuggauagaaaggaguucgaagaguacaaaaggagcgggauccuggagguugaccggacagaagccaaguccgcacuccgcgauggaucaaaaauuaagcacgcugugucuagaggcaguucgaagaucagguggauugucgagcgagggaugaucaaacccaagggaaaaguggucgaccugggcugugguagaggcggguggagcuacuauauggccaccuuaaagaaugugacugaaguuaaaggguacacaaagggcgggccuggacaugaggaaccgauacccauggcgaccuaugguuggaaucuuguaaagcugcacuccggcguggaugucuuuuacaaaccaacggaacagguggacacccuccuaugcgauauuggggagucuucaagcaacccuacaaucgaagagggacguacucugagaaucuugaagaugguugaacccuggcuguccaguaaaccugaguucuguauuaaggugcucaauccauauaugcccaccgucauagaggaacuugagaaacugcaacgcaggcacggcgguucuuuggugcggugcccucugagcagaaacucaacacaugaaauguacuggguauccggggccaguggaaauaucgugagcucuguuaacacuauuuccaagaugcucuuaaaucgcuuuaccacaaggcaccgaaaaccaaccuaugagaaggacgucgaucugggcgcaggcacucggucagugagcaucgaaacggagaagcccgacaugacaauuaucgggagaaggcuucagcgccugcaggaggaacauaaagagaccuggcacuacgaucaggaaaacccguaccguacuugggcuuaucacggaucguacgaggccccuucuaccgguagugcauccagcauggugaauggcgucguuaagcuacucacaaaaccaugggacgugauacccaugguaacgcaacuggcuaugaccgacacuacaccuuucgggcagcagcggguguuuaaggaaaaagucgauaccagaacuccacagcccaaguugggaacaaggaugaucaugaccacaacugccaacuggcugugggcccuccuuggcaagaaaaagucaccgcgccuguguacccgagaggaguucauuuccaaagugcggucuaaugcggcuaucggugcaguuuuccaagaggaacagggguggacgagcgccagugaagcugugaacgacuccagauuuugggaguuagucgauaaggaaagggcccugcaucaggagggaaaaugcgagagcugcguguauaauaugaugggcaagcgcgaaaagaaauugggcgaguucgggagagcaaagggaucucgggccauuugguacauguggcucggugcuagguuucuggaguucgaggcgcuaggcuuucuuaacgaagaccacugguucucacgugagaacaguugguccgggguagagggagaaggccugcaucgacucgguuauauccuggaggauauagacaaaaaggauggggacuugauuuacgccgaugacaccgcaggaugggauacacgcaucacugaagacgaucugcucaaugaggagcuuaucaccgaacaaauggcuccucaccauaaaacacuggccaaggcaauuuuuaaguuaacuuaucagaacaaaguugugaagguccugagacccaccccaaaaggcgccgugauggacauaaucagccggaaggaccagaggggcucuggacaggugggaacguacgguuugaauacauucaccaacauggagguccaacucauucgccagauggaagcugagggcguuaucacucaggaugacaugcagaauccuaaagggcugaaggaaagaguggagaaauggcuaaaggaguguggaguagaucggcuuaagaggauggccauuucgggcgacgauugcguggucaaaccccuggacgaacgauuuucaacaagccuccuguucuugaacgauauggguaaggugcguaaagacguuccacaaugggaucccuccaagggguggaaaaauuggcaggaggugccuuuuuguagucaccacuuccauaagaucuuuaugaaggacggaagaucuuuagucgugccaugccgcaaccaggaugaacugauaggccgggcgaggaucagccagggcgcaggguggucccucagagagaccgccugucuuggaaaggcuuacgcccaaauguggucacugauguauuuccaccgccgggaccuaaggcuggcaaguauggcuauuugcucugccguaccgacugaaugguuccccaccagccgaacaacgugguccauccaugcucagcaccaguggaugaccacugaggacaugcucaagguuuggaauagaguguggauugaggauaacccuaauaugacagacaaaaccccaguccacucaugggaagauauccccuacuuggguaagcgggaggaccugugguguggcagccuuauugggcugucuuccagggccacuugggccaagaacauacauacagcgaucacccaggugcgcaaucucauuggaaaggaagaguauguugauuacaugccugugaugaagcguuauagugccccaagcgaaucggagggcgucuuauga

SEQ ID NO: 15768 - RNA, 9867 nt, Artificial Sequence
  derived and/or modified CDS sequence (opt3) from DENV-4__JQ915084__SS-prME
agcaccaugacucugcucugccuuauccccacugugauggccuuccaccuguccacgagggacggcgagccuuugaugauugucgcuaagcaugaaagggggcggccauuacuguuuaagaccaccgagggaauaaacaaguguacucuaaucgcaauggaucucggugaaaugugcgaggacaccguuacguacaaguguccgcugcuugugaauaccgaacccgaggauauugacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaagcaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguugaaggcguuagcgggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauuuguagaagggaugucguugaccggggcuggggcaacgggugcggacuguucgguaaaggcggggugguaaccugcgcuaaguuuuuguguucuggaaaaaucacaggcaaucucgugcaaauagagaaccuggaauauacugucgugguuaccgugcauaauggugauacacacgccgucgggaacgacacuagcaaucacggcgugaccgcaacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacagcuggggccgacaccagcgaaguccacuggaauuacaaagagagaauggugacuuucaaggucccccaugcgaaaaggcaggaugugaccguucucggaucucaggaaggugccaugcacuccgcacuggcuggcgccacagagguggacucaggggauggaaaccacauguuugcuggccaucuuaaguguaagguacggauggaaaaacugcgaaucaaggguaugagcuauaccaugugcagugggaaauucucuaucgacaaggagauggccgagacucaacacggcacaacggucgugaaaguuaaguacgaaggagcaggcgccccuuguaagauuccaauagagauccgcgaugugaauaaagaaaaggucguggggagaauuaucuccagcacccccuucgcugagaacacuaacucgguaauaaauauugaguuggaaccgccuuuuggagacucuuauaucgugaucgguguuggcgauuccgcgcucacacugcauugguucaggaaagggucaaguauuggaaagauguuugagagcaccuaccggggcgcaaaacgcauggccaucuuaggugaaacagcuugggacuucggguccgucggcggacuguuuacuucucuaggcaaggccgugcaccagguguucgggagcgucuauaccacgauguuuggaggcguuucauggaugauuagaauacucaucgguuuccuggugcuuuggauugggaccaacaguaggaauacauccauggcaaugacuugcaucgccgugggaggcaucaccuuguuucuggguuucacaguacaggcugauaugggcugugucgugagcuggaacgggaaggagcucaaaugcggaucuggcauuuuuguuguggacaauguccauacuuggaccgaacaauacaaguuccagcccgagucaccagcccgucuggcaagugcgauacuuaacgcucacaaagacgggguguguggaauccggagcacgacacgacuggagaauguuauguggaagcagauuaccaacgaauugaauuaugugcucugggagggcggucacgaucugacuguagucgccggggacgugaaaggaguguuaacaaagggcaagagagcacugaccccucccgucaacgaucuaaaauacuccuggaagacuugggguaaagccaagaucuuuaccccagaagcuagaaauucuacauuccucauugacggccccgauacgucggagugcccuaacgaacgccgggccuggaauuucuuugagguugaggacuacggguucggaauguuuaccacuaacaucuggaugaaauucagagaaggcagcuccgaggugugugaucauaggcugaugucagcagcuauaaaggaccagaaagccguacacgcggauaugggguauuggaucgaaaguucuaagaaucaaacauggcagauugagaaggccagccuuaucgaagugaaaaccugcuuguggccaaagacacauacucugugguccaacggaguccucgagucacagaugcugauuccgcgcagcuacgcuggccccuuuucucagcacaacuaucgacaagguuacgcaacccagacggccgggccuuggcacuuaggaaaacuggagaucgacuucggcgaaugcccagguacaaccgugaagauacaggaggauugugaccaucggggccccucccuucguacuaccacagcuagugggaaauugguuacucaguggugcuguagaagcugcaccaugccuccacucagguuucugggagaagauggcuguugguaugggauggagauucgcccccuaucugagaaggaagagaauauggugaagucccaagucacagccggacagggcacgucagaaaccuucaguaugggucugcucugccugacucuuuuuguggaggaauguuugcggagaaggguuacacgaaaacacaugauccugguggucguaauuaccuucugcgcaaucauauuagggggacucacuuggauggaccugcuucgcgcgcugaucauguugggcgacacaaugagcggccggauugggggacagauccaucucgccauuaugaccguguuuaagaugucgccggguuacguucugggcguguuccuaagaaaacugacguccagggagacugcucucauggucaucgggauggccaugaccacaguguuuucuauaccucacgaucugauggagcuuauugacggaaucagcuugggccugaucuuacucaagauuguaacccauuucgauaacacucagguggguacacuggcacuuucacugaccuucaugcguaguacaacuccccuggucauggcuuggcgcaccaucauggccguauuuuucgugauuacgcucauaccccugugucggacauccugcuugcaaaaacagucucacuggguggaaaucaccgcacugauuuuaggggcccaggcucucccugucuaucugaugacucuuaugaagggagcgagcagaagguccuggccccugaaugagggcaucauggccgugggcuugguuucacuccuggggagcgcacuacugaagaacgacguaccacuugcuggaccuaugguggccgguggccuccuguuggccgcuuacgucaugagugggucuuccgcagaucugagcuuagaaaaagccgcgaaugugcaaugggacgagauggcugauauuaccggaucgucacccaucauagaaguuaagcaggacgaggauggcucuuuuaguauccgagacguggaggaaacaaacaugauuacucuccuggucaaacuugcccugaucaccguguccgguuuguacccacucgcaauuccgguaacgauggcccugugguauaucuggcaggucaagacacagcggagcggggcucuaugggaugugccuucucccgcagccacccaaaaagcgacucugagcgagggaguuuaccgcauaaugcagagaggccuuuucggcaagacacaggugggggucggcauucacauggaagguguguuucauaccauguggcacguuacuaggggcuccgugaucugucaugagacagggcggcucgaaccaucaugggcugacguccgaaaugauaugaucaguuauggaggcgguuggagacugggggacaagugggacaaagaggaggaugugcagguauuggccauugaacccggaaagaacccucgccacgugcaaaccaaaccaggcuuauucaagacgcugacuggcgagauaggggcaguuacccucgacuuuaaacccggaacaagcgguucuccuaucauuaauaagaaaggcaaggucaucgggcuguacggaaacggcguggugaccaaguccggugauuaugucucagccauuacacaggcugaaaggaucggggagccggacuacgagguagaugaagacauauuccguaaaaagcggcuuacuaucauggaucugcauccaggagccggcaaaaccaagagaauuuugcccaguaucgugagggaggcacuaaaacgccgacugagaacgcucauucuggcuccuacacggguuguggccgcggaaauggaggaagcccuuaggggcuuaccaauccgcuaucagacucccgcagucaagagcgagcacaccgggcgugagauaguggaccugaugugccacgcuacauuuaccacuagacucuuguccucuacccggguuccuaauuacaaccugauugugauggaugaagcccauuucacagacccgugcucggucgcugcaaggggauacaucagcacgcgcguggagaugggugaagccgccgcuaucuuuaugacugcgacaccaccaggcucaauugauccuuucccccaguccaauaguccaaucgaggacauagaacgagagauuccugagagaucuuggaacacaggguucgacuggaucaccgauuaucaaggaaagacuguaugguuugugcccagcauuaaagcaggcaaugacaucgccaacugucuccggaaguccgguaaaaggguuauacagcugucacgcaagacauucgauaccgaauacccaaaaacgaaacuuacugacugggauuuugucgugacaaccgacauuucugagaugggggcuaacuucagagccggcagggugaucgauccgcggcguugccugaagccugucaucuugaccgacggacccgaacgcguuauucuagcaggcccaauccccgugacuccugccagcgcugcgcagcgaagagggaggauuggacggaauccagcccaagaggaugaccaguauguauuuaguggugauccccugaaaaacgacgaagaucacgcacauuggacagaggcuaagaugcucuuagacaauauauacaccccugagggcaucauuccgacacuguucgggccagaacgcgagaaaacucaggccaucgacggagaauuuagacuuaggggcgagcagcggaagacguucguggagcugaugcgaagaggugaucuccccgucugguuguccuauaaaguggcaagcgccgggaucucuuacaaggaccgcgaaugguguuuuaccggcgagaggaacaaucaaauucuggaagagaacauggaaguugagauauggacacgggagggagaaaagaaaaagcuccguccuaaauggcuggaugcuagaguguaugccgaccccauggcgcuuaaggauuucaaagaguuugcaucaggcaggaaguccacuacccuagacauccugacagaaauugccaccuugccaacuuacuuaaguagcaaggcuaaacuggcccucgauaauaucgucaugcugcacacgaccgagaaaggugggcgcgcuuaccagcacgcacuuaacgaacugccugagucgcucgagacauugaugcugguagcccuacugggggcuaugacugccggcauuuuccucuuuuucaugcaggggaaaggaaucggcaaacuuucuaugggucugauagcaaucgcgguggccuccggguuauuguggguugcugaaauucagccccaauggaucgccgcaagcauuauccuggaguucuuucucauggugcugcuuauaccagaaccugagaaacagcggaccccgcaggacaaucagcugauuuaugucauccucacaauuuuggcuaucauaggccugaucgccgcaaacgaaaugggauuaauugagaagaccaaaacugauuucggcuuuuaccaagugaagacagagacgaccauccuagacgucgaucugcgacccgccucagcuuggacucucuaugcgguggccacaaccauucuuaccccaaugcugagacauacaaucgaaaauacaagugcaaacuugucucuggcugccauagccaaucaggcagcuguucucauggggcugggaaagggcuggccucuucacaggauggaccucggugugccccuguuggccauggggugcuacucccagguaaacccaacgacccugacagcgagcuuagugaugcuacugauucauuaugcuaucaucggaccuggccuccaggccaaagcaacucgcgaggcccaaaagcggaccgcugcagguauuaugaaaaaucccacagucgauggcaucaccguuauagaccuugaaccgauuucauacgacccaaaguucgagaaacagcugggacaggugauguugcugguccucugugugggacaacugcuuuuaaugagaacuacgugggcccugugcgagguacucacauuggcgaccggcccuaucaugacucugugggaagggaaccccggacguuuuuggaacaccacaauugcugugaguacugccaauaucuucaggggcagcuaucuagccggugcagggcuggcuuuuucccucauaaagaacgcccagaccccacggcgcggaacaggcacgaccggugagacucuuggcgaaaaguggaaacgacagcugaacucuuuggauagaaaggaguucgaagaguacaaaaggagcgggauccuggagguugaccggacagaagcaaaguccgcucuccgcgauggaucaaaaauuaagcacgccgugucuagaggcaguucgaagaucagguggauugucgagcgagggaugaucaaacccaagggaaaaguggucgaccugggcugugguagaggcggguggagcuacuauauggcgaccuuaaagaaugugacugaaguuaaaggguacacaaagggcgggccuggacaugaggaaccgauucccauggccaccuaugguuggaaucuuguaaagcugcacuccggcguggaugucuuuuacaaaccaacggaacagguggacacccuccuaugcgauaucggggagucuucaagcaacccuacaauagaagagggacguacucugagaauuuugaagaugguugaacccuggcuguccaguaaaccugaguucuguaucaaggugcucaauccauauaugcccaccgucaucgaggaacuugagaaacugcaacgcaggcacggcgguucuuuggugcggugcccucugagcagaaacucaacacaugaaauguacuggguauccggggcaaguggaaauauugugagcucuguuaacacuauauccaagaugcucuuaaaucgcuuuaccacaaggcaccgaaaaccaaccuaugagaaggacgucgaucugggcgcuggcacucggucagugagcacggaaacagagaagcccgacaugaccaucauugggagaaggcuucagcgccugcaggaggaacauaaagagacuuggcacuacgaucaggaaaacccguaccguaccugggccuaucacggaucguacgaggcaccuucuacagguagugcuuccagcauggugaauggcgucguuaagcuacucacgaaaccaugggacgugauccccaugguaacccaacuggccaugacugacacaaccccuuucgggcagcagcggguguuuaaggaaaaagucgauacuagaacaccacagcccaagauuggaaccaggaugaucaugacaacuaccgccaacugguugugggcgcugcucggcaagaaaaagucaccgcgccuuuguacgcgagaggaguucauauccaaagugcggucuaaugcugcaaucggugccguuuuccaagaggaacagggguggaccagcgcuagugaagccgugaacgacuccagauuuugggagcuggucgauaaggaaagggcauuacaucaggagggaaaaugcgagagcugcguguauaauaugaugggcaagcgcgaaaagaaacugggcgaguucgggagagccaagggaucucgggcuauuugguacaugugguugggugcgagguuucucgaguucgaggcccugggcuuucuaaacgaagaccacugguucucacgugagaacaguugguccgggguagagggagaaggccuucaucgacuggguuauauccucgaggauauugacaaaaaggauggggaccugaucuacgcagaugacacagcuggaugggauacucgcauaaccgaagacgauuugcugaaugaggagcucauuacagaacaaauggccccucaccauaaaacucuugcaaaggccaucuuuaagcugaccuaucagaacaaaguugugaaggucuuaagacccacgccaaaaggcgcugugauggacaucauuagccggaaggaccagaggggcucuggacaggugggaacauacggucugaauaccuucacuaacauggagguccaauugauacgccagauggaagccgagggcguuaucacacaggaugacaugcagaauccuaaagggcucaaggaaagaguggagaaauggcugaaggaguguggaguagaucggcuaaagaggauggcgauuucgggcgacgauugcguggucaaaccccuugacgaacgauuuucaaccagccuacucuuccugaacgauauggguaaggugcguaaagacguuccacaaugggagcccuccaagggguggaaaaauuggcaggaagugccuuuuuguagucaccacuuccauaagaucuuuaugaaggauggaagaucuuuggucgugccaugccgcaaccaggacgaguuaauuggccgggcaaggaucagccagggcgccggguggucccugagagaaacugcuugucucggaaaagccuacgcacaaauguggucacuuauguauuuccaccgccgggaucugaggcuagcuaguauggccauaugcucugcuguaccgaccgagugguuccccacaagccgaacgaccugguccauccaugcccagcaccaguggaugacuacagaggacaugcugaagguuuggaauagaguguggauugaagacaacccuaauaugaccgauaaaacuccaguccacucaugggaggacauccccuaccucgguaagcgggaagauuugugguguggcagccugauugggcuuucuuccagggcaacaugggcgaaaaacauccauaccgccauuacacaggugcgcaaucugauaggaaaggaggaauauguugacuacaugccugugaugaagcguuauaguagcccaucggaguccgagggcguccucuga

SEQ ID NO: 15769 - RNA, 9867 nt, Artificial Sequence
  derived and/or modified CDS sequence (opt3) from DENV-4__KM190936__SS-prME
agcaccaucacacugcucugccuuauucccacugugauggccuucucccugucuacgagagacggcgagccuuugaugauagucgcuaagcacgaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucaacauggguaauguauggcaccugcacgcagaguggggagcgccgacgugaaaagagaagcguggccuugacuccucauuccggaaugggccucgagaccagggcggaaacauggaugucuucggagggugcuuggaaacacgcccaacgggucgagucauggauucugcgcaauccaggguucgcacugcucgccggauuuauggcuuacaugaucggccagacuggcauacagagaaccguguucuuuguuuuaaugaugcugguggcacccagcuaugggaugaggugugucggaguggguaaccgggauuucguagaaggcguuagugggggagccuggguggaccuugucuuggagcauggcgguugcgugacaaccauggcucaggggaagccuacgcuggauuuugaacuaacuaagacaaccgccaaagagguggcgcuccugcgcacuuacuguaucgaagcauccauuucuaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuagcuguuccggaaaaaucacuggcaauuuggugcaaauagagaaccucgaauauaccgucgugguuacagugcacaauggugauacucaugccgucgggaacgacaccucaaaucacggcgugacagcaaugauuaccccucguaguccaagcguagagguuaagcugccggauuacggagaauuaacucuggacugcgagccccgcucuggcaucgacuucaacgagaugauucucaugaagaugaaaaagaaaacguggcuugugcacaagcagugguuucuggauuugccucuaccauggacagcuggggccgacaccuccgaaguccauuggaauuacaaagagagaauggugacuuucaaggucccccacgcgaaaaggcaggaugugaccguucugggaucacaggaaggugccaugcauagcgcacucgcuggcgccacagagguggacaguggggauggaaaccacauguuugcuggccaccugaaguguaagguacggauggaaaaacuucgaaucaaggguaugucuuauaccaugugcuccgggaaauucagcaucgacaaggagauggccgagacucaacauggcacaacggucgugaaaguuaaguacgaaggagcaggcgccccuuguaaggugccaauugagauacgcgaugucaauaaagaaaaggugguagggagaaucauuucgucuaccccccuggcugagaacacuaacuccgugacaaauaucgaguuggaaccgccuuucggagacucauauauaguuauuggugucggcaacagugcgcucacccugcacugguuuaggaaagggagcuccaucggaaagauguucgagucuacauaccggggcgcaaaacgcauggccaucuuaggugaaacugcuugggauuuugggagcgugggcggacuguucaccucacuaggcaaggccgugcaucaggucuuugggaguguuuauacgaccauguucggaggcguguccuggaugauuagaauccucauugguuuucuggugcuuuggauagggacaaauagcaggaacacuucuauggcaaugaccugcaucgccguaggaggcauuacauuguuccuggguuuuacuguccaggcugacaugggcugugugguuucauggagugggaaggagcucaaaugcggaagcggcaucuucguggucgauaaugugcacaccuggacggaacaauacaaguuucagcccgaguccccagcccgucuggcaucugcgauccuuaacgcucauaaagacgggguuuguggaauucggucgacaacccgacuggagaaugugauguggaagcagauaacuaacgaauugaauuauguacucugggagggcggucacgaccugacagucguggccggggaugugaaaggagucuuaaccaagggcaagagagcacugacuccucccguuagcgaccuaaaauacuccuggaagaccugggguaaagccaagaucuucacaccagaagcuaggaacucaacguuucucauugauggccccgacaccagugagugcccuaaugaacgccgggccuggaacucucuggagguggaggauuacggguucggaauguucacuacaaauaucuggaugaaauuuagagaaggcagcuccgagguaugugaccacaggcuuaugucagcagcuauuaaggaucagaaagccgugcaugcggacaugggguauuggaucgaaagcucuaagaaccaaaccuggcagauagagaaggccuccuugaucgaagucaaaacaugccuguggccaaagacucacacccucuggaguaauggagugcuggagagccagauguuaauuccgaaaucuuacgcuggccccuucucccagcauaacuaucgccaagguuacgcaacgcagacaguugggccuuggcaccugggaaagcuugagaucgauuuuggcgaaugcccagguaccacugugaccauucaggaggacugugaucaccgaggccccucauugcggacaacuaccgccagugggaaacucgucacacaguggugcugucguagcugcacgaugccuccacugagauuccuaggagaagacggcuguugguaugggauggagaucaggccccugucggagaaggaagagaacauggugaagucccaaguuaccgcuggacagggcacuucugaaacauuuagcaugggucuccugugccuuaccuuguucguggaggaaugucugcgccggagagucacuaggaaacauaugauauuaguagugguuauuacacucugcgccaucauucuggggggacuuaccuggauggaucuguugcgagcacucaucaugcugggcgacacgaugucaggccgcauagggggacagauccaccuagcgauuauggccguguuuaagaugaguccggguuacguccugggcguguuccuccggaaacugacuuccagagagaccgcucuuaugguaaucgggauggccaugacaaccguguugucuauuccucaugaccugauggaguuaaucgauggaauaagccucggccugauucuucugaagaucgucacucaguuugacaauacacaaguugguacccuagcacucucccugacauucaucaggucaacuaugccauuggugauggcuuggcguaccauuauggccgugcuguuugucgugacguuaaucccccucugucgcacaagcugccugcagaaacagagucacuggguugaaauuaccgcacuuauacugggggcccaagcuuugccuguauaucucaugacucugaugaagggagcgucucggagauccuggccccuaaacgagggcaucauggccgugggccuggucagccuucucgggucggcacuguugaagaaugaugugccacuggcuggaccuaugguugccgguggcuuacuccuggccgcuuacgugaugucagggucuagugcagaccuuucccuggaaaaagccgcgaacguccagugggaugagauggcugacauuaccggaagcucucccaucauugaagugaagcaggaugaggacggcagcuucuccaucagggauguagaggaaacaaauaugauaacuuugcucgucaaacuggcccuaaucaccgugucaggucuguacccacuugcaauuccgguuacgaugacacucugguauauguggcaggugaagacccaacgaaguggggcccugugggacgucccuagccccgcugcaacucagaaagccgcguugucugagggaguguaccggaucaugcagcgcggcuuauuuggcaagacacagguuggggugggaauucauauggaaggugucuuccacaccauguggcacgugacuagaggcuccguaaucugucaugagacagggaggcuggaaccaucaugggcugaugugcggaacgacaugauaaguuauggaggcgguuggcgacucggggauaagugggacaaagaggaggacguucaaguccuggccauugaacccggaaagaauccuaaacacgugcagaccaagccaggccuuuucaaaacgcugacuggcgagaucggggcagugaccuuggauuuuaagcccggaacaagcgguuccccuaucauuaacagaaaaggcaaggucauagggcuauacggaaauggcguagugaccaagucuggugacuauguuucggccaucacacaggcugaacgcauuggggagccggauuacgagguggacgaagauaucuucaggaaaaagcgucugacuauuauggaccuccauccaggagccggcaaaaccaagcggauccugcccagcauagucagagaggcacuuaaaaggcgcuuacgaacgcugauccucgcuccuacaagagugguugccgcggaaauggaggaagccuugcggggccugccaauuagguaucagacucccgcagugaagucagagcacaccgggcgcgagaucgucgaucucaugugccaugcuacauuuaccacucgucugcuuuccaguaccagagugccuaacuacaaucugauuguaauggacgaagcccacuucacagauccgucuagcguggcugcacggggauacaucuccacgaggguugagaugggugaagccgccgcuauauuuaugacugcgacccccccaggcgcaacagacccuuucccccaaucaaacucuccaauugaggauaucgaacgcgagaucccugagcgaagcuggaauaccggguuugacuggauuacugacuaucagggaaagacagucugguucgugcccaguaucaaagccggcaacgauauagcuaauugcuugagaaaguccgguaaaaaggugauucagcuaagccggaaaaccuuugacacggaauacccaaagacuaagcugacagauugggacuucgucguuaccaccgauaucucugagaugggggccaacuuuagggcaggccgcgugauugacccgagaaggugucucaaaccuguaaucuuaacugauggacccgaacgggugauacuggccggcccaauucccgucacaccugcuucagcggcccaacgucgcgggcgaaucggaagaaacccagcacaggaggacgaucaguauguguucuccggugacccccuuaagaaugaugaagaccacgcucauuggaccgaggccaaaaugcugcucgauaacaucuacacaccugagggcauuaucccgacuuuguucgggccagaaagggagaagacgcaggcaauugacggagaauuucggcugcgcggcgagcaaagaaaaaccuucguugagcucaugaggcggggugaccugcccguguggcuuaguuauaaggucgccagcgcugggauaucguacaaggaucgagaauggugcuuuacaggcgagagaaauaaccagauccuagaagagaauauggaaguagagauuuggacucgcgagggagaaaaaaagaaacugaggccucggugguuggacgcccguguguaugcggaucccauggcauuaaaggacuucaaagaguuugccucuggcagaaaguccaucacccuggauauccucacagaaauugcuagccugccaaccuaccuuucaaguagggccaagcuggcucucgacaacauaguuauguugcacacuacggagcgcgggggacgggcauaccagcaugcccugaaugaacuaccugagucucuggagacccucaugcuuguggcucuguuaggugccaugacagcaggcaucuucuuguuuuucaugcaggggaaaggaauuggcaagcuguccaugggucucaucacuauugcggucgccagcgggcugcuuuggguggcugaaauccaaccccaguggauagccgcaucaaucauucuggaguuuuuccucauggucuugcugaucccagaaccugagaaacagcgaaccccgcaggauaaccaauuaauuuaugugauccuaacaauacugaccauuaucggccucauugcugccaaugaaaugggacuuaucgagaagacuaaaacagacuuuggcuucuaccagguuaagacggagaccacuauacuggauguggacuugagacccgcaagugccuggacacuguaugcuguagcgaccaccauccucacaccaaugcugaggcacacuauugaaaacacgagcgccaaucuuucccucgcagcuaucgccaaccaggccgcagugcugaugggguugggaaaaggcuggccucugcaccgcauggauuuaggugucccccuacuggcuaugggguguuacucucagguuaauccaaccacacucacugccagccuugugaugcuguugguccauuaugcgauuaucggaccuggccugcaagcuaaggccacccgggaggcacagaagagaacagccgcugguauaaugaaaaaccccaccguggacggcauuacuguaaucgaucucgaaccgaucuccuacgacccaaaguuugagaaacagcuggggcaagugaugcuuuuaguucugugcgcaggacagcucuugcugaugcguacgacaugggccuucugugaggugcuaacccuggcgacuggcccuauucucacccuuugggaagggaaucccggaagguucuggaacacaacuaucgcugucucaaccgccaacauauuucggggcucuuaucuggcaggugccggguuggcuuucagucugauuaagaaugcccagacaccacgccgaggaacgggcaccacuggugagacacucggcgaaaaauggaagagacagcugaacucguuagacaggaaggaguuugaagaguacaaacggagcgggauccuugagguggaucgcaccgaagcaaaguccgcucugaaagacggaucuaagauuaaacacgccgucucaagaggcagcuccaagaucagguggauaguggagcgagggaugguuaagcccaaaggaaagguaguggaucucggcugcggucgggggggauggaguuacuauauggcgacucuaaaaaaugucacagaagugaagggcuacaccaaaggcgggccuggacaugaggaaccgauccccauggccacguaugguuggaaccugguuaaguugcacucuggcguggacgucuucuacaagccaaccgagcaaguggauacacugcucugugacauuggggagagcucauccaauccuacuaucgaagagggacguacccuuagaguacugaaaaugguggaacccugguugaguagcaagccugaguuuugcauuaaaguucugaacccauauaugcccacagucaucgaagagcucgagaaguuacagcgcaaacauggcgguaaucuggugagguguccucuuucucggaacuccacucacgaaauguacugggugucaggggcaagcggaaauauugucucgucuguuaacaccacaaguaagaugcugcuaaauagauucaccacucgccacaggaaaccaacguaugagaaggauguggaccucggcgcuggcacacgauccguaagcaccgaaacugagaagcccgauaugaccaucauagggcggagacugcagagguugcaggaggaacauaaagagacauggcacuacgaccaagaaaacccguaccgcacgugggccuaucauggaucauacgaggcaccuuccaccgguucugcuagcaguauggugaauggcgucgugaagcugcucacuaaaccaugggauguuauucccauggugacacagcuugccaugaccgacacuacaccuuuugggcagcagcgugucuucaaggaaaaaguggacacccggacaccacaacccaagccgggaacuagaaugguaaugaccacgaccgccaacuggcugugggcguuacugggcaagaaaaagaauccuagguugugcacacgcgaggaguuuaucuccaaaguucgaagcaacgcugcaaucggugccguguuccaggaagagcagggguggacuucugcuucagaagccgucaaugauagucgguuuugggagcucguggacaaggaaagagcacugcaccaagagggaaaaugugaguccugcguguauaacaugaugggcaagagggaaaagaaacuaggcgaguucgggcgcgccaagggaagcagagcuauuugguacauguggcuuggugcgcgguuucuggaauucgaggcccucggcuuccugaacgaagaucacugguuugggagggagaauucuuggucgggagucgagggcgaagguuugcaucgucugggguauauacucgaggaaaucgacaaaaaggauggagaccuuauguacgcagaugacaccgcuggcugggauacacgaauuacugaggacgaucugcagaacgaggaauuaaucaccgagcagauggccccccaccauaaaauucuggcaaaggccaucuucaaguugacguaucagaauaaaguugugaagguacuccgcccaacaccuagaggcgcugugauggacauaaucucacggaaagaucaaagggggagcggacaggucgguaccuacggccugaacacuuuuacaaauauggaagugcagcuaauucgccagauggaggccgaagggguuaucacccaagacgacaugcagaaccccaagggacuuaaagagagaguggagaaguggcugaaagaaugcggcgucgaucggcucaagaggauggcgauuuccggugacgauugugugguaaagccacuggacgagcgauucgggacuaguuuguuauuucugaaugauaugggaaaaguucguaaggacaucccccagugggaaccuucuaaaggcuggaagaacuggcaggaggugccauucugcagccaccauuuucacaaaauauucaugaaggauggcagaucccucgucgugccgugucgcaaucaagacgaacuuauugggcgggcaaggaucucacagggagccgguuggagucugagagagaccgcuugccuaggcaaggccuacgcacagauguggucucugauguauuuucaccgccgggaucucagguuggcuagcauggccaucuguuccgcuguucccacagagugguucccuacgucacgaaccacuuggagcauucaugcccaccaucaguggaugacaaccgaagacaugcugaaaguguggaacagagucuggauagaggauaauccaaacaugacugacaagacacccgugcacucuugggaagacaucccuuaccuugggaaacgggaggaucuguggugcggaucccucauuggcuuaaguagcagggcaaccugggcgaagaauauccacacggccauuacacaaguacgcaaccugaucgguaaagaagaguauguggacuacaugccagucaugaagcguuauucggcucccuccgagucugaagggguuuuguga

SEQ ID NO: 15770 - RNA, 9867 nt, Artificial Sequence
  derived and/or modified CDS sequence (opt3) from DENV-4__JQ915090__SS-prME
agcaccaugacacugcucugccuuaucccaacugugauggccuuccaccuguccacgagggacggcgagccuuugaugauugucgcuaagcaugaaagggggcggccauuacuguuuaagaccacagaggggauaaacaaguguacucuaaucgcaauggaucucggugaaaugugcgaggacaccguuacauacaaguguccgcugcuugugaauaccgaacccgaggauauugacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaagcaugcccaacgggucgagucguggauccugcgcaauccaggguucgcacugcucgccggauuuauggcuuacaugauuggccagacuggcauccagagaauaguguucuuuguuuuaaugaugcugguggcacccucauaugggaugaggugugucggaguggguaaccgggauuucguugaaggcguuagcgggggagccuggguggaccuugucuuggagcacggcgguugcgugaccacaauggcucaggggaagccuacccuggauuuugaacuagccaagacgacugcgaaagagguggcacuccugcgcacauacuguaucgaagccaguauuuccaauaucaccacugcuacacgaugcccaacccaaggagagcccuaucuuaaggaggaacaggaccagcaguacauuuguagaagggaugucguugaccggggcuggggcaacgggugcggacuguucgguaaaggcggggugguaacgugcgccaaguuuuuguguucuggaaaaaucaccggcaaucucgugcaaauagagaaccuggaauauacagucgugguuacugugcauaauggugauacccacgcagucgggaacgacacaagcaaucacggcgugacugcuaccauuacaccucguuccccaucaguagagguuaaguuaccggauuacggagaacugacccucgacugcgagccccgcaguggcaucgacuucaacgagaugauucuuaugaagaugaaaaagaaaacuuggcuggugcauaagcagugguuuuuggaucuaccucugccauggacggccggggcggacacaagcgaaguccacuggaauuacaaagagagaauggugaccuucaaggucccccaugccaaaaggcaggaugugacuguucucggaucucaggaaggugcaaugcacuccgcucuggccggcgcuaccgagguggacucaggggauggaaaccacauguuugccggccaucuuaaguguaagguacggauggaaaaacugcgaaucaaggguaugagcuauacaaugugcagugggaaauucucuaucgacaaggagauggcagagacccaacacggcacuacagucgugaaaguuaaguacgaaggagccggcgcuccuuguaagauuccaauagagauccgcgaugugaauaaagaaaaggucguggggagaauuaucuccagcacgcccuucgcggagaacaccaacucgguaauaaauauugaguuggaaccgccuuuuggagacucuuauaucgugaucgguguuggcgauuccgcacucacucugcauugguucaggaaagggucaaguauuggaaagauguuugagagcacauaccggggcgccaaacgcauggcuaucuuaggugaaaccgccugggacuucggguccgucggcggacuguuuacaucucuaggcaaggcagugcaccagguguucgggagcgucuauacuaccauguuuggaggcguuucauggaugauuagaauacucaucgguuuccuggugcuuuggauugggacgaacaguaggaauaccuccauggccaugacaugcaucgcugugggaggcaucacuuuguuucuggguuucaccguacaggccgauaugggcugugucgugagcuggaacgggaaggagcucaaaugcggaucuggcauuuuuguuguggacaauguccauacauggacugaacaauacaaguuccagcccgagucaccagcacgucuggcgagugcuauacuuaacgcccacaaagacgggguguguggaauccggagcaccacgcgacuggagaauguuauguggaagcagauuacaaacgaauugaauuaugugcucugggagggcggucacgaucugaccguagucgcaggggacgugaaaggaguguuaacuaagggcaagagagcccugacaccucccgucaacgaucuaaaauacuccuggaagaccugggguaaagcuaagaucuuuacuccagaagccagaaauucuaccuuccucauugacggccccgauacaucggagugcccuaacgaacgccgggcauggaauuucuuugagguugaggacuacggguucggaauguuuacgaccaacaucuggaugaaauucagagaaggcagcuccgaggugugugaucauaggcugaugucagcugccauaaaggaccagaaagcgguacacgccgauaugggguauuggaucgaaaguucuaagaaucaaacuuggcagauugagaaggcuagccuuaucgaagugaaaacaugcuuguggccaaagacccauacacugugguccaacggaguccucgagucacagaugcugauuccgcgcagcuacgcaggccccuuuucucagcacaacuaucgacaagguuacgccacucagaccgcugggccuuggcacuuaggaaaacuggagaucgacuucggcgaaugcccagguacgacagugaagauacaggaggauugugaccaucggggccccucccuucguaccacuaccgccagugggaaauugguuacacaguggugcuguagaagcugcacuaugccuccacucagguuucugggagaagauggcuguugguaugggauggagauucgcccccuaucugagaaggaagagaauauggugaagucccaagucaccgcaggacagggcacaucagaaacguucaguaugggucugcucugccugacccuuuuuguggaggaauguuugcggagaaggguuacucgaaaacacaugauccugguggucguaauuacauucugcgcgaucauauuagggggacucaccuggauggaccugcuucgcgcccugaucauguugggcgacacuaugagcggccggauugggggacagauccaucucgcuauuaugacaguguuuaagaugucgccggguuacguucugggcguguuccuaagaaaacugaccuccagggagacggcccucauggucaucgggauggcaaugacuaccguguuuucuauaccucacgaucugauggagcuuauugacggaaucagcuugggccugaucuuacucaagauuguaacacauuucgauaacacccagguggguacucuggcucuuucacugacauucaugcguaguaccacaccccuagucauggccuggcgcacuaucauggcaguauuuuucgugauuacccucauaccccugugucggacguccugcuugcaaaaacagucucacuggguggaaaugacagcccugaucuuaggggcucaggcgcucccugucuaucugaugacccuuaugaagggagccagcagaagguccuggccccugaaugagggcauuauggcagugggcuugguuucacuccuggggagcgcucuacugaagaacgacguaccacuugccggaccuaugguggccgguggccuccuguuggcugcauacgucaugagugggucuuccgccgaucugagcuuagaaaaagcggcuaaugugcaaugggacgagauggccgauaucacuggaucgucacccauuaucgaaguuaagcaggacgaggauggcucuuuuaguauacgagacguggaggaaaccaacaugaucacacuccuggucaaacuugcacugauuacuguguccgguuuguacccacucgccaucccgguaaccauggcucugugguauauuuggcaggucaagacgcagcggagcggggcacuaugggaugugccuucucccgccgcgacacaaaaagcuacccugagcgagggaguuuaccgcaucaugcagagaggccuuuucggcaagacucaggugggggucggaauacacauggaagguguguuucauacaauguggcacguuaccaggggcuccgugauuugucaugagacugggcggcucgaaccaucaugggccgacguccgaagugauaugaucagcuauggaggcgguuggagacugggggacaagugggacaaagaggaggaugugcagguauuggcaaucgaacccggaaagaauccucgccacgugcaaacaaaaccaggcuuauucaagacccugacgggcgagauuggggccguuacucucgacuuuaaacccggaaccucugguuccccuauaaucaacaagaaaggcaaggucauugggcuguacggaaauggcguggugacaaagucaggugauuaugucagugcuaucacccaggccgaaaggauuggggagccggacuacgagguagaugaagacaucuuccguaaaaagcggcuuacaauaauggaucugcauccaggagcaggcaaaacuaagagaaucuugcccagcauugugagggaggcucuaaaacgccgacugagaacccucauccuggccccuacgcggguuguggcggccgaaauggaggaagcacuuaggggcuuaccaauucgcuaucagacacccgcugucaaguccgagcacacugggcgugagaucguggaccugaugugccacgccaccuuuacaaccagacucuugucuucgacucggguuccuaacuacaaucugauagugauggaugaagcucauuucaccgacccgugcagcgucgcagccaggggauacauuucaacacgcguggagaugggugaagccgcugcgaucuuuaugacggcaacucccccaggcuccaucgauccuuucccccagaguaacucuccaauugaggacaucgaacgagagauaccugagagaagcuggaauaccggguucgacuggauuacagauuaucaaggaaagaccguaugguuugugcccuccaucaaagccggcaacgacauugcuaauugucuccggaagucagguaaaaggguuauccagcugucucgcaagacuuucgauacagaauacccaaaaaccaaacuuacggacugggauuuugucgugacuacagacauaagcgagaugggggccaacuucagagcaggcagggugauugauccgcggcguugccugaagccugucaucuugaccgacggacccgaacgcguuauccuagccggcccaauucccgugaccccugcuagugcggcccagcgaagagggaggaucggacggaacccagcacaagaggaugaccaguauguauuuuccggugauccccugaaaaaugacgaagaucacgcucauuggacugaggccaagaugcucuuagacaacauuuacacaccugagggcauaaucccgacccuguucgggccagaacgcgagaaaacacaggcaauugacggagaauuuagacuuaggggcgagcagcggaagacuuucguggagcugaugcgaagaggugaucuccccgucugguugagcuauaaaguggccucugcugggaucucauacaaggaccgcgaaugguguuuuacgggcgagaggaauaaccaaauccuggaagagaauauggaaguugagauuuggacccgggagggagaaaagaaaaagcuccguccuaaauggcuggaugccagaguguaugcggaccccauggcacuuaaggauuucaaagaguuugccuccggcaggaagaguacaacucuagacauacugaccgaaaucgcuacauugccaaccuacuuaagcucgaaggccaaacuggcucucgauaacauugucaugcugcacacuacggagaaagggggccgcgcauaccagcacgcccuuaaugaacugccugagucucucgagaccuugaugcugguagcucuacugggugccaugacagcaggcaucuuccucuuuuucaugcaggggaaaggaauuggcaaacuuuccaugggucugaucgcgauagccguggcuagcggguuauuguggguugccgaaauccagccccaauggauugcagcuucaaucauucuggaguucuuucucauggugcugcuuaucccagaaccugagaaacagcggacuccgcaggacaaccagcugauauaugucauucucaccaucuugacaauuaucggccugauagccgcaaaugaaaugggauuaaucgagaagaccaaaacugauuucggcuuuuaccaagugaagacagagacgaccauucuagacgucgaucugcgacccgccagugcuuggacucucuaugcgguggccacaaccauccuuaccccaaugcugagacauacaauugaaaacaugucugcaaauuugucccuggcugccaucgccaaccaggcagcuguucucauggggcugggaaagggcuggccucuucacaggauggaccucggugugccccuguuggccauggggugcuacagccagguaaauccaacuacgcugaccgcgucauuagugaugcuacugauacauuaugcuauuaucggaccuggccuccaggccaaagcaacacgcgaggcccaaaagcggacugcugcagguaucaugaaaaaccccaccgucgauggcauuacaguuaucgaccuugaaccgauaaguuacgacccaaaguucgagaaacagcugggacaggugauguugcugguccucugugugggacaacugcuuuuaaugagaaccacuugggcccugugcgagguacucacguuggcgacaggcccuauuaugacccugugggaagggaaucccggacguuuuuggaacacuaccaucgcugugagcacagccaacauuuucaggggcuccuaucuagccggugcagggcuggcuuuuucucucaucaagaaugcccagacuccacggcgcggaaccggcacaacgggugagacccuuggcgaaaaguggaaacgacagcugaacagcuuggauagaaaggaguucgaagaguacaaaagguccgggauacuggagguugaccggacugaagcaaagucagcucuccgcgauggaucuaaaaucaagcacgccgugaguagaggcucgagcaagauuagguggaucgucgagcgagggaugauuaaacccaagggaaaaguggucgaccugggcugugguagaggcgggugguccuacuauauggcgacauuaaagaaugugaccgaaguuaaaggguacacuaagggcgggccuggacaugaggaaccgauccccauggccacauaugguuggaaccuuguaaagcugcacucuggcguggaugucuuuuacaaaccaaccgaacagguggacacgcuccuaugcgauauuggggagucaagcuccaauccuaccaucgaagagggacguacacugagaauauugaagaugguugaacccuggcugaguucuaaaccugaguucuguauuaaggugcucaacccauauaugcccacugucaucgaggaacuugagaaacugcaacgcaggcacggcgguagcuuggugcggugcccucugucaagaaauuccacccaugaaauguacuggguaaguggggcaagcggaaacaucgugucuuccguuaauacaauuucaaagaugcucuuaaaccgcuuuacuaccaggcaccgaaaaccaacauaugagaaggacgucgaucugggcgcuggcacccggagcgugucgacugaaacggagaagcccgacaugacaauaaucgggagaaggcuucagcgccugcaggaggaacauaaagagaccuggcacuacgaucaggaaaauccguaccguacuugggccuaucacggaucuuacgaggcaccuaguaccgguuccgcuagcucaauggugaacggcgucguuaagcuacucacaaaaccaugggacgugauucccaugguaacgcaacuggccaugaccgacacuacaccuuucgggcagcagcggguguuuaaggaaaaagucgauaccagaacuccacagcccaaguugggaacaaggaugaucaugaccacaacugccaauuggcugugggcgcuccuuggcaagaaaaaguccccgcgccuguguacccgagaggaguucauuucuaaagugcggagcaacgcugcaaucggugccguuuuccaagaggaacagggguggacgagugcuauagaagccgugaaugacuccagauuuugggaguuagucgauaaggaaagggcacugcaucaggagggaaaaugcgagagcugcguguauaacaugaugggcaagcgcgaaaagaaauugggcgaguucgggagagccaagggaucucgggcuaucugguacauguggcucggugcgagguuucuggaguucgaggcccuaggcuuucuuaaugaagaccacugguucucacgugagaacaguugguccgggguagagggagaaggccugcaucgacucgguuauauucuggaggauaucgacaaaaaggauggggacuugauuuacgcagaugacaccgcuggaugggauacacgcaucacugaagacgaucugcucaacgaggagcuuauaaccgaacaaauggccccucaccauaaaacacuggcaaaggccauuuuuaaguuaacuuaucagaauaaaguugugaagguccugagacccaccccaaaaggcgcugugauggacaucaucagccggaaggaccagaggggcucuggacaggugggaacguacgguuugaacacauucaccaauauggagguccaacucauucgccagauggaagccgagggcguuauaacucaggaugacaugcagaacccuaaagggcugaaggaaagaguggagaaauggcuaaaggaguguggaguagaucggcuuaagaggauggcgaucucgggcgacgauugcguggucaaaccccuggacgaacgauuuucaacaagccuccuguucuugaaugauauggguaaggugcguaaagacguuccacaaugggagcccuccaagggguggaaaaacuggcaggaagugccuuuuuguagucaccacuuccauaagauuuuuaugaaggauggaagaucuuuagucgugccaugccgcaaucaggacgagcugaucggccgggcaaggauuagccagggcgccggguggucccucagagaaaccgcuugucuuggaaaagccuacgcacaaauguggucacugauguauuuccaccgccgggaucuaaggcuggcuaguauggccaucugcucugcuguaccgacugagugguuccccaccagccgaacaacgugguccauacaugcccagcaccaguggaugaccacugaggacaugcucaagguuuggaacagaguguggaucgaagacaauccuaacaugacagauaaaaccccaguccacucaugggaggacauucccuacuuggguaagcgggaagaucugugguguggcagccuuaucgggcugucuuccagggcaacuugggcgaaaaauauucauacagccaucacccaggugcgcaaccucauuggaaaggaggaauauguugacuacaugccugugaugaagcguuauaguagcccaucggaguccgagggcgucuuauga

SEQ ID NO: 15771 - RNA, 9867 nt, Artificial Sequence
  derived and/or modified CDS sequence (opt3) from DENV-4__KJ160504__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaccauuacuccucguucaccaaguguagagguuaagcugccggauuacggagaauuaacgcuggacugcgagccccgcagcggcaucgacuucaacgagaugauucucaugaagaugaaaaagaaaacauggcuugugcauaagcagugguuucuggauuugccucuaccauggaccgcuggggccgacacuucugaaguccacuggaauuacaaagagagaauggugaccuucaaggucccccaugcgaaaaggcaggaugugacaguucugggaucccaggaaggugccaugcacucagcacucgcuggcgccaccgagguggacagcggggauggaaaccacauguuugcuggccaucugaaguguaagguacggauggaaaaacuucgaaucaaggguaugaguuauacuaugugcucugggaaauucuccaucgacaaggagauggccgagacacaacacggcacgaccgucgugaaaguuaaguacgaaggagcaggcgccccuuguaaggugccaauugagauacgcgaugucaauaaagaaaaggugguagggagagugaucagcucgacuccccuggcugagaacacaaacucuguuaccaauauugaguuggaaccgccuuucggagacuccuauaucgucauaggugugggcaacucagcgcucacacugcauugguuuaggaaagggaguagcauuggaaagauguucgaguccacuuaccggggcgcaaaacgcauggccaucuuaggugaaaccgcuugggauuuugggucugugggcggacuguucacgagccuaggcaaggccguccaccagguuuuugggucaguguauaccacaauguucggaggcgugaguuggaugaucagaauucucaucgguuuucugguacuuuggauugggacuaauuccaggaacaccagcauggcaaugacaugcauagccgucggaggcaucacuuuguuccuggguuuuaccgugcaggcugacaugggcuguguugugucuuggucagggcgugagcucaagugcggaaguggcauuuucgucguggauaauguucauacguggacagaacaauacaaauuucagcccgagagcccagcccggcuggcauccgcgauccuuaacgcucacaaggacgggguguguggaauccgaucuaccacuagacuggagaauguaauguggaaacagauuacaaacgaauugaauuauguccucugggagggcggucacgaccugaccgugguggccggggaugucaagggaguuuuaacuaaaggcaagagggcacugaccccucccgugucggaccuaaaguacagcuggaaaacaugggguaaggccaaaauauucacgccagaagcucgcaacuccaccuuucucaucgauggccccgacacuucagagugcccuaaugaacggagagccuggaacagucuggagguagaggauuacggguucggaauguucacaaccaauauuuggaugaaguuuagggaaggcucuagcgaggugugugaccaucgccuuauguccgcagcuaucaaagaucagaaggccguccacgcggacaugggguauuggauugaaucaagcaaaaaccaaacauggcagaucgagaaggccucuuugauagaagugaagacuugccuguggccaaaaacccauacgcucugguccaauggaguucuggagagucagauguuaaucccgaagagcuacgcuggccccuucucucagcacaacuaucgacaagguuacgcaacacagaccguggggccuuggcaccugggaaaacuugagauugauuuuggcgaaugcccagguacuaccgucacaauccaggaggacugugaucaucggggccccuccuugcguacuaccacagccucagggaagcucgugacgcaguggugcuguagaaguugcaccaugccuccacugagguuccuaggagaagacggcuguugguaugggauggagauucgcccccugagcgagaaagaagagaacaugguuaagucgcaagugacugcuggacagggcacauccgaaaccuuuucuaugggucuccugugccuuacuuuguucgucgaggaaugucugcggagaaggguaacacgaaagcacaugaucuuagugguugugauaacccucugcgccauuauccuggggggacuuacguggauggaucuguugcgcgcacucauuaugcugggcgacacuaugagcggccggaucgggggacagauacaucuagcgaucauggccgucuuuaaaaugucaccggguuacgugcugggcguauuccucagaaagcugaccaguagggagacagcucuuauggugauugggauggccaugaccacugucuuguccaucccucacgaccugauggaguuaauugauggaaucucucucggccugauacuucugaaaauuguuacacaguuugacaauacccaaguggguacacuagcacucagccugacuuucauccguuccaccaugccauuggugauggcuuggcgcacgaucauggccguccuguuugugguuacauuaauuccccucugucggaccucaugccugcagaagcagagccauuggguagaaaucacugcacuuauucugggggcccaagcuuugccuguguaucucaugacccugaugaaaggagcgaguagaaggucuuggccccuaaacgagggcauaauggccgucggccuggugucccuucucgggagcgcacuguugaagaaugauguuccacuggcuggaccuaugguggccgguggcuuacuccuggccgcuuacgucaugucggggucaucugcagaccuuagucuggaaaaggccgcgaacgugcagugggaugagauggcugacaucacaggauccagccccauuaucgaaguaaaacaggaugaggacggcucuuucagcauucgagaugucgaggaaacuaauaugaucaccuugcucgugaagcuggcccuaauaacgguuuccggucuguacccacuugcaaucccgauuacaaugacccucugguauauguggcaggugaaaacucaacggucaggggcccugugggacgucccuagucccgcugcaacacagaaggccgcguugagcgagggaguguaccgcaucaugcagagaggcuuauuuggcaaaacccagguuggggugggaauucacauggaaggugucuuccacacuauguggcaugugacaaggggcucuguaaucugucacgagaccgggcggcuggaaccauccugggcugaugugcgaaacgacaugauaucauauggaggcgguuggagacucggggauaagugggacaaggaggaggacguucaaguccuggccauugaacccggaaaaaauccuaagcaugugcagacgaaaccaggccuuuucaagacucugaccggcgagaucggggcagugacauuggauuuuaaacccggaaccagugguagcccuaucauuaaccgcaagggcaaagucauagggcuauacggaaauggcguagugacaaaguccggugacuauguuucugccaucacucaggcugaaaggauuggggagccggauuacgagguggacgaagauaucuuccguaagaaacggcugaccauuauggaccuccacccaggagccggcaagacgaaaagaauccugcccucgauagucagggaggcacuuaagcgccgauuaagaacacugauccucgcuccuacucgggugguugccgcggaaauggaggaagccuugaggggccugccaauucgcuaucagacccccgcagugaaaagcgagcauacagggcgugagaucgucgaucucaugugccacgcuaccuuuacuaccagacugcuuucauccacacgggugccuaacuacaaucugauuguaauggacgaagcccacuucacggauccgaguucuguggcugcaaggggauacaucagcacucgcguugagaugggugaagccgccgcuauauuuaugaccgcgacacccccaggcgcaaccgacccuuucccccaauccaacucaccaauugaggauaucgaacgagagaucccugagagaucuuggaauacuggguuugacuggauuacagacuaucagggaaagaccgucugguucgugcccagcaucaaggccggcaacgauauagcuaauugcuugcggaaaagugguaagaaagugauucagcuauccaggaagacguuugggacugaauacccaaaaacaaagcugaccgacugggauuucgucguuaccacugacaucagcgagaugggcgccaacuuucgcgcaggaagagugauugauccgaggcggugucucaagccuguaaucuuaacagacggccccgaacgugugauacuggccgggccaauucccgucaccccugcuucugcggcccaacgccgaggaagaguggguaggaacccagcacaggaggaugaccaguauguuuucucaggcgauccccuuaaaaaugacgaagaucaugcucacuggacagaggccaagaugcugcucgacaacaucuacacuccugaggggaucauuccgacguuguucggaccagaacgggagaaaacccaggcaaucgauggcgaauuucgccugagaggugagcaaaggaagacauucguggagcucaugcggcgaggggaccugcccgucuggcuuuccuauaaaguagccagugcuggcauuagcuacaaggacagagaauggugcuuuacuggagagcgcaauaaccagauacuagaagagaauauggaaguggagaucuggaccagggagggcgaaaagaaaaagcugcggccucguugguuggaugccagaguuuaugcggaccccauggcauuaaaagauuucaaggaguuugccucggggaggaaaucuauuacacuggacauccucaccgaaaucgcuucccugccagccuaccuuagcucacgcgcuaagcuggcacucgauaacauugugauguugcauacuacggagcggggaggucgagccuaccagcacgcucugaaugaacuaccugagagucuggagacccucaugcuugucgcccuguuaggcgcaaugacagcggggauauucuuguuuuucaugcagggaaagggcaucgguaaacugucuauggggcucauuacuaucgccguggcuuccggccugcuuuggauugccgaaauccaaccccaguggauagcagcuagcaucauucuggaguuuuuccucauggucuugcugaucccagaaccugagaagcagagaaccccgcaggacaaccaauuaauuuaugugauccuaacaguucugaccauaauuggacucaucgccgcaaaugaaaugggccuuauugagaaaacuaagacagauuuuggguucuaccaggugaaaacggagaccacuauccuggacguagauuugaggcccgccucagcuuggacacuguaugcgguggccaccaccguccucacaccaaugcugcgccacacuauagaaaacacgagugcaaaucuuagccucgcugccaucgccaaccaggcagcuguucugaugggauugggcaaggguuggccucugcaucggauggacuuaggggugccccuacuggccaugggauguuacucccaggucaauccaaccacacucacugcgucucuugugaugcuguuuguacacuaugcuauuaucggcccugguuugcaagccaaagcaaccagagaggcccagaagcguacagcugcaggcauuaugaagaaccccaccguggaugggaucacuguuauagaccuggaaccgauuagcuacgauccaaaauucgagaagcagcucggacaagugaugcugcuugucuuaugcgccggccagcugcucuugaugaggacgacaugggcguucugugaggugcugacccuagcuacugggccuauccugacccucugggaaggaaaucccggccgguuuuggaacacaacuaucgccgucuccaccgcaaacauuuuccgcgguucauaucuugccggggcuggacuggccuuuucuuugaucaaaaaugcacagacaccacgaagaggcacggguaccacuggcgagacacugggggaaaaguggaaaaggcagcucaacagucuggaccggaaggaguucgaagaguacaagcgcucgggaauauuagagguggacagaaccgaagcuaaaagcgcccuuaaggauggcuccaaaauuaagcaugcgguuucuagggggucaagcaaaauccgauggauuguagagcggggaauggugaagcccaagggcaaagucguggaccuggguugcgggcguggaggcugguccuacuauauggccacucucaagaauguuacagaagugaaaggcuacaccaaggggggaccuggucacgaggaaccgauccccauggcaacguauggcuggaaccuagucaaacugcauagugggguggauguauuuuacaagccaaccgagcaaguggacacauugcugugugauauaggagagucuagcucaaauccuacuaucgaagagggcagaacccuccgcguucuuaagauggucgaacccuggcuguccaguaaaccugaguucugcauuaagguguugaacccauauaugcccacagugaucgaagagcuggagaaacuccagaggaagcacggugggaauuuaguccgguguccucugagcagaaacucuacucacgaaauguacuggguuuccggagcuucaggcaauauugugagcucgguaaacaccacaucuaaaaugcuucugaaucgcuuuaccacuaggcaucgaaagccaacguaugagaaagacguggaucuaggcgccgggacacggagugucuccaccgaaacugagaagcccgacaugaccaucauuggaagaaggcuccagcgccugcaggaggaacacaaggagacauggcauuacgaucaagaaaacccguaccguacgugggcauaucacgguagcuacgaggcuccuucaaccggcuccgccucuagcauggugaaugggguugugaaauugcugacuaagccaugggacgucauccccauggugacacagcucgccaugaccgauacuacaccuuucggacagcagcggguauuuaaagaaaagguugacaccagaacaccacaacccaaaccgggcacuaggauggugaugaccacgaccgcgaacuggcuuugggcucuguuagguaagaagaaaaauccucgccugugcacacgagaggaguucauaaguaagguccgguccaacgcagccauuggggcuguguuucaggaagagcagggauggacuagcgccucugaagcagugaaugacucaagauucugggaguuggucgauaaagaaagggcccuccaccaagagggcaagugugagaguugcguuuauaacaugaugggcaaacgcgaaaagaagcugggggaguuuggaagagcuaaagguucccgggcgaucugguacauguggcuaggcgccagguuccuugaauucgaggcacugggguuucucaacgaagaccauugguucggacgugagaauagcuggucuggcguggagggugaagggcugcaccgauugggauauauccuggaggaaauugauaagaaagacggcgaucucauguacgcugacgauaccgccggcugggacacacgcauaacugaggaugaccuucagaacgaggaacugaucaccgagcagauggcaccccaucacaagauuuuagccaaagcuaucuuuaagcugacguaucagaauaagguagugaaagucuugagaccaacaccucggggggccgugauggauauuaucucgaggaaggaccaacgcggaucaggucagguuggcaccuacgggcucaacacuuucacaaauauggaagugcagcugauaagacagauggaggcggaaggagucaucacccaagaugacaugcagaaccccaaaggccuaaaggagcggguggagaaauggcuuagggaaugcgguguagaccgacugaagcguauggcaauuagcggggaugacuguguugugaaaccacucgaugagagauuuggaacuucccuguuguucuuaaaugacaugggcaagguccgcaaggauaucccccagugggaaccuaguaaaggcuggaagaacuggcaggaggugccauuuugcucucaucacuuccacaaaauuuuuaugaaggacgggcggagccugguugugccguguaggaaucaagaugaacucaucggaagagcccgcauaucccagggugcuggcuggucacuucgggagaccgccugccuggggaaagcauacgcucagauguggagucuaauguauuuccauaggcgagaccugagacucgccucuauggcuauuuguagcgccguccccacagagugguuuccuacgucccggaccacuuggucaauccacgcacaucaccaguggaugacaaccgaagauauguugaagguguggaacaggguauggaucgaggacaauccaaacaugacugauaagacacccgugcacagcugggaagacauuccuuaccugggaaaacgcgaggaccuuuggugcggcucucugauaggucucuccagucgugcgaccugggccaagaauauccauacggcuauuacacaagucagaaacuuaaucgggaaagaagaguauguugauuacaugccagugaugaagcgauauagcgcccccucggaguccgaaggaguccuguga

SEQ ID NO: 15772 - RNA, 9867 nt, Artificial Sequence
  derived and/or modified CDS sequence (opt3) from DENV-4__GU289913__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaugauuaccccucguucaccaaguguagagguuaagcugccggauuacggagaauuaacucuggacugcgagccccgcagcggcaucgacuucaacgagaugauucucaugaagaugaaaaagaaaacguggcuugugcauaagcagugguuucuggauuugccucuaccauggacagcuggggccgacaccucugaaguccacuggaauuacaaagagagaauggugacuuucaaggucccccaugcgaaaaggcaggaugugaccguucugggaucccaggaaggugccaugcacucagcacucgcuggcgccacagagguggacagcggggauggaaaccacauguuugcuggccaucugaaguguaagguacggauggaaaaacuucgaaucaaggguaugaguuauaccaugugcucugggaaauucuccaucgacaaggagauggccgagacucaacacggcacaacggucgugaaaguuaaguacgaaggagcaggcgccccuuguaaggugccaauugagauacgcgaugucaauaaagaaaaggugguagggagaaucauuagcucgaccccccuggcugagaacacuaacucugugacaaauaucgaguuggaaccgccuuucggagacuccuauauaguuauuggugucggcaacucagcgcucacccugcauugguuuaggaaagggaguagcaucggaaagauguucgaguccacauaccggggcgcaaaacgcauggccaucuuaggugaaacugcuugggauuuugggucugugggcggacuguucaccagccuaggcaaggccgugcaccaggucuuugggucaguuuauacgaccauguucggaggcgugaguuggaugauuagaauccucauugguuuucuggugcuuuggauagggacaaauuccaggaacacuagcauggcaaugaccugcaucgccguaggaggcauuacauuguuccuggguuuuacuguccaggcugacaugggcugugugguuucuuggucagggaaggagcucaaaugcggaaguggcaucuucguggucgauaaugugcauaccuggacggaacaauacaaguuucagcccgagagcccagcccgucuggcauccgcgauccuuaacgcucacaaagacgggguuuguggaauucggucuacaacccgacuggagaaugugauguggaagcagauaacuaacgaauugaauuauguacucugggagggcggucacgaccugacagucguggccggggaugugaaaggagucuuaaccaagggcaagagagcacugacuccucccguuucggaccuaaaauacagcuggaagaccugggguaaagccaagaucuucacaccagaagcuaggaacuccacguuucucauugauggccccgacaccucagagugcccuaaugaacgccgggccuggaacagucuggagguggaggauuacggguucggaauguucacuacaaauaucuggaugaaauuuagagaaggcucuagcgagguaugugaccauaggcuuauguccgcagcuauuaaggaucagaaagccgugcacgcggacaugggguauuggaucgaaucaagcaagaaccaaaccuggcagauagagaaggccucuuugaucgaagucaaaacaugccuguggccaaagacucauacccucugguccaauggagugcuggagagucagauguuaauuccgaaaagcuacgcuggccccuucucucagcacaacuaucgccaagguuacgcaacgcagacaguugggccuuggcaccugggaaagcuugagaucgauuuuggcgaaugcccagguaccacugugaccauucaggaggacugugaucaucgaggccccuccuugcggacaacuaccgccucagggaaacucgucacacaguggugcugucguaguugcacgaugccuccacugagauuccuaggagaagacggcuguugguaugggauggagaucaggccccugagcgagaaggaagagaacauggugaagucgcaaguuaccgcuggacagggcacuuccgaaacauuuucuaugggucuccugugccuuaccuuguucguggaggaaugucugcgccggagagucacuaggaaacacaugauauuaguagugguuauuacacucugcgccaucauucuggggggacuuaccuggauggaucuguugcgagcacucaucaugcugggcgacacgaugagcggccgcauagggggacagauccaucuagcgauuauggccguguuuaagaugucaccggguuacguccugggcguguuccuccggaaacugacuaguagagagaccgcucuuaugguaaucgggauggccaugacaaccguguuguccauuccucacgaccugauggaguuaaucgauggaauaucucucggccugauucuucugaagaucgucacucaguuugacaauacacaaguugguacccuagcacucagccugacauucaucagguccacuaugccauuggugauggcuuggcguaccauuauggccgugcuguuugucgugacguuaaucccccucugucgcacaucaugccugcagaaacagagccauuggguugaaauuaccgcacuuauacugggggcccaagcuuugccuguauaucucaugacucugaugaagggagcgagucggagaucuuggccccuaaacgagggcaucauggccgugggccuggucucccuucucgggagcgcacuguugaagaaugaugugccacuggcuggaccuaugguugccgguggcuuacuccuggccgcuuacgugaugucggggucaucugcagaccuuagucuggaaaaagccgcgaacguccagugggaugagauggcugacauuaccggauccagccccaucauugaagugaagcaggaugaggacggcucuuucagcaucagggauguagaggaaacaaauaugauaacuuugcucgucaaacuggcccuaaucaccguguccggucuguacccacuugcaauuccgguuacgaugacacucugguauauguggcaggugaagacccaacgaucaggggcccugugggacgucccuagucccgcugcaacucagaaagccgcguugagcgagggaguguaccggaucaugcagcgcggcuuauuuggcaagacacagguuggggugggaauucacauggaaggugucuuccacaccauguggcaugugacuagaggcucuguaaucugucacgagacagggaggcuggaaccauccugggcugaugugcggaacgacaugauaucauauggaggcgguuggcgacucggggauaagugggacaaagaggaggacguucaaguccuggccauugaacccggaaagaauccuaaacaugugcagaccaagccaggccuuuucaaaacgcugacuggcgagaucggggcagugaccuuggauuuuaagcccggaacaagugguagcccuaucauuaacagaaaaggcaaggucauagggcuauacggaaauggcguagugaccaaguccggugacuauguuucugccaucacacaggcugaacgcauuggggagccggauuacgagguggacgaagauaucuucaggaaaaagcgucugacuauuauggaccuccacccaggagccggcaaaaccaagcggauccugcccucgauagucagagaggcacuuaaaaggcgcuuacgaacgcugauccucgcuccuacaagagugguugccgcggaaauggaggaagccuugcggggccugccaauuagguaucagacucccgcagugaagagcgagcauaccgggcgcgagaucgucgaucucaugugccacgcuacauuuaccacucgucugcuuucauccaccagagugccuaacuacaaucugauuguaauggacgaagcccacuucacagauccgaguucuguggcugcacggggauacaucagcacgaggguugagaugggugaagccgccgcuauauuuaugacugcgacccccccaggcgcaacagacccuuucccccaauccaacucaccaauugaggauaucgaacgcgagaucccugagcgaucuuggaauaccggguuugacuggauuacugacuaucagggaaagacagucugguucgugcccagcaucaaagccggcaacgauauagcuaauugcuugagaaagagugguaaaaaggugauucagcuaucccggaaaaccuuugacacggaauacccaaagacuaagcugacagauugggacuucgucguuaccaccgauaucagcgagaugggggccaacuuuagggcaggccgcgugauugacccgagaaggugucucaaaccuguaaucuuaacugauggacccgaacgggugauacuggccggcccaauucccgucacaccugcuucugcggcccaacgucgcgggcgaaucggaagaaacccagcacaggaggacgaucaguauguguucucaggugacccccuuaagaaugaugaagaccaugcucacuggaccgaggccaaaaugcugcucgauaacaucuacacaccugagggcauuaucccgacuuuguucgggccagaaagggagaagacgcaggcaauugacggagaauuucggcugcgcggcgagcaaagaaaaaccuucguugagcucaugaggcggggugaccugcccguguggcuuuccuauaaggucgccagugcugggauaagcuacaaggaucgagaauggugcuuuacaggcgagagaaauaaccagauccuagaagagaauauggaaguagagauuuggacucgcgagggagaaaaaaagaaacugaggccucggugguuggacgcccguguguaugcggaucccauggcauuaaaggacuucaaagaguuugccucgggcagaaagucuaucacccuggauauccucacagaaauugcuucccugccaaccuaccuuagcucaagggccaagcuggcucucgacaacauaguuauguugcauacuacggagcgcgggggacgggcauaccagcacgcccugaaugaacuaccugagagucuggagacccucaugcuuguggcucuguuaggugccaugacagcaggcaucuucuuguuuuucaugcaggggaaaggaauuggcaagcugucuaugggucucaucacuauugcggucgccuccgggcugcuuuggguggcugaaauccaaccccaguggauagccgcaagcaucauucuggaguuuuuccucauggucuugcugaucccagaaccugagaaacagcgaaccccgcaggauaaccaauuaauuuaugugauccuaacaauacugaccauuaucggccucauugcugccaaugaaaugggacuuaucgagaagacuaaaacagacuuuggcuucuaccagguuaagacggagaccacuauacuggauguggacuugagacccgcaucagccuggacacuguaugcuguagcgaccaccauccucacaccaaugcugaggcacacuauugaaaacacgagugccaaucuuagccucgcagcuaucgccaaccaggccgcagugcugaugggguugggaaaaggcuggccucugcaucgcauggauuuaggugucccccuacuggcuaugggguguuacucccagguuaauccaaccacacucacugccucucuugugaugcugagcguccacuaugcgauuaucggaccuggcuugcaagcuaaggccacccgggaggcacagaagagaacagccgcugguauaaugaaaaaccccaccguggacggcauuacuguaaucgaucuggaaccgaucuccuacgacccaaaguuugagaaacagcucgggcaagugaugcugcuuguuuuaugcgcaggacagcugcucuugaugcguacgacaugggccuucugugaggugcugacccuagcgacuggcccuauucugacccucugggaagggaaucccggaagguucuggaacacaacuaucgcugucucaaccgccaacauauuucggggcucuuaucuugcaggugccgggcuggcuuucaguuugauuaagaaugcccagacaccacgccgaggaacgggcaccacuggugagacacugggcgaaaaauggaagagacagcucaacucgcuggacaggaaggaguuugaagaguacaaacggagcgggaucuuagagguggaucgcaccgaagcaaaguccgcucuuaaagacggaucuaagauuaaacaugccgucucaagaggcagcuccaagaucagguggauaguggagcgagggaugguuaagcccaaaggaaagguaguggaucugggcugcggucgggggggauggaguuacuauauggcgacucucaaaaaugucacagaagugaagggcuacaccaaaggcgggccuggacacgaggaaccgauccccauggccacguaugguuggaaccuaguuaagcugcauucuggcguggacgucuucuacaagccaaccgagcaaguggauacauugcugugugacauuggggagagcucauccaauccuacuaucgaagagggacguacccucagaguacuuaaaaugguggaacccuggcugaguagcaagccugaguuuugcauuaaaguuuugaacccauauaugcccacagucaucgaagagcuggagaagcuccagcgcaaacacggcgguaauuuagugagguguccucugucucggaacuccacucacgaaauguacugggugucaggggcaagcggaaauauugucucgucuguuaacaccacaaguaagaugcuucugaauagauucaccacucgccauaggaaaccaacguaugagaaggauguggaccuaggcgcuggcacacgauccguaagcaccgaaacugagaagcccgauaugaccaucauagggcggagacuccagaggcugcaggaggaacacaaagagacauggcauuacgaccaagaaaacccguaccgcacgugggccuaucacggaucauacgaggcaccuuccaccgguucugcuagcaguauggugaauggcgucgugaaguugcugacuaaaccaugggauguuauucccauggugacacagcucgccaugaccgacacuacaccuuuugggcagcagcgugucuucaaggaaaaaguggacacccggacaccacaacccaagccgggaacuagaaugguaaugaccacgaccgccaacuggcuuugggcgcuguuaggcaagaaaaagaauccuaggcugugcacacgcgaggaguuuaucuccaaaguucgaagcaacgcugcaaucggugccguguuccaggaagagcagggguggacuucugcuucagaagccgucaaugauagucgguuuugggaguugguggacaaggaaagagcacuccaccaagagggaaaaugugaguccugcguguauaacaugaugggcaagagggaaaagaaacugggcgaguucgggcgcgccaagggaagcagagcuauuugguacauguggcuaggugcgcgguuucuugaauucgaggcccugggcuuccucaacgaagaucauugguuugggagggagaauucuuggucgggagucgagggcgaaggucugcaccguuugggguauauacuggaggaaaucgacaaaaaggauggagaccucauguacgcagaugacaccgcuggcugggauacacgaauuacugaggacgaucuucagaacgaggaacugaucaccgagcagauggccccccaucacaaaauuuuagcaaaggccaucuucaagcugacguaucagaauaaaguugugaagguauugcgcccaacaccuagaggcgcugugauggacauaaucucacggaaagaucaaagggggagcggacaggucgguaccuacggccucaacacuuuuacaaauauggaagugcagcugauucgccagauggaggccgaagggguuaucacccaagacgacaugcagaaccccaagggacuaaaagagagaguggagaaguggcuuaaagaaugcggcgucgaucggcugaagaggauggcgauuuccggugacgauugugugguaaagccacucgacgagcgauucgggacuagucuguuguuuuuaaaugauaugggaaaaguucguaaggacaucccccagugggaaccuucuaaaggcuggaagaacuggcaggaggugccauucugcagccaucacuuucacaaaauauucaugaaggauggcagaucccuggucgugccgugucgcaaucaagacgaacucauugggcgggcaaggaucucacagggagccgguuggagucuuagagagaccgcuugccugggcaaggccuacgcacagauguggucucuaauguauuuucaucgccgggaucugaggcucgcuagcauggccaucuguuccgcuguucccacagagugguucccuacgucacgaaccacuuggagcauucacgcccaucaccaguggaugacaaccgaagacauguugaaaguguggaacagagucuggauagaggauaauccaaacaugacugacaagacacccgugcacucuugggaagacaucccuuaccuggggaaacgggaggaucuuuggugcggaucccugauuggccucaguagcagggcaaccugggcgaagaauauccauacggccauuacacaaguacgcaacuuaaucgguaaagaagaguauguggacuacaugccagucaugaagcguuauucggcucccuccgagucugaagggguucuguga

SEQ ID NO: 15773 - RNA, 9867 nt, Artificial Sequence
  derived and/or modified CDS sequence (opt3) from DENV-4__KJ579243__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguugccuuguauuguggauugggaccaauucaaggaacacaaguauggcaaugacuuguauagccgucggaggcaucacccuguuucucgguuucacggugcaggcugacaugggcugcguuguguccuggagcgggcgugagcugaaguguggaucuggcauuuuugucguggauaauguucauacauggaccgaacaauacaaauuccagcccgagucaccagcccggcuugcaagugcgauccugaacgcucacaaggacggggugugcggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccggucucaaguacucuuggaaaacguggggcaaggcuaaaauauuuaccccagaagcccgcaacucgacuuuccugaucgacgggcccgauacaagcgaguguccuaaugaacggagagcauggaacuccuuugagguggaggacuacggauucggcauguucaccacaaauauuuggaugaaguuuagggaagggucaagugagguaugcgaucaucgccuuaugucugcugccaucaaagaccagaaggcggugcacgccgauaugggauauuggauugaaagcuccaaaaaccaaacuuggcagaucgagcgagcuucauugauagaagucaagaccugccuguggccaaagacgcauacacucuggagcaauggcgugcuggagucucagauguuaaucccgaaauccuacgcaggucccuucagucagcacaacuaucggcaaggguacgccacccagacuguuggaccuuggcaccugggcaagcuugagauugacuuuggugaauguccaggcaccacagugacuauccaggagaacugcgaucaucgugggcccagcuugagaaccacaacggcuucuggaaaacucgucacccagugguguugcagguccuguacuaugccuccacugcgcuuccuaggcgaagacgggugcugguauggaauggagauucggccccugucagagaaggaagagaauauggugaaaagucaaguuacagccggccaggguaccagcgaaacuuuuucgauggggcuccugugucuuacauuguucguggaggaaugccugagaaggcgagucacccgcaagcacaugaucuuagcaguagugauaacgcucugugcgauuauccugggaggccuuacuuggauggaucuguugcgggcccucauuauccugggcgacaccauguccgggagaauaggaggucagacacaucuagcuaucauggccguuuuuaagaugucuccgggcuacgugcugggggucuuccucaggaaacugaccagccgugagacugcacuuauggugauuggaauggcuaugacaaccacauugucaaucccucacgaucugauggaguuaauugacggcaucagucucggucugauacuucugaagauuguaacucaguuugacaacacccaaguggggacgcuagcccucucccugacauucauccgcucuaccaugagcuuggucauggcauggcggacuaucauggccguucuguuuguggugaccuuaauuccacucugcagaacauccugucugcagaaacagucacauugggucgaaaucacugcucuuauucugggagcgcaagccuugcccguguaucucaugacccugaugaagggcgcaagcaggcgaaguuggccucuaaaugagggcauaauggcuguugggcugguaucucuucucggauccgcccuguugaaaaacgaugugccccuggccgguccaauggucgcuggcggguuacuccuggcagccuacgugaugagcggaucgucagcggaccuuucucuggaaaaggcugccaauguucagugggaugagauggcagacaucacgggcaguuccccuauuaucgaagugaagcaggaugaggacgguagcuucucuauucgggaugucgaggaaacaaacaugaucaccuugcucgugaaacuggcccuaauaacuguaagcgggcuguacccccuugcuaucccaauuacaaugacccucugguauauguggcaggucaagacucaacgcuccggagcacugugggacgugccgucaccugccgcgacacagaaagcugccuugagugagggcguuuacagaaucaugcagaggggcuuauuugggaagacccaggugggagucgguauucacauggaaggcguguuccacacgauguggcauguuacucgggggagcgugaucugccacgagaccggacgacuggaacccucuugggcagaugucagaaaugacaugauauccuauggcgguggguggcgccucggagauaaaugggacaaggaggaggaugugcaaguacuggccauugaaccaggcaagaaccccaaacaugugcagacaaagccuggccuuuucaaaacccugacaggggagaucggagcuguuacuuuggacuuuaagccagguaccucaggcagucccaucauuaauaggaaagggaaggucauaggacuauacggcaacgguguggugacgaaaagcggggacuaugucuccgccaucacacaggcagaacguauuggagagccugauuacgagguagacgaagauaucuuccggaagaagagacugacuauuauggaccuccacccgggcgcuggcaaaaccaagaggauccugccaucuauagugcgcgaggcccuuaaacgaagauuacggacacugauccucgcgcccaccaggguuguggccgcagaaauggaggaagcuuugcgcgggcugccuauucguuaucagacuccagccgucaagucggagcauaccggaagagagaucguggaucucaugugccacgcuacauuuacgacucggcugcuuagcucaaccaggguucccaauuacaaccugauugugauggacgaagcacacuucacagauccuuccagugucgccgcccgcgguuacaucucuacccgaguggagaugggcgaagcugcggcaauauuuaugacugccacaccgcccggggcuaccgacccauucccucaaagcaauucccccauugaggauaucgaaagagagaucccagagcggucauggaacacgggauuugacuggauuacugauuaucagggcaaaacaguaugguucgugccuucuaucaaggccgguaaugacauagcaaacuguuugaggaagagcgggaaaaagguuauucagcuaagucgcaaaaccuuugacaccgaauaccccaagacuaaacugacagauugggacuucgucgugaccacagauaucuccgagaugggcgccaacuuuagagcuggaagggugauugacccacggcguugccucaagccggucaucuuaacugauggcccugaacgcguuauacuggcggggcccauuccagugacgcccgccagcgcagcucaacgaagaggaaggaucggucggaauccugcccaggaggacgaucaguauguauucucuggcgacccacuuaagaacgaugaagaccaugcacacuggaccgaggccaaaaugcugcucgauaauaucuacacacccgaggggauuaucccuacuuuguucggaccggaacgcgagaagacccaggcuauugacggcgaauuuagacugaggggugagcaacggaaaacauucguggagcucaugcgaagaggggaucugccagucuggcuuucauauaagguggccuccgcgggcauaaguuacaaagaccgcgaaugguguuuuaccggagagaggaacaaucagauccuagaagagaacauggaaguugagauuuggacucgggagggcgaaaagaagaaacugcgucccaagugguuggacgcaagaguguaugccgauccuauggcuuuaaaagacuucaaggaguuugccagcgggaggaaaucgaucacgcuggauauccucaccgaaauugcuucucugcccacauaccuuuccagccgcgcaaagcuggcccucgacaauauagucauguugcauacuaccgagcggggaggucgagcuuaccagcacgcccugaacgaacuaccagagucacuggagacacucaugcuuguagcacuguuaggcgcgaugaccgccgggaucuucuuguuuuucaugcagggaaagggcauugguaaacugaguauggggcucaucacuauugcuguggccucuggccugcuuuggguugcagaaauccaaccucaguggauagcugccuccaucauucuggaguuuuuccucaugguguugcugauccccgaaccagagaagcagagaacaccucaggauaaucaauuaauuuaugucauccuaacgauacugaccauuaucggacucauugcagccaacgaaaugggccuuaucgagaaaacuaagacagacuuuggguucuaccaggugaaaaccgagaccacaauacuggaugucgacuugaggccggcuagcgcguggacucuguaugccguggcaacgaccauccucacacccaugcugcgccacacuauugaaaauaccucagcuaaccuuagucucgccgccaucgcaaaucaggcugccguucugaugggauugggcaaggguuggccacugcaucggauggauuuaggggugccucuacuggcgaugggaugcuacagccagguaaaccccacaacccucacugcuucccuugugaugcuguugguccacuaugccauuaucggcccaggucugcaagcaaaagccacgagagaggcucagaagcguacagcagccggcauaaugaagaauccuaccguugacgggauuacugugaucgaucucgaacccaucucuuacgacccgaaauuugagaagcagcugggacaagucaugcuuuuagugcugugugcgggccagcucuugcugaugaggaccacaugggcuuucugcgagguacuaacucuggccaccgggccaauucucacacuuugggaaggaaacccuggccgguucuggaacacgaccaucgcagugagcacugccaauauauuucgcgguuccuaucuggcuggggccggauuggcauucucacugauuaaaaacgcucagacaccccgaagaggcaccgguacugccggcgagacacucggggaaaaguggaaaaggcagcugaauucuuuagaucggaaggaguuugaagaguacaagcgcaguggaauccuugagguugacagaaccgaagcgaaaucggcccugaaggacggcagcaaaauuaagcaugcaguguccagggggucuucaaaaauccgauggauagucgagcggggaauggugaagccaaagggcaaagucguggaucucgguugugggcguggaggcuggagcuacuauauggcuacgcuaaagaacguuaccgaaguaaaaggcuacacaaaggggggacccggucacgaggaaccuaucccgauggccacuuauggcuggaaucuggugaaauugcauuccggggucgacguguucuacaagcccaccgagcaaguugauacacugcucugcgacauuggagagaguucuagcaacccaacuaucgaagagggcagaacccuucgcgugcugaagauggucgaaccuugguugucauccaaacccgaguuuuguauuaaggugcugaauccuuauaugccaacaguaaucgaagagcucgagaaauuacagaggaagcacggugggaaccuggugcggugcccccuuaguagaaauagcacccacgaaauguacuggguuucuggagcauccggcaacauugucucaagcgugaauacuacgucgaaaaugcugcuaaaccgcuucacaaccaggcaucgaaagccuacuuaugagaaagauguggaccucggcgcugggacccggucugucaguacagaaacggagaagccagauaugaccaucauaggaagaaggcugcagcgcuugcaggaggaacacaaggagacuuggcauuacgaccaagaaaaucccuaccguacaugggccuaucacgguuccuacgaggccccgagcaccggcucagcguccucuaugguuaacggggugguaaaacugcucacuaagccuugggaugugauuccaauggucacacagcuugcuaugaccgacacaacucccuuuggacagcagcggguguucaaagaaaagguugauaccagaacgccucaaccaaaacccggcaccaggauggugaugacaacuaccgcaaauuggcugugggccuuacuggguaagaagaaaaacccgcgcuuguguacacgagaggaguuuaucagcaagguccggaguaaugcugccaucggggcaguguuccaggaagagcagggauggacuuccgccagcgaagcuguaaacgacucuagauuuugggagcucguugacaaagaaagggcgcugcaccaagagggcaagugcgagucaugcguguauaacaugaugggcaaacgcgaaaagaagcuaggggaguucggaagagccaaagguagucgggcaauuugguacauguggcuuggcgcuagguuucuggaauucgaggcccucggguuccugaaugaagaucauugguuuggacgugagaacuccuggagcggcgucgagggugaaggguugcaccgacugggauauauacucgaggaaaucgacaagaaagauggcgaccuuauguacgcagaugacaccgccggcugggauacgcgcauuacagaggacgaucugcagaaugaggaauuaaucaccgagcagauggcuccucaucacaagauucuggccaaagcgaucuucaaguugacuuaucagaacaagguggugaaaguccucagacccacaccacggggggcaguuauggacauaaucucuaggaaggaucaacgcggaucgggucaggugggcaccuacgggcugaauacuuuuaccaacauggaaguacagcuaauuagacagauggaggccgaaggagugaucacacaagacgauaugcagaauccuaaaggccuuaaggagcgggucgagaaauggcugagggaaugugguguggaccgacucaagcguauggcuauuucaggggacgauugcguugugaaaccccuggacgagagauucggaacgagcuuguuauuucugaacgauaugggcaagguccgcaaggacaucccacagugggaacccuccaaaggcuggaagaauuggcaggaggugccuuucuguagucaucacuuucacaaaauauucaugaaggaugggcggucucucguaguuccaugcaggaaccaagacgaacuuauuggaagagcccgcaucagccagggugcaggcuggucccugcgggagaccgcuugucuagggaaagccuacgcucagauguggucacugauguauuuucauaggcgagaucucagauuggccaguauggcaaucugcucugcggugccgacugagugguuccccacaagccggaccacuugguccauucacgcccaucaccaguggaugacaaccgaagacaugcugaaggucuggaauaggguguggauagaggauaacccuaauaugaucgacaagacgccaguucacucaugggaagauauucccuaccuuggaaaacgcgaggaccugugguguggcagccucaucgguuuaucuucccgugcuacaugggccaagaacauucauaccgcaaucacucaagugagaaaucugauagggaaagaagaguaugucgacuacaugccugugaugaagcgauauagugcuccaagcgagucggaaggaguauuguga

SEQ ID NO: 15774 - RNA, 9867 nt, Artificial Sequence
  derived and/or modified CDS sequence (opt3) from DENV-4__KJ579246__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuauccugggcgauaccauguccggcagaauagggggacagacacaucuagcuaucauggccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaacggagaagccagacaugaccaucauagggagaaggcugcagcgcuugcaggaggaacacaaggagacuuggcauuacgaucaagaaaaucccuaccguacaugggccuaucacggauccuacgaggccccgagcaccgguucagcguccucuaugguuaacggcgugguaaaacugcucacuaagccuugggacgugauuccaauggucacacagcuugcuaugaccgauacaacucccuucgggcagcagcggguguuuaaagaaaagguugacaccagaacgccucaaccaaaacccggaaccaggauggugaugacaacuaccgcaaauuggcugugggccuuacugggcaagaagaaaaacccgcgcuugugcacacgagaggaguucaucagcaagguccggaguaaugcugccaucggugcaguguuucaggaagagcagggguggacuuccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggagucgagggcgaagguuugcaccgacugggguauauacucgaggaaaucgauaagaaagacggagaucuuauguacgcagacgauaccgccggcugggacacgcgcauuacagaggaugaccugcagaaugaggaauuaaucaccgagcagauggcuccucaucacaagauucuggccaaagcgaucuuuaaguugacuuaucagaacaagguggugaaaguccucagacccacaccacggggcgcaguuauggauauaaucucuaggaaggaccaacgcgggucgggacagguggguaccuacggccugaauacuuucaccaacauggaaguacagcuaauuagacagauggaggccgaaggggugaucacacaagaugacaugcagaauccuaaaggacuuaaggagcgggucgagaaauggcugagggaaugcggcguggaccgacucaagcguauggcuauuucaggugaugacuguguugugaaaccccuggaugagagauuugggacgagcuuguuauuccugaacgacaugggaaagguccgcaaggauaucccacagugggaacccuccaaaggcuggaagaauuggcaggaggugccuuuuugcagucaucacuuccacaaaauauuuaugaaggacggccggucucucguaguuccauguaggaaccaagaugaacuuauugggagagcccgcaucagccagggagcagguuggucccugcgggagaccgcuugccuaggcaaagccuacgcucagauguggucacugauguauuuccauaggcgagaccucagauuggccaguauggcaaucuguucugcggugccgacugagugguuucccacaagccggaccacuugguccauucacgcccaucaccaguggaugacaaccgaagauaugcugaaggucuggaauaggguguggauagaggacaacccuaauaugaucgauaagacgccaauucacucaugggaagacauccccuaccuugggaaacgcgaggaccuguggugcggaagccucauuggcuuaucuucccgugcuacaugggccaagaacauccauaccgcaauaacucaaguuagaaaucugaucgguaaagaagaguauguggauuacaugccugucaugaagcgauauagugcuccaagcgagucggaagggguguuguga

SEQ ID NO: 15775 - RNA, 9867 nt, Artificial Sequence
  derived and/or modified CDS sequence (opt3) from DENV-4__KJ579248__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaguugggggacagacacaucuagcuaucauagccguguucaagaugucuccggguuacguccugggcguguuucucaggaaacugaccagccgugagacugcacuuaugguaaucgggauggcuaugacaaccacauugucaauuccucacgaccugauggaguuaaucgacggaauuagucucggccugauccuucugaagauagugacucaguucgauaacacccaagucgguacgcuagcccucucccugacauuuauucgcucuaccaugagcuugguuauggcauggcggacuaucauggccgugcuguucguggucaccuuaaucccacucuguagaacauccugccugcagaaacagucacauuggguggaaauuacugcucuuauccugggggcgcaagccuugcccguuuaucucaugacccugaugaagggagcaagcaggcgaaguuggccucuaaaugagggcauuauggcuguaggccuggugucucuucucggguccgcccuguugaaaaacgacgucccccuggccggaccaaugguggcugguggcuuacuccuggcagccuacguuaugagcgggucgucagcggaucuuucucuggaaaaggcugccaaugugcagugggacgagauggcagauauaacgggaaguuccccuaucauugaagucaagcaggacgaggauggcagcuuuucuauccgggacguggaggaaacaaacaugauuaccuugcucguaaaacuggcccuaaucacugucagcggucuguacccccuugcuauaccaaucacaaugacccucugguauauguggcaggugaagacucaacgcuccggggcacugugggauguuccgucaccugccgcgacacagaaagcugccuugagugagggaguguacagaauuaugcagaggggcuuauucggcaagacccaggucggggugggaauccacauggaagguguuuuccacacgauguggcaugugacucggggcagcgucauuugucacgagaccgggcgacuggaacccucuugggcagacgugagaaaugauaugaucuccuauggaggcgguuggcgccucggggacaaaugggauaaggaggaggacguacaagugcuggccauagaaccaggaaagaaccccaaacauguucagacaaagccuggccuuuuuaaaacccugacaggcgagauuggggcugucacuuuggacuucaagccaggaaccucagguagucccaucaucaauaggaaaggcaaggugauugggcuauacggaaacggcguggucacgaaaagcggugauuauguauccgccauaacacaggcagaacguaucggggagccugacuacgagguggaugaagacauuuuucggaagaagagacugacuaucauggaucuccacccgggagcuggcaaaaccaagaggauucugccaucuaucguucgcgaggcccuuaaacgaagauuacggacacugauacucgcgcccaccaggguggucgccgcagaaauggaggaagcuuugcgcggccugccuauccguuaucagacuccagccgugaagucggagcauaccgggagagagauuguugaccucaugugccacgcuacauucacgacucggcugcuuagcucaaccagggugcccaauuacaaccugaucgucauggaugaagcacacuuuacagacccuuccaguguggccgcccgcggauacauuucuacccgaguagagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacagugugguuuguuccuucuauuaaggccggcaaugacaucgcaaacugcuugaggaagagcgguaaaaaggucauacagcuaagucgcaaaaccuucgauaccgaauaccccaagacuaaacugacagacugggauuuuguggugaccacagacauuuccgagaugggggccaacuucagagcuggcagggucaucgauccacggcguugucucaagccgguuauuuuaacugacggaccugaacgcgugauccuggcgggccccauaccaguaacgcccgccagcgcagcucaacgaagagggaggauuggacggaauccugcccaggaggaugaccaguauguguucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaauucagacugaggggcgagcaacggaaaacauuugucgagcucaugcgaagaggugaccugccaguguggcuuucauauaagguugccuccgcggggauuaguuacaaagaccgcgaauggugcuucaccggcgagaggaacaaucagauacuagaagagaacauggaaguggagaucuggacucgggagggagaaaagaagaaacugcgucccaagugguuggaugcaagagucuaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauuguaauguugcauacuaccgagcgggggggacgagcuuaccagcacgcccugaacgaacuaccagagucacuggagacacucaugcuuguggcacuguuaggugcgaugaccgccggcauauuuuuguucuuuaugcaggggaagggaaucggcaaacugaguaugggucucauuacuaucgcuguugccucugggcugcuuuggguggcagaaauucaaccucaguggaucgcugccuccauaauccuggaguucuuucucauggucuugcugauucccgaaccagagaagcagagaacaccucaggacaaucaauuaaucuaugugauucuaacgauccugaccauaauuggccucaucgcagccaacgaaaugggacuuauugagaaaacuaagacagauuucggcuuuuaccaggucaaaaccgagaccacaauccuggacguggauuugaggccggcuagcgcguggacucuguaugccguugcaacgaccauacucacacccaugcugcgccacacuaucgaaaauaccucagcuaaccuuagucucgccgccauugcaaaucaggcugccgugcugaugggguugggaaagggcuggccacugcaucggauggacuuagguguaccucuacuggcgaugggguguuacagccaggugaaccccacaacccucacugcuucccuugucaugcuguugguucacuaugccaucauuggaccaggccugcaagcaaaagccacgagagaggcucagaagcguacagcagccgguaucaugaagaauccuaccguggauggcauaacugucauugaccucgaacccaucucuuacgauccgaaauucgagaagcagcuggggcaagugaugcuuuuaguacugugcgcgggacagcucuugcugaugaggaccacaugggcuuucugugaggugcuaacucuggccaccggcccaauccucacacuuugggaagggaacccuggacgguuuuggaacacgaccauugcaguuagcacugccaauaucuuccgcggcuccuaucuggcuggugccggguuggcauuuucacugauaaaaaacgcucagacaccccgaagaggaaccggcacugccggugagacacucggcgaaaaguggaaaaggcagcugaauucuuuagaccggaaggaguucgaagaguacaagcgcagugggauucuugagguggacagaaccgaagcgaaaucggcccugaaggauggaagcaaaaucaagcaugcagucuccaggggcucuucaaaaauucgauggaucguggagcgggggauggucaagccaaagggaaaagugguugaccucggcugcggucgugggggauggagcuacuauauggcuacgcuaaagaacguaaccgaagugaaaggcuacacaaagggcgggcccggacacgaggaaccuauaccgauggccacuuaugguuggaaucuggucaaauugcauuccggcguggauguuuuuuacaagcccaccgagcaaguggacacacugcucugugauaucggggagaguucuagcaacccaacuauugaagagggaagaacccuucgcguccugaagaugguggaaccuugguugucauccaaacccgaguucugcaucaagguacugaauccuuauaugccaacagugauugaagagcucgagaaauuacagaggaagcacggcgguaaccugguucgguguccccuuaguagaaauagcacccacgaaauguacugggucucuggggcauccggaaacaucgugucaagcgugaauacuacgucgaaaaugcugcuaaaccgcuuuacaaccaggcaucgaaagccuacuuaugagaaagacgucgaucucggcgcuggcacccggucuguuaguacagaaauugagaagccagacaugacgaucauagggagaaggcugcagcgcuugcaggaggaacacaaggagaccuggcauuacgaucaagaaaaucccuaccguacuugggccuaucacggauccuacgaggccccgagcacagguucagcguccucuauggugaacggcguagugaaacugcucaccaagccuugggacgucauuccaauggugacucagcuugcuaugacagauaccacacccuucgggcagcagcggguuuuuaaagaaaagguggacacuagaaccccucaaccaaaacccggaacgaggauggucaugaccacaacugcaaauuggcugugggccuuacugggcaagaagaaaaacccgcgcuugugcacccgagaggaguucaucagcaaggugcggaguaaugcugccaucggugcaguauuucaggaagagcagggguggacauccgccagcgaagcuguuaacgacucuagauucugggagcucguggauaaagaaagggcgcugcaccaagagggaaagugugagucaugcgucuauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggaguggagggcgaagguuugcaccgacugggguauauacucgaggaaaucgauaagaaagacggagaucuuauguacgcagacgauacugccggcugggacacccgcauuacggaggaugaccugcagaaugaggaauuaaucacagagcagauggcuccucaucacaagauucuggccaaagcgaucuuuaaguugaccuaucagaacaagguggucaaaguucucagacccacuccacggggcgcagugauggauauaaucucuaggaaggaccaacgcgggucgggacagguagguacauacggccugaauaccuucacuaacauggaagugcagcuaauuagacagauggaggccgaaggggucaucacccaagaugacaugcagaauccuaaaggacuuaaggagcggguggagaaauggcugagggaaugcggcguugaccgacucaagcguauggcuauuucaggugaugacuguguggucaaaccccuggaugagagauuugggacaagcuuguuauuccugaacgacaugggaaaggugcgcaaggauaucccacagugggaacccuccaaaggcuggaagaauuggcaggagguaccuuuuugcagucaucacuuccacaaaauauuuaugaaggacggccggucucucguugugccauguaggaaccaagaugaacuuauugggagagcccgcaucagccagggagcagguuggucccugcgggagacggcuugccuaggcaaagccuacgcucagauguggucacugauguauuuccauaggcgagaccucagauuggccaguauggcaaucuguucugcggucccgaccgagugguuucccacuagccggacaaccugguccauucacgcccaucaccaguggaugacuacagaagauaugcugaagguguggaauaggguuuggauagaggacaacccuaauaugaucgauaagaccccagugcacucaugggaagacauucccuaccuugggaaacgcgaggaccuguggugcggaagccucaucggcuuaucuucccgugcuacgugggccaagaacauucauacagcaaucacccaagucagaaaucugauagguaaagaagaguauguggauuacaugaguguaaugaagcgauauagcgcuccuucggaguccgaagggguguuguga

SEQ ID NO: 15776 - RNA, 9867 nt, Artificial Sequence
  derived and/or modified CDS sequence (opt3) from DENV-4__KJ579240__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcagucacuugcauagccgugggaggcaucacccuguuccucgguuuuacgguucaggcugacaugggcuguguggucuccuggagcgggcgugagcugaagugcggaucuggcauuuucgugguugauaaugugcauacauggaccgaacaauacaaauuucagcccgagucaccagcccggcuugcaagugcgauccugaacgcucacaaggacgggguauguggaauccgaagcacuacaagauuggagaaugucauguggaaacagauuaccaacgaacucaauuaugugcugugggagggcggucacgacuuaacuguggucgccggggauguuaagggagugcugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguagaggauuacggguucggaauguuuaccacaaauauuuggaugaaguucagggaaggcucaagugaggugugugaccaucgccuuaugucugcugccaucaaagaucagaaggcgguccacgccgacaugggguauuggauugaaagcuccaaaaaccaaacuuggcagaucgagcgagcuucauugauagaagugaagaccugccuguggccaaagacgcauacacucuggagcaauggaguucuggagucucagauguuaaucccgaaauccuacgcaggccccuuuagucagcacaacuaucggcaagguuacgccacccagacuguggggccuuggcaccugggaaagcuugagauugauuucggcgaaugcccagguaccacagucacuauccaggagaacugugaccaucguggccccagcuugagaaccacaacggcuucugggaaacucgugacccaguggugcuguagguccugcacuaugccuccacugcgcuuucuaggagaagauggcuguugguaugggauggagauucggccccugucagagaaggaagagaauaugguuaaaagucaagugacagccggacagggcaccagcgaaacuuucucgaugggucuccugugccuuacauuguuugucgaggaaugucugagaaggcgaguaacccgcaagcacaugaucuuagcagugguuauaacgcucugcgcgauuauccuggggggacuuacuuggauggaccuguugcgggcccucauuaugcugggcgauaccauguccggcagaaucgggggacagacacaucuagcuauaaucgccguguucaagaugucuccggguuacguccugggcguguuucucaggaaacugaccagccgugagacugcacuuaugguaauugggauggcuaugacaaccacauugucaaucccucacgaccugauggaguuaauugacggaaucagucucggccugauacuucugaagauugugacucaguucgauaacacccaagucgguacgcuagcccucucccugacauuuauccgcucuaccaugagcuugguuauggcauggcggacuaucauggccgugcuguucguggucaccuuaauuccacucuguagaacauccugccugcagaaacagucacauuggguggaaaucacugcucuuauucugggggcgcaagccuugcccguuuaucucaugacccugaugaagggagcaagcaggcgaaguuggccucuaaaugagggcauaauggcuguaggccuggugucucuucucggguccgcccuguugaaaaacgacgucccccuggccggaccaaugguggcugguggcuuacuccuggcagccuacguuaugagcgggucgucagcggaucuuucucuggaaaaggcugccaaugugcagugggacgagauggcagauaucacgggaaguuccccuauuaucgaagucaagcaggacgaggauggcagcuuuucuauucgggacguggaggaaacaaacaugaucaccuugcucguaaaacuggcccuaauaacugucagcggucuguacccccuugcuaucccaauuacaaugacccucugguauauguggcaggugaagacucaacgcuccggggcacugugggauguuccgucaccugccgcgacacagaaagcugccuugagugagggaguguacagaaucaugcagaggggcuuauucggcaagacccaggucggggugggaauucacauggaagguguuuuccacacgauguggcaugugacucggggcagcgucaucugucacgagaccgggcgacuggaacccucuugggcagacgugagaaaugauaugauauccuauggaggcgguuggcgccucggggacaaaugggauaaggaggaggacguacaagugcuggccauugaaccaggaaagaaccccaaacauguucagacaaagccuggccuuuuuaaaacccugacaggcgagaucggggcugucacuuuggacuucaagccaggaaccucagguagucccaucauuaauaggaaaggcaaggugauagggcuauacggaaacggcguggucacgaaaagcggugauuauguauccgccaucacacaggcagaacguauuggggagccugacuacgagguggaugaagacaucuuucggaagaagagacugacuauuauggaucuccacccgggagcuggcaaaaccaagaggauccugccaucuauaguucgcgaggcccuuaaacgaagauuacggacacugauccucgcgcccaccaggguggucgccgcagaaauggaggaagcuuugcgcggccugccuauucguuaucagacuccagccgugaagucggagcauaccgggagagagaucguugaccucaugugccacgcuacauucacgacucggcugcuuagcucaaccagggugcccaauuacaaccugauugucauggaugaagcacacuuuacagacccuuccaguguggccgcccgcggauacaucucuacccgaguagagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacagugugguuuguuccuucuaucaaggccggcaaugacauagcaaacugcuugaggaagagcgguaaaaaggucauucagcuaagucgcaaaaccuucgauaccgaauaccccaagacuaaacugacagacugggauuuuguggugaccacagacaucuccgagaugggggccaacuucagagcuggcagggucauugauccacggcguugucucaagccgguuaucuuaacugacggaccugaacgcgugauacuggcgggccccauuccaguaacgcccgccagcgcagcucaacgaagagggaggaucggacggaauccugcccaggaggaugaccaguauguguucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuugucgagcucaugcgaagaggugaccugccaguguggcuuucauauaagguugccuccgcggggauaaguuacaaagaccgcgaauggugcuucaccggcgagaggaacaaucagauccuagaagagaacauggaaguggagauuuggacucgggagggagaaaagaagaaacugcgucccaagugguuggaugcaagagucuaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauaguaauguugcauacuaccgagcgggggggacgagcuuaccagcacgcccugaacgaacuaccagagucacuggagacacucaugcuuguggcacuguuaggugcgaugaccgccggcaucuuuuuguucuuuaugcaggggaagggaauuggcaaacugaguaugggucucaucacuauugcuguugccucugggcugcuuuggguggcagaaauccaaccucaguggauagcugccuccaucauucuggaguucuuucucauggucuugcugauccccgaaccagagaagcagagaacaccucaggacaaucaauuaauuuaugugauccuaacgauacugaccauuaucggccucauugcagccaacgaaaugggacuuaucgagaaaacuaagacagauuucggcuuuuaccaggucaaaaccgagaccacaauacuggacguggauuugaggccggcuagcgcguggacucuguaugccguugcaacgaccauccucacacccaugcugcgccacacuauugaaaauaccucagcuaaccuuagucucgccgccaucgcaaaucaggcugccgugcugaugggguugggaaagggcuggccacugcaucggauggacuuagguguaccucuacuggcgaugggguguuacagccaggugaaccccacaacccucacugcuucccuugucaugcuguugguucacuaugccauuaucggaccaggccugcaagcaaaagccacgagagaggcucagaagcguacagcagccgguauaaugaagaauccuaccguggauggcauuacugucaucgaccucgaacccaucucuuacgauccgaaauucgagaagcagcuggggcaagugaugcuuuuaguacugugcgcgggacagcucuugcugaugaggaccacaugggcuuucugugaggugcuaacucuggccaccggcccaauucucacacuuugggaagggaacccuggacgguuuuggaacacgaccaucgcaguuagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguggacagaaccgaagcgaaaucggcccugaaggauggaagcaaaauuaagcaugcagucuccaggggcucuucaaaaauccgauggauaguggagcgggggauggucaagccaaagggaaaagugguugaccucggcugcggucgugggggauggagcuacuauauggcuacgcuaaagaacguaaccgaagugaaaggcuacacaaagggcgggcccggacacgaggaaccuaucccgauggccacuuaugguuggaaucuggucaaauugcauuccggcguggauguuuuuuacaagcccaccgagcaaguggacacacugcucugugauauuggggagaguucuagcaacccaacuaucgaagagggaagaacccuucgcguccugaagaugguggaaccuugguugucauccaaacccgaguucugcauuaagguacugaauccuuauaugccaacagugaucgaagagcucgagaaauuacagaggaagcacggcgguaaccugguucgguguccccuuaguagaaauagcacccacgaaauguacugggucucuggggcauccggaaacauugugucaagcgugaauacuacgucgaaaaugcugcuaaaccgcuuuacaaccaggcaucgaaagccuacuuaugagaaagacgucgaucucggcgcuggcacccggucuguuaguacagaaaucgagaagccagacaugacgauaauugggagaaggcugcagcgcuugcaggaggaacacaaggagaccuggcauuacgaucaagaaaaucccuaccguacuugggccuaucacggauccuacgaggccccgagcacagguucagcguccucuauggugaacggcguagugaaacugcucaccaagccuugggacgucaucccaauggugacucagcuugcuaugacagauaccacacccuucgggcagcagcggguuuuuaaagaaaagguggacacuagaaccccucaaccaaaacccggaacgaggauggucaugaccacaacugcaaauuggcugugggccuuacugggcaagaagaaaaacccgcgcuugugcacccgagaggaguucaucagcaaggugcggaguaaugcugccauuggugcaguauuucaggaagagcagggguggacauccgccagcgaagcuguuaacgacucuagauucugggagcucguggauaaagaaagggcgcugcaccaagagggaaagugugagucaugcgucuauaacaugaugggcaaacgcgaaaagaagcuaggcgaguuugggagagccaaaggaagucgggcaauaugguacauguggcuuggugcuagguuccuggaauucgaggcccucggcuuucugaaugaagaccauugguucgggcgugagaacuccuggagcggaguggagggcgaagguuugcaccgacugggguauauccucgaggaaauugauaagaaagacggagaucuuauguacgcagacgauacugccggcugggacacccgcaucacggaggaugaccugcagaaugaggaauuaauuacagagcagauggcuccucaucacaagauccuggccaaagcgauauuuaaguugaccuaucagaacaagguggucaaaguucucagacccacuccacggggcgcagugauggauaucauuucuaggaaggaccaacgcgggucgggacagguagguacauacggccugaauaccuucacuaacauggaagugcagcuaaucagacagauggaggccgaaggggucauuacccaagaugacaugcagaauccuaaaggacuuaaggagcggguggagaaauggcugagggaaugcggcguugaccgacucaagcguauggcuaucucaggugaugacuguguggucaaaccccuggaugagagauuugggacaagcuuguuauuccugaacgacaugggaaaggugcgcaaggauauaccacagugggaacccuccaaaggcuggaagaauuggcaggagguaccuuuuugcagucaucacuuccacaaaauuuuuaugaaggacggccggucucucguugugccauguaggaaccaagaugaacuuaucgggagagcccgcaucagccagggagcagguuggucccugcgggagacggcuugccuaggcaaagccuacgcucagauguggucacugauguauuuccauaggcgagaccucagauuggccaguauggcaauuuguucugcggucccgaccgagugguuucccacuagccggacaaccugguccauacacgcccaucaccaguggaugacuacagaagauaugcugaagguguggaauaggguuuggaucgaggacaacccuaauaugauugauaagaccccagugcacucaugggaagacauccccuaccuugggaaacgcgaggaccuguggugcggaagccucauuggcuuaucuucccgugcuacgugggccaagaacauccauacagcaauaacccaagucagaaaucugaucgguaaagaagaguauguggauuacaugaguguaaugaagcgauauagcgcuccuucggaguccgaagggguguuguga

SEQ ID NO: 15777 - RNA, 9867 nt, Artificial Sequence
  derived and/or modified CDS sequence (opt3) from DENV-4__KJ596658__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuauccugggcgauaccauguccggcagaauagggggacagacacaucuagcuaucauggccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaacggagaagccagacaugaccaucauagggagaaggcugcagcgcuugcaggaggaacacaaggagacuuggcauuacgaucaagaaaaucccuaccguacaugggccuaucacggauccuacgaggccccgagcaccgguucagcguccucuaugguuaacggcgugguaaaacugcucacuaagccuugggacgugauuccaauggucacacagcuugcuaugaccgauacaacucccuucgggcagcagcggguguuuaaagaaaagguugacaccagaacgccucaaccaaaacccggaaccaggauggugaugacaacuaccgcaaauuggcugugggccuuacugggcaagaagaaaaacccgcgcuugugcacacgagaggaguucaucagcaagguccggaguaaugcugccaucggugcaguguuucaggaagagcagggguggacuuccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggagucgagggcgaagguuugcaccgacugggguauauacucgaggaaaucgauaagaaagacggagaucuuauguacgcagacgauaccgccggcugggacacgcgcauuacagaggaugaccugcagaaugaggaauuaaucaccgagcagauggcuccucaucacaagauucuggccaaagcgaucuuuaaguugacuuaucagaacaagguggugaaaguccucagacccacaccacggggcgcaguuauggauauaaucucuaggaaggaccaacgcgggucgggacagguggguaccuacggccugaauacuuucaccaacauggaaguacagcuaauuagacagauggaggccgaaggggugaucacacaagaugacaugcagaauccuaaaggacuuaaggagcgggucgagaaauggcugagggaaugcggcguggaccgacucaagcguauggcuauuucaggugaugacuguguugugaaaccccuggaugagagauuugggacgagcuuguuauuccugaacgacaugggaaagguccgcaaggauaucccacagugggaacccuccaaaggcuggaagaauuggcaggaggugccuuuuugcagucaucacuuccacaaaauauuuaugaaggacggccggucucucguaguuccauguaggaaccaagaugaacuuauugggagagcccgcaucagccagggagcagguuggucccugcgggagaccgcuugccuaggcaaagccuacgcucagauguggucacugauguauuuccauaggcgagaccucagauuggccaguauggcaaucuguucugcggugccgacugagugguuucccacaagccggaccacuugguccauucacgcccaucaccaguggaugacaaccgaagauaugcugaaggucuggaauaggguguggauagaggacaacccuaauaugaucgauaagacgccaguucacucaugggaagacauucccuaccuugggaaacgcgaggaccuguggugcggaagccucaucggcuuaucuucccgugcuacaugggccaagaacauucauaccgcaaucacucaagugagaaaucugauagguaaagaagaguaugucgauuacaugccugugaugaagcgauauagugcuccaagcgagucggaagggguauuguga

SEQ ID NO: 15778 - RNA, 9867 nt, Artificial Sequence
  derived and/or modified CDS sequence (opt3) from DENV-4__KJ596659__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaaucauaaagagagaauggugacauucaaggucccccacgccaaaaggcaggaugugaccguucucggaucucaggaaggugcgaugcacuccgcccuggcaggcgcuacugagguggacucaggggauggaaaccauauguuugccggccaccuuaaguguaagguacggauggaaaaacugcgaaucaaggguaugagcuacacaaugugcagugggaaauucucuaucgacaaggagauggcugagacgcaacauggcaccacugucgugaaaguuaaguaugaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguacaucgucauaggugugggcaacucugcgcugacuuuacacugguuuaggaaaggguccucaauuggaaagauguucgagaguaccuaucggggcgcaaaacgcauggccauccugggugaaacggcuugggauuuugggagcgugggcggacuauucaccucccucggcaaggccguccaucagguuuuugggucuguguacacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucacacauggaccgaacaauauaaauuucagcccgagucaccagcccggcuugcaagugcgauccugaacgcucacaaggacgggguguguggaauccgaagcacuacaagauuggagaauguaauguggaaacagauuaccaacgaacucaauuacguccugugggagggcggucaugacuuaacugugguggccggggaugucaagggaguucugaccaaaggcaagagggcacuaacaccucccgccuccgaccucaaguauucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaccgccuuaugucugcugccaucaaagaucagaaggcggugcaugccgacaugggguacuggauugaaagcuccaaaaaccaaacuuggcagaucgagcgagcuucauugauagaagucaagaccugccuguggccaaagacgcacacacucuggagcaauggagugcuggagucucagauguuaaucccgaaauccuaugcaggccccuuuagucagcacaacuaccggcaagguuaugccacccagacuguugggccuuggcaucugggaaagcuugagauugauuucggcgaaugcccagguaccacagugacuauccaggagaacugugaccaccguggccccagcuugagaaccacaacggcuucugggaaacucgucacccaguggugcuguagguccugcacuaugccuccacugcgcuuucuaggagaagauggcuguugguacgggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcauaugaucuuagcaguagugauaacgcucugcgcgauuauccuggggggacuuacuuggauggaccuguugcgggcccucauuauccugggcgauaccauguccggcagaauagggggacagacacaccuagcuaucauggccguuuucaagaugucuccggguuaugugcugggcgucuuucucaggaaacugaccagccgugagacugcacuuauggugauugggauggcuaugacaaccacauugucaaucccucaugaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacacugggucgaaaucacugcucuuauucugggggcgcaagccuugcccguguaccucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuaugugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguacauguggcaggucaagacucaacgcuccggggcacugugggaugugccgucaccugccgcgacacagaaagcugccuugagugagggaguuuauagaaucaugcagaggggcuuauucggcaagacccaggugggggucggaauucacauggaagguguguuccauacgauguggcacguuacucggggcagcgugaucugucaugagaccgggcgacuggaacccucuugggcagacgucagaaaugauaugauauccuacggaggcgguuggcgccucggggacaaaugggauaaggaggaggacgugcaaguacuggccauugaaccaggaaagaaccccaaacacgugcagacaaagccuggccuuuuuaaaacccugacaggcgagaucggggcuguuacuuuggacuucaagccaggaaccucagguagucccaucauuaauaggaaaggcaaggucauagggcuauauggaaacggcguggugacgaaaagcggugauuacgucuccgccaucacacaggcagaacguauuggggagccugacuaugagguagaugaagacaucuuucggaagaagagacugacuauuauggaucuccauccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaccagacuccagccgucaagucggagcacaccgggagagagaucguggaccucaugugccacgcuacauucacgacucggcugcuuagcucaaccaggguucccaauuauaaccugauugugauggaugaagcacauuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaccagggaaaaacaguaugguuugugccuucuaucaaggccggcaaugacauagcaaacugcuugaggaagagcgguaaaaagguuauucagcuaagucgcaaaaccuucgauaccgaauaucccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguacguauucucuggugauccacuuaagaacgacgaagaucacgcacauuggaccgaggccaaaaugcugcucgacaauaucuauacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauacaagguggccuccgcggggauaaguuauaaagaccgcgaauggugcuucaccggcgagaggaacaaucagauccuagaagagaacauggaaguugagauuuggacucgggagggagaaaagaagaaacugcgucccaagugguuggaugcaagaguguacgccgacccuauggcuuuaaaagauuuuaaggaguucgccagcggcaggaaaucgaucacgcuggacauccucaccgaaauugcuucucugcccacauaucuuuccagccgcgcaaagcuggcccucgauaauauagucauguugcacacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuacgucauccuaacgauacugaccauuaucggccucauugcagccaacgaaaugggacuuaucgagaaaacuaagacagauuucggcuuuuaucaggugaaaaccgagaccacaauacuggacgucgauuugaggccggcuagcgcguggacucuguacgccguggcaacgaccauccucacacccaugcugcgccauacuauugaaaauaccucagcuaaccuuagucucgccgccaucgcaaaucaggcugccguucugaugggguugggaaagggcuggccacugcaccggauggacuuaggugugccucuacuggcgaugggguguuauagccagguaaaccccacaacccucacugcuucccuugugaugcuguugguccauuacgccauuaucggaccaggccugcaagcaaaagccacgagagaggcucagaagcguacagcagccgguauaaugaagaauccuaccguugauggcauuacugugaucgaccucgaacccaucucuuaugauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaccuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguauaagcgcagugggauccuugagguugacagaaccgaagcgaaaucggcccugaaggauggaagcaaaauuaagcacgcaguguccaggggcucuucaaaaauccgauggauagucgagcgggggauggugaagccaaagggaaaagucguggaccucggcugcggucgugggggauggagcuacuacauggcuacgcuaaagaacguuaccgaaguaaaaggcuauacaaagggcgggcccggacaugaggaaccuaucccgauggccacuuacgguuggaaucuggugaaauugcacuccggcgucgauguguuuuauaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuacaugccaacaguaaucgaagagcucgagaaauuacagaggaagcacggcgguaaccuggugcgguguccccuuaguagaaauagcacccaugaaauguauuggguuucuggggcauccggaaacauugucucaagcgugaauacuacgucgaaaaugcugcuaaaccgcuuuacaaccaggcaccgaaagccuacuuacgagaaagacguggaucucggcgcuggcacccggucugucaguacagaaacggagaagccagacaugaccaucauagggagaaggcugcagcgcuugcaggaggaacauaaggagacuuggcacuaugaucaagaaaaucccuaccguacaugggccuaccacggauccuaugaggccccgagcaccgguucagcguccucuaugguuaacggcgugguaaaacugcucacuaagccuugggacgugauuccaauggucacacagcuugcuaugaccgauacaacucccuucgggcagcagcggguguuuaaagaaaagguugacaccagaacgccucaaccaaaacccggaaccaggauggugaugacaacuaccgcaaauuggcugugggccuuacugggcaagaagaaaaacccgcgcuugugcacacgagaggaguucaucagcaagguccggaguaaugcugccaucggugcaguguuucaggaagagcagggguggacuuccgccagcgaagcuguaaacgacucuagauucugggagcucguugauaaagaaagggcgcugcaucaagagggaaagugugagucaugcguguacaacaugaugggcaaacgcgaaaagaagcuaggcgaguuugggagagccaaaggaagucgggcaauuugguauauguggcuuggugcuagguuccuggaauucgaggcccucggcuuucugaaugaagaccacugguucgggcgugagaacuccuggagcggagucgagggcgaagguuugcaucgacugggguacauacucgaggaaaucgauaagaaagacggagaucuuauguaugcagacgauaccgccggcugggacacgcgcauuacagaggaugaccugcagaaugaggaauuaaucaccgagcagauggcuccucaccauaagauucuggccaaagcgaucuuuaaguugacuuaccagaacaagguggugaaaguccucagacccacaccacggggcgcaguuauggauauaaucucuaggaaggaccaacgcgggucgggacagguggguaccuauggccugaauacuuucaccaacauggaaguacagcuaauuagacagauggaggccgaaggggugaucacacaagaugacaugcagaauccuaaaggacuuaaggagcgggucgagaaauggcugagggaaugcggcguggaccgacucaagcguauggcuauuucaggugaugacuguguugugaaaccccuggaugagagauuugggacgagcuuguuauuccugaacgacaugggaaagguccgcaaggauaucccacagugggaacccuccaaaggcuggaagaauuggcaggaggugccuuuuugcagucaccacuuccauaaaauauuuaugaaggacggccggucucucguaguuccauguaggaaccaagaugaacuuauugggagagcccgcaucagccagggagcagguuggucccugcgggagaccgcuugccuaggcaaagccuacgcucagauguggucacugauguacuuccacaggcgagaccucagauuggccaguauggcaaucuguucugcggugccgacugagugguuucccacaagccggaccacuugguccauucaugcccaccaccaguggaugacaaccgaagauaugcugaaggucuggaauaggguguggauagaggacaacccuaauaugaucgauaagacgccaguucauucaugggaagacauucccuaucuugggaaacgcgaggaccuguggugcggaagccucaucggcuuaucuucccgugcuacaugggccaagaacauucacaccgcaaucacucaagugagaaaucugauagguaaagaagaguacgucgauuauaugccugugaugaagcgauacagugcuccaagcgagucggaagggguauuguga

SEQ ID NO: 15779 - RNA, 9867 nt, Artificial Sequence
  derived and/or modified CDS sequence (opt3) from DENV-4__KJ596661__SS-prME
agcaccauaacccugcucugccuuauucccacugugauggccuuccaccuguccacgcgggacggcgaaccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucaggauucugaucgguuuucuuguauuguggauugggaccaauucaagaaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaaacuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuagggggccuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgagcccugccgcgacacagaaagcugccuugagugagggaguuuacagaauuaugcagaggggcuuauucggcaagacccaggugggggucggaauccacauugaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaggcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaaaucagguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaguucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagagagggggccgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaacacucacgcuuugggaagggaacccuggacgguuuuggaacaccacuauugcagugagcacagccaauaucuuccgcggcuccuaucuggcuggugccggguuggcauuuucacugaucaagaacgcucagacaccccgaagaggaacuggcacagccggugagacccucggcgaaaaguggaaaaggcagcuaaauucuuuagaccggaaggaguucgaagaguacaagcgcagugggauucuugagguugacagaacggaagcgaaaucggcccugaaggauggaagcaaaaucaagcaugcaguguccaggggaucuucaaaaauucgauggaucgucgagcgggggauggugaagccaaagggaaaagucguggaccucggcugcggucgugggggauggagcuacuauauggcuacccuaaagaacguuacagaaguaaaaggcuacacuaagggcgggcccggacacgaggaaccuauaccgauggccaccuaugguuggaaucuggugaaauugcauuccggcgucgauguguuuuacaagcccacagagcaaguugacacucugcucugugauaucggggagaguucuagcaacccaaccauugaagagggaagaacacuucgcgugcugaagauggucgaaccuugguugucauccaaacccgaguucugcaucaaggugcugaauccuuauaugccaaccguaauugaagaacucgagaaauuacagaggaagcacggcgguaaccuggugcgguguccccuuaguagaaauagcacucacgaaauguacuggguuucuggggcauccggaaacaucgucucaagcgugaauacgacaucgaaaaugcugcuaaaccgcuuuaccacuaggcaucgaaagccuaccuaugagaaagacguggaucucggcgcuggcacacggucugucaguacggaaaccgagaagccagacaugacuauuaucgggagaaggcugcagcgcuugcaggaggaacacaaggagacauggcauuacgaucaagaaaaucccuaccguaccugggccuaucacggauccuacgaggccccgagcacugguucagcguccucuaugguuaacggcgugguaaaacugcucacaaagccuugggacgugauaccaauggucacccagcuugcuaugacagauacuacccccuucgggcagcagcggguguuuaaagaaaagguugacacgagaaccccucaaccaaaacccggaacaaggauggugaugacuaccacagcaaauuggcugugggccuuacugggcaagaagaaaaacccgcgcuugugcacucgagaggaguucauuagcaagguccggaguaaugcugccaucggugcaguguuucaggaagaacagggguggaccuccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaaucugguacauguggcuuggugcuagguuccuggaguucgaggcccucggcuuucugaaugaagaccauugguucgggcgugagaacuccuggagcggagucgagggcgaagguuugcaccgacugggguauauucucgaggaaauagauaagaaagacggagaucuuauguacgcagacgauacggccggcugggacacacgcaucaccgaggaugaccugcagaaugaggaauuaauuacugagcagauggcuccucaucacaagauccuggccaaagcgauuuuuaaguugacauaucagaacaagguggugaaaguccucagacccaccccacggggcgcaguuauggauaucauaucuaggaaggaccaacgcgggucgggacagguggguacuuacggccugaauaccuucacaaacauggaaguacagcuaaucagacagauggaggccgaaggggugauuacgcaagaugacaugcagaauccuaaaggacuuaaggagcgggucgagaaauggcugagggaaugcggcguggaccgacucaagcguauggcuaucucaggugaugacuguguugugaaaccccuggaugagagauuugggaccagcuuguuauuccugaacgacaugggaaaggcccgcaaggauauuccacagugggaacccuccaaaggcuggaagaauuggcaggaggucccuuuuugcagucaucacuuccacaaaaucuuuaugaaggacggccggucucucgugguaccauguaggaaccaagaugaacuuauagggagagcacgcauuagccagggagcugguuggucccugcgggagacugccugccuaggcaaggcuuacgcccagauguggucacugauguauuuccauaggcgagaccucagauuggcaaguauggcgaucuguucugccguuccgacagagugguuucccaccagccggacuacaugguccauccacgcucaucaccaguggaugaccacggaagauaugcugaagguguggaauagggucuggauugaggacaacccuaauaugauagauaagacaccagugcacucaugggaagacauccccuaccuugggaaacgcgaggaccuguggugcggaagccucauuggcuuaucuucccgugccaccugggcaaagaacauccauacugcuauuacccaaguuagaaaucugaucgguaaagaagaguauguggauuacaugccugucaugaagcgauauagugccccaagcgagucggaagggguguuguga

SEQ ID NO: 15780 - RNA, 9867 nt, Artificial Sequence
  derived and/or modified CDS sequence (opt3) from DENV-4__KJ596663__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuauccugggcgauaccauguccggcagaauagggggacagacacaucuagcuaucauggccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaacggagaagccagacaugaccaucauagggagaaggcugcagcgcuugcaggaggaacacaaggagacuuggcauuacgaucaagaaaaucccuaccguacaugggccuaucacggauccuacgaggccccgagcaccgguucagcguccucuaugguuaacggcgugguaaaacugcucacuaagccuugggacgugauuccaauggucacacagcuugcuaugaccgauacaacucccuucgggcagcagcggguguuuaaagaaaagguugacaccagaacgccucaaccaaaacccggaaccaggauggugaugacaacuaccgcaaauuggcugugggccuuacugggcaagaagaaaaacccgcgcuugugcacacgagaggaguucaucagcaagguccggaguaaugcugccaucggugcaguguuucaggaagagcagggguggacuuccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggagucgagggcgaagguuugcaccgacugggguauauacucgaggaaaucgauaagaaagacggagaucuuauguacgcagacgauaccgccggcugggacacgcgcauuacagaggaugaccugcagaaugaggaauuaaucaccgagcagauggcuccucaucacaagacucuggccaaagcgauuuuuaaguugacauaucagaacaagguggugaaaguccucagacccaccccacggggcgcaguuauggauaucauaucuaggaaggaccaacgcgggucgggacagguggguacuuacggccugaauaccuucacaaacauggaaguacagcuaaucagacagauggaggccgaaggggugauuacgcaagaugacaugcagaauccuaaaggacuuaaggagcgggucgagaaauggcugagggaaugcggcguggaccgacucaagcguauggcuaucucaggugaugacuguguugugaaaccccuggaugagagauuugggaccagcuuguuauuccugaacgacaugggaaagguccgcaaggauauuccacagugggaacccuccaaaggcuggaagaauuggcaggaggugccuuuuugcagucaucacuuccacaaaaucuuuaugaaggacggccggucucucguaguuccauguaggaaccaagaugaacuuauagggagagcccgcauuagccagggagcagguuggucccugcgggagacugcuugccuaggcaaagccuacgcucagauguggucacugauguauuuccauaggcgagaccucagauuggccaguauggcaaucuguucugcggugccgacagagugguuucccaccagccggacuacaugguccauccacgcccaucaccaguggaugaccacggaagauaugcugaaggucuggaauaggguguggauugaggacaacccuaauaugauagauaagacaccaguucacucaugggaagacauccccuaccuugggaaacgcgaggaccuguggugcggaagccucauuggcuuaucuucccgugcuaccugggccaagaacauccauacugcaauuacccaagugagaaaucugaucgguaaagaagaguaugucgauuacaugccugugaugaagcgauauagugcuccaagcgagucggaagggguauuguga

SEQ ID NO: 15781 - RNA, 9867 nt, Artificial Sequence
  derived and/or modified CDS sequence (opt3) from DENV-4__KJ596664__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaaucgccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaaucgagaagccagacaugacgauaauugggagaaggcugcagcgcuugcaggaggaacacaaggagaccuggcauuacgaucaagaaaaucccuaccguacuugggccuaucacggauccuacgaggccccgagcacagguucagcguccucuaugguuaacggcgugguaaaacugcucaccaagccuugggacgugaucccaauggucacucagcuugcuaugacagauaccacacccuucgggcagcagcggguguuuaaagaaaagguugacacuagaaccccucaaccaaaacccggaacgaggauggugaugaccacaacugcaaauuggcugugggccuuacugggcaagaagaaaaacccgcgcuugugcacccgagaggaguucaucagcaagguccggaguaaugcugccauuggugcaguguuucaggaagagcagggguggacauccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauaugguacauguggcuuggugcuagguuccuggaauucgaggcccucggcuuucugaaugaagaccauugguucgggcgugagaacuccuggagcggagucgagggcgaagguuugcaccgacugggguauauccucgaggaaauugauaagaaagacggagaucuuauguacgcagacgauacugccggcugggacacccgcaucacggaggaugaccugcagaaugaggaauuaauuacagagcagauggcuccucaucacaagauccuggccaaagcgauauuuaaguugaccuaucagaacaagguggugaaaguccucagacccacuccacggggcgcaguuauggauaucauuucuaggaaggaccaacgcgggucgggacagguggguacauacggccugaauaccuucacuaacauggaaguacagcuaaucagacagauggaggccgaaggggugauuacccaagaugacaugcagaauccuaaaggacuuaaggagcgggucgagaaauggcugagggaaugcggcguggaccgacucaagcguauggcuaucucaggugaugacuguguugugaaaccccuggaugagagauuugggacaagcuuguuauuccugaacgacaugggaaagguccgcaaggauauaccacagugggaacccuccaaaggcuggaagaauuggcaggaggugccuuuuugcagucaucacuuccacaaaauuuuuaugaaggacggccggucucucguaguuccauguaggaaccaagaugaacuuaucgggagagcccgcaucagccagggagcagguuggaaucugcgggagacggcuugccuaggcaaagccuacgcucagauguggucccugauguauuuccauaggcgagaccucagauuggccucaauggcaauuuguagugcggugccgaccgagugguuucccacuucucggacaaccuggagcauacacgcccaucaccaguggaugacuacagaagauaugcugaaggucuggaacaggguguggaucgaggacaauccuaacaugauugauaagaccccaguucacuccugggaagacauccccuaccuugggaaacgcgaggaccuguggugcggaucacucauuggcuuaagcucucgugcuacgugggccaagaauauccauacagcaauaacccaagugagaaaccugaucgguaaagaagaguaugucgauuacauguccgugaugaagcgauauagugcuccuagcgagucggaagggguauuguga

SEQ ID NO: 15782 - RNA, 9867 nt, Artificial Sequence
  derived and/or modified CDS sequence (opt3) from DENV-4__KJ596665__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccggucucaaguacucuuggaaaacguggggcaaggcuaaaauauucaccccagaagcccgcaacucgacuuuucugaucgacgggcccgauacaagcgagugcccuaaugaacggagagcauggaacuccuucgagguggaggacuacggauucggcauguuuaccacaaauauuuggaugaaguucagggaagggucaagugagguaugugaucaucgccuuaugucugcugccaucaaagaccagaaggcggugcacgccgauaugggauauuggauugaaagcuccaaaaaccaaacuuggcagaucgagcgagcuucauugauagaagucaagaccugccuguggccaaagacgcauacacucuggagcaauggcgugcuggagucucagauguuaaucccgaaauccuacgcaggucccuuuagucagcacaacuaucggcaaggguacgccacccagacuguuggaccuuggcaccugggcaagcuugagauugacuucggugaaugcccaggcaccacagugacuauccaggagaacugugaucaucgugggcccagcuugagaaccacaacggcuucuggaaaacucgucacccaguggugcuguagguccugcacuaugccuccacugcgcuuucuaggcgaagacggguguugguauggaauggagauucggccccugucagagaaggaagagaauauggugaaaagucaaguuacagccggccaggguaccagcgaaacuuucucgauggggcuccugugccuuacauuguuuguggaggaaugucugagaaggcgagucacccgcaagcacaugaucuuagcaguagugauaacgcucugcgcgauuauccugggaggccuuacuuggauggaucuguugcgggcccucauuauccugggcgacaccauguccgggagaauaggaggucagacacaucuagcuaucauggccguuuucaagaugucuccgggcuacgugcugggggucuuucucaggaaacugaccagccgugagacugcacuuauggugauuggaauggcuaugacaaccacauugucaaucccucacgaucugauggaguuaauugacggcaucagucucggucugauacuucugaagauuguaacucaguucgacaacacccaaguggggacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggagcgcaagccuugcccguguaucucaugacccugaugaagggcgcaagcaggcgaaguuggccucuaaaugagggcauaauggcuguugggcugguaucucuucucggauccgcccuguugaaaaacgaugugccccuggccgguccaauggucgcuggcggguuacuccuggcagccuacgugaugagcggaucgucagcggaccuuucucuggaaaaggcugccaauguucagugggaugagauggcagacaucacgggcaguuccccuauuaucgaagugaagcaggaugaggacgguagcuuuucuauucgggaugucgaggaaacaaacaugaucaccuugcucgugaaacuggcccuaauaacuguaagcgggcuguacccccuugcuaucccaauuacaaugacccucugguauauguggcaggucaagacucaacgcuccggagcacugugggacgugccgucaccugccgcgacacagaaagcugccuugagugagggcguuuacagaaucaugcagaggggcuuauucgggaagacccaggugggagucgguauucacauggaaggcguguuccacacgauguggcauguuacucgggggagcgugaucugucacgagaccggacgacuggaacccucuugggcagaugucagaaaugacaugauauccuauggcgguggguggcgccucggagauaaaugggacaaggaggaggaugugcaaguacuggccauugaaccaggcaagaaccccaaacaugugcagacaaagccuggccuuuuuaaaacccugacaggggagaucggagcuguuacuuuggacuucaagccagguaccucaggcagucccaucauuaauaggaaagggaaggucauaggacuauacggcaacgguguggugacgaaaagcggggacuaugucuccgccaucacacaggcagaacguauuggagagccugauuacgagguagacgaagauaucuuucggaagaagagacugacuauuauggaccuccacccgggcgcuggcaaaaccaagaggauccugccaucuauagugcgcgaggcccuuaaacgaagauuacggacacugauccucgcgcccaccaggguuguggccgcagaaauggaggaagcuuugcgcgggcugccuauucguuaucagacuccagccgucaagucggagcauaccggaagagagaucguggaucucaugugccacgcuacauucacgacucggcugcuuagcucaaccaggguucccaauuacaaccugauugugauggacgaagcacacuuuacagauccuuccagugucgccgcccgcgguuacaucucuacccgaguggagaugggcgaagcugcggcaauauucaugacugccacaccgcccggggcuaccgacccauuuccucaaagcaauucccccauugaggauaucgaaagagagaucccagagcggucauggaacacgggauucgacuggauuacugauuaucagggcaaaacaguaugguuugugccuucuaucaaggccgguaaugacauagcaaacugcuugaggaagagcgggaaaaagguuauucagcuaagucgcaaaaccuucgacaccgaauaccccaagacuaaacugacagauugggacuuugucgugaccacagauaucuccgagaugggcgccaacuucagagcuggaagggugauugacccacggcguugucucaagccggucaucuuaacugauggcccugaacgcguuauacuggcggggcccauuccagugacgcccgccagcgcagcucaacgaagaggaaggaucggucggaauccugcccaggaggacgaucaguauguauucucuggcgacccacuuaagaacgaugaagaccaugcacacuggaccgaggccaaaaugcugcucgauaauaucuacacacccgaggggauuaucccuacuuuguuuggaccggaacgcgagaagacccaggcuauugacggcgaauucagacugaggggugagcaacggaaaacauuuguggagcucaugcgaagaggggaucugccagucuggcuuucauauaagguggccuccgcgggcauaaguuacaaagaccgcgaauggugcuucaccggagagaggaacaaucagauccuagaagagaacauggaaguugagauuuggacucgggagggcgaaaagaagaaacugcgucccaagugguuggacgcaagaguguaugccgauccuauggcuuuaaaagacuuuaaggaguucgccagcgggaggaaaucgaucacgcuggauauccucaccgaaauugcuucucugcccacauaccuuuccagccgcgcaaagcuggcccucgacaauauagucauguugcauacuaccgagcggggaggucgagcuuaccagcacgcccugaacgaacuaccagagucacuggagacacucaugcuuguagcacuguuaggcgcgaugaccgccgggaucuuuuuguucuuuaugcagggaaagggcauugguaaacugaguauggggcucaucacuauugcuguggccucuggccugcuuuggguugcagaaauccaaccucaguggauagcugccuccaucauucuggaguucuuucucaugguguugcugauccccgaaccagagaagcagagaacaccucaggauaaucaauuaauuuaugucauccuaacgauacugaccauuaucggacucauugcagccaacgaaaugggccuuaucgagaaaacuaagacagacuucggguuuuaccaggugaaaaccgagaccacaauacuggaugucgacuugaggccggcuagcgcguggacucuguaugccguggcaacgaccauccucacacccaugcugcgccacacuauugaaaauaccucagcuaaccuuagucucgccgccaucgcaaaucaggcugccguucugaugggauugggcaaggguuggccacugcaucggauggauuuaggggugccucuacuggcgaugggauguuacagccagguaaaccccacaacccucacugcuucccuugugaugcuguugguccacuaugccauuaucggcccaggucugcaagcaaaagccacgagagaggcucagaagcguacagcagccggcauaaugaagaauccuaccguugacgggauuacugugaucgaucucgaacccaucucuuacgacccgaaauucgagaagcagcugggacaagucaugcuuuuagugcugugcgcgggccagcucuugcugaugaggaccacaugggcuuucugugagguacuaacucuggccaccgggccaauucucacacuuugggaaggaaacccuggccgguuuuggaacacgaccaucgcagugagcacugccaauauauuccgcgguuccuaucuggcuggggccggauuggcauuuucacugauuaaaaacgcucagacaccccgaagaggcaccgguacugccggcgagacacucggggaaaaguggaaaaggcagcugaauucuuuagaucggaaggaguucgaagaguacaagcgcaguggaauccuugagguugacagaaccgaagcgaaaucggcccugaaggacggcagcaaaauuaagcaugcaguguccagggggucuucaaaaauccgauggauagucgagcggggaauggugaagccaaagggcaaagucguggaucucgguugcgggcguggaggcuggagcuacuauauggcuacgcuaaagaacguuaccgaaguaaaaggcuacacaaaggggggacccggucacgaggaaccuaucccgauggccacuuauggcuggaaucuggugaaauugcauuccggggucgacguguuuuacaagcccaccgagcaaguugauacacugcucugugacauuggagagaguucuagcaacccaacuaucgaagagggcagaacccuucgcgugcugaagauggucgaaccuugguugucauccaaacccgaguucugcauuaaggugcugaauccuuauaugccaacaguaaucgaagagcucgagaaauuacagaggaagcacggugggaaccuggugcgguguccccuuaguagaaauagcacccacgaaauguacuggguuucuggagcauccggcaacauugucucaagcgugaauacuacgucgaaaaugcugcuaaaccgcuuuacaaccaggcaucgaaagccuacuuaugagaaagauguggaccucggcgcugggacccggucugucaguacagaaacggagaagccagauaugaccaucauaggaagaaggcugcagcgcuugcaggaggaacacaaggagacuuggcauuacgaccaagaaaaucccuaccguacaugggccuaucacgguuccuacgaggccccgagcaccggcucagcguccucuaugguuaacggggugguaaaacugcucacuaagccuugggaugugauuccaauggucacacagcuugcuaugaccgacacaacucccuucggacagcagcggguguuuaaagaaaagguugauaccagaacgccucaaccaaaacccggcaccaggauggugaugacaacuaccgcaaauuggcugugggccuuacuggguaagaagaaaaacccgcgcuugugcacacgagaggaguucaucagcaagguccggaguaaugcugccaucggggcaguguuucaggaagagcagggauggacuuccgccagcgaagcuguaaacgacucuagauucugggagcucguugacaaagaaagggcgcugcaccaagagggcaagugugagucaugcguguauaacaugaugggcaaacgcgaaaagaagcuaggggaguuuggaagagccaaagguagucgggcaauuugguacauguggcuuggcgcuagguuccuggaauucgaggcccucggguuucugaaugaagaucauugguucggacgugagaacuccuggagcggcgucgagggugaaggguugcaccgacugggauauauacucgaggaaaucgacaagaaagauggcgaccuuauguacgcagaugacaccgccggcugggauacgcgcauuacagaggacgaucugcagaaugaggaauuaaucaccgagcagauggcuccucaucacaagauucuggccaaagcgaucuuuaaguugacuuaucagaacaagguggugaaaguccucagacccacaccacggggggcaguuauggacauaaucucuaggaaggaucaacgcggaucgggucaggugggcaccuacgggcugaauacuuucaccaacauggaaguacagcuaauuagacagauggaggccgaaggagugaucacacaagacgauaugcagaauccuaaaggccuuaaggagcgggucgagaaauggcugagggaaugcgguguggaccgacucaagcguauggcuauuucaggggacgauuguguugugaaaccccuggacgagagauuuggaacgagcuuguuauuccugaacgauaugggcaagguccgcaaggacaucccacagugggaacccuccaaaggcuggaagaauuggcaggaggugccuuuuugcagucaucacuuccacaaaauauuuaugaaggaugggcggucucucguaguuccauguaggaaccaagacgaacuuauuggaagagcccgcaucagccagggugcaggcuggucccugcgggagaccgcuugccuagggaaagccuacgcucagauguggucacugauguauuuccauaggcgagaucucagauuggccaguauggcaaucuguucugcggugccgacugagugguuucccacaagccggaccacuugguccauucacgcccaucaccaguggaugacaaccgaaaauaugcugaaggucuggaacaggguguggauagaggacaauccuaacaugaucgauaagacgccaguucacucaugggaagacauucccuaccuuggaaaacgcgaggaucuguggugcggcagccucaucgguuuaucuucccgugcuacaugggccaagaauauucauaccgcaaucacucaagugagaaaccugauagggaaagaagaguaugucgacuacaugccugugaugaagcgauauagugcuccaagcgagucggaaggaguauuguga

SEQ ID NO: 15783 - RNA, 9867 nt, Artificial Sequence
  derived and/or modified CDS sequence (opt3) from DENV-4__KJ596668__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuauccugggcgauaccauguccggcagaauagggggacagacacaucuagcuaucauggccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccagucacaaugacccucugguauauguggcaggugaagacucaacgcuccggggcacugugggauguuccgucaccugccgcgacacagaaagcugccuugagugagggaguguacagaauuaugcagaggggcuuauucggcaagacccaggucggggugggaauccacauggaagguguuuuccacacgauguggcaugugacucggggcagcgucauuugucacgagaccgggcgacuggaacccucuugggcagacgugagaaaugauaugaucuccuauggaggcgguuggcgccucggggacaaaugggauaaggaggaggacguacaagugcuggccauagaaccaggaaagaaccccaaacauguucagacaaagccuggccuuuuuaaaacccugacaggcgagauuggggcugucacuuuggacuucaagccaggaaccucagguagucccaucaucaauaggaaaggcaaggugauugggcuauacggaaacggcguggucacgaaaagcggugauuauguauccgccauaacacaggcagaacguaucggggagccugacuacgagguggaugaagacauuuuucggaagaagagacugacuaucauggaucuccacccgggagcuggcaaaaccaagaggauucugccaucuaucguucgcgaggcccuuaaacgaagauuacggacacugauacucgcgcccaccaggguggucgccgcagaaauggaggaagcuuugcgcggccugccuauccguuaucagacuccagccgugaagucggagcauaccgggagagagauuguugaccucaugugccacgcuacauucacgacucggcugcuuagcucaaccagggugcccaauuacaaccugaucgucauggaugaagcacacuuuacagacccuuccaguguggccgcccgcggauacauuucuacccgaguagagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacagugugguuuguuccuucuauuaaggccggcaaugacaucgcaaacugcuugaggaagagcgguaaaaaggucauacagcuaagucgcaaaaccuucgauaccgaauaccccaagacuaaacugacagacugggauuuuguggugaccacagacauuuccgagaugggggccaacuucagagcuggcagggucaucgauccacggcguugucucaagccgguuauuuuaacugacggaccugaacgcgugauccuggcgggccccauaccaguaacgcccgccagcgcagcucaacgaagagggaggauuggacggaauccugcccaggaggaugaccaguauguguucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaauucagacugaggggcgagcaacggaaaacauuugucgagcucaugcgaagaggugaccugccaguguggcuuucauauaagguugccuccgcggggauuaguuacaaagaccgcgaauggugcuucaccggcgagaggaacaaucagauacuagaagagaacauggaaguggagaucuggacucgggagggagaaaagaagaaacugcgucccaagugguuggaugcaagagucuaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauuguaauguugcauacuaccgagcgggggggacgagcuuaccagcacgcccugaacgaacuaccagagucacuggagacacucaugcuuguggcacuguuaggugcgaugaccgccggcauauuuuuguucuuuaugcaggggaagggaaucggcaaacugaguaugggucucauuacuaucgcuguugccucugggcugcuuuggguggcagaaauucaaccucaguggaucgcugccuccauaauccuggaguucuuucucauggucuugcugauucccgaaccagagaagcagagaacaccucaggacaaucaauuaaucuaugugauucuaacgauccugaccauaauuggccucaucgcagccaacgaaaugggacuuauugagaaaacuaagacagauuucggcuuuuaccaggucaaaaccgagaccacaauccuggacguggauuugaggccggcuagcgcguggacucuguaugccguugcaacgaccauacucacacccaugcugcgccacacuaucgaaaauaccucagcuaaccuuagucucgccgccauugcaaaucaggcugccgugcugaugggguugggaaagggcuggccacugcaucggauggacuuagguguaccucuacuggcgaugggguguuacagccaggugaaccccacaacccucacugcuucccuugucaugcuguugguucacuaugccaucauuggaccaggccugcaagcaaaagccacgagagaggcucagaagcguacagcagccgguaucaugaagaauccuaccguggauggcauaacugucauugaccucgaacccaucucuuacgauccgaaauucgagaagcagcuggggcaagugaugcuuuuaguacugugcgcgggacagcucuugcugaugaggaccacaugggcuuucugugaggugcuaacucuggccaccggcccaauccucacacuuugggaagggaacccuggacgguuuuggaacacgaccauugcaguuagcacugccaauaucuuccgcggcuccuaucuggcuggugccggguuggcauuuucacugauaaaaaacgcucagacaccccgaagaggaaccggcacugccggugagacacucggcgaaaaguggaaaaggcagcugaauucuuuagaccggaaggaguucgaagaguacaagcgcagugggauucuugagguggacagaaccgaagcgaaaucggcccugaaggauggaagcaaaaucaagcaugcagucuccaggggcucuucaaaaauucgauggaucguggagcgggggauggucaagccaaagggaaaagugguugaccucggcugcggucgugggggauggagcuacuauauggcuacgcuaaagaacguaaccgaagugaaaggcuacacaaagggcgggcccggacacgaggaaccuauaccgauggccacuuaugguuggaaucuggucaaauugcauuccggcguggauguuuuuuacaagcccaccgagcaaguggacacacugcucugugauaucggggagaguucuagcaacccaacuauugaagagggaagaacccuucgcguccugaagaugguggaaccuugguugucauccaaacccgaguucugcaucaagguacugaauccuuauaugccaacagugauugaagagcucgagaaauuacagaggaagcacggcgguaaccugguucgguguccccuuaguagaaauagcacccacgaaauguacugggucucuggggcauccggaaacaucgugucaagcgugaauacuacgucgaaaaugcugcuaaaccgcuuuacaaccaggcaucgaaagccuacuuaugagaaagacgucgaucucggcgcuggcacccggucuguuaguacagaaacggagaagccagacaugaccauuaucgggagaaggcugcagcgcuugcaggaggaacacaaggagacuuggcauuacgaucaagaaaaucccuaccguacaugggccuaucacggauccuacgaggccccgagcaccgguucagcguccucuauggugaacggcguagugaaacugcucacuaagccuugggacgucauaccaauggugacacagcuugcuaugaccgauacaacucccuucgggcagcagcggguuuuuaaagaaaagguggacaccagaacgccucaaccaaaacccggaaccaggauggucaugacaacuaccgcaaauuggcugugggccuuacugggcaagaagaaaaacccgcgcuugugcacacgagaggaguucauuagcaaggugcggaguaaugcugccaucggugcaguauuucaggaagagcagggguggacuuccgccagcgaagcuguuaacgacucuagauucugggagcucguggauaaagaaagggcgcugcaccaagagggaaagugugagucaugcgucuauaacaugaugggcaaacgcgaaaagaagcuaggcgaguuugggagagccaaaggaagucgggcaaucugguacauguggcuuggugcuagguuccuggaauucgaggcccucggcuuucugaaugaagaccauugguucgggcgugagaacuccuggagcggaguggagggcgaagguuugcaccgacugggguauauucucgaggaaauagauaagaaagacggagaucuuauguacgcagacgauaccgccggcugggacacgcgcaucacagaggaugaccugcagaaugaggaauuaauuaccgagcagauggcuccucaucacaagauccuggccaaagcgauuuuuaaguugacuuaucagaacaagguggucaaaguucucagacccacaccacggggcgcagugauggauaucauaucuaggaaggaccaacgcgggucgggacagguagguaccuacggccugaauacuuucaccaacauggaagugcagcuaaucagacagauggaggccgaaggggucauuacacaagaugacaugcagaauccuaaaggacuuaaggagcggguggagaaauggcugagggaauacggcguugaccgacucaagcguauggcuaucucaggugaugacugcguggucaaaccccuggaugagagauuugggacgagcuuguuauuccugaacgacaugggaaaggugcgcaaggauauuccacagugggaacccuccaaaggcuggaagaauuggcaggagguaccuuuuuguagucaucacuuccacaaaaucuuuaugaaggacggccggucucucguugugccaugcaggaaccaagaugaacuuauagggagagcccgcauuagccagggagcagguuggucccugcgggagaccgcuugucuaggcaaagccuaugcucagauguggucacugauguacuuccauaggcgagaccucagauuggccaguauggcaaucugcucugcggucccgacugagugguuucccacaagccggaccacuugguccauccacgcccaucaccaguggaugacaaccgaagauaugcugaagguguggaauaggguuuggauugaggacaacccuaauaugauagauaagacgccagugcacucaugggaagacauccccuaucuugggaaacgcgaggaccugugguguggaagccucauuggcuuaucuucccgugcuacaugggccaagaacauccauaccgcaauuacucaagucagaaaucugaucgguaaagaagaguacguggauuauaugccuguaaugaagcgauacagugcuccaagcgagucggaagggguguuguga

SEQ ID NO: 15784 - RNA, 9867 nt, Artificial Sequence
  derived and/or modified CDS sequence (opt3) from DENV-4__KJ596670__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuguucuggggggacuuacuuggauggaccuguugcgggcccucaucaugcugggcgauaccauguccggcagaauugggggacagacacaucuagcuaucauagccguguucaagaugucuccggguuacguccugggcguguuucucaggaaacugaccagccgugagacugcacuuaugguaaucgggauggcuaugacaaccacauugucaauuccucacgaccugauggaguuaaucgacggaauuagucucggccugauccuucugaagauagugacucaguucgauaacacccaagucgguacgcuagcccucucccugacauuuauucgcucuaccaugagcuugguuauggcauggcggacuaucauggccgugcuguucguggucaccuuaaucccacucuguagaacauccugccugcagaaacagucacauuggguggaaauuacugcucuuauccugggggcgcaagccuugcccguuuaucucaugacccugaugaagggagcaagcaggcgaaguuggccucuaaaugagggcauuauggcuguaggccuggugucucuucucggguccgcccuguugaaaaacgacgucccccuggccggaccaaugguggcugguggcuuacuccuggcagccuacguuaugagcgggucgucagcggaucuuucucuggaaaaggcugccaaugugcagugggacgagauggcagauauaacgggaaguuccccuaucauugaagucaagcaggacgaggauggcagcuuuucuauccgggacguggaggaaacaaacaugauuaccuugcucguaaaacuggcccuaaucacugucagcggucuguacccccuugcuauaccaaucacaaugacccucugguauauguggcaggugaagacucaacgcuccggggcacugugggauguuccgucaccugccgcgacacagaaagcugccuugagugagggaguguacagaauuaugcagaggggcuuauucggcaagacccagaucggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaaucgagaagccagacaugacgauaauugggagaaggcugcagcgcuugcaggaggaacacaaggagaccuggcauuacgaucaagaaaaucccuaccguacuugggccuaucacggauccuacgaggccccgagcacagguucagcguccucuaugguuaacggcgugguaaaacugcucaccaagccuugggacgugaucccaauggucacucagcuugcuaugacagauaccacacccuucgggcagcagcggguguuuaaagaaaagguugacacuagaaccccucaaccaaaacccggaacgaggauggugaugaccacaacugcaaauuggcugugggccuuacugggcaagaagaaaaacccgcgcuugugcacccgagaggaguucaucagcaagguccggaguaaugcugccauuggugcaguguuucaggaagagcagggguggacauccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauaugguacauguggcuuggugcuagguuccuggaauucgaggcccucggcuuucugaaugaagaccauugguucgggcgugagaacuccuggagcggagucgagggcgaagguuugcaccgacugggguauauccucgaggaaauugauaagaaagacggagaucuuauguacgcagacgauacugccggcugggacacccgcaucacggaggaugaccugcagaaugaggaauuaauuacagagcagauggcuccucaucacaagauccuggccaaagcgauauuuaaguugaccuaucagaacaagguggugaaaguccucagacccacuccacggggcgcaguuauggauaucauuucuaggaaggaccaacgcgggucgggacagguggguacauacggccugaauaccuucacuaacauggaaguacagcuaaucagacagauggaggccgaaggggugauuacccaagaugacaugcagaauccuaaaggacuuaaggagcgggucgagaaauggcugagggaaugcggcguggaccgacucaagcguauggcuaucucaggugaugacuguguugugaaaccccuggaugagagauuugggacaagcuuguuauuccugaacgacaugggaaagguccgcaaggauauaccacagugggaacccuccaaaggcuggaagaauuggcaggaggugccuuuuugcagucaucacuuccacaaaauuuuuaugaaggacggccggucucucguaguuccauguaggaaccaagaugaacuuaucgggagagcccgcaucagccagggagcagguuggucccugcgggagacggcuugccuaggcaaagccuacgcucagauguggucacugauguauuuccauaggcgagaccucagauuggccaguauggcaauuuguucugcggugccgaccgagugguuucccacuagccggacaaccugguccauacacgcccaucaccaguggaugacuacagaagauaugcugaaggucuggaauaggguguggaucgaggacaacccuaauaugauugauaagaccccaguucacucaugggaagacauccccuaccuugggaaacgcgaggaccuguggugcggaagccucauuggcuuaucuucccgugcuacgugggccaagaacauccauacagcaauaacccaagugagaaaucugaucgguaaagaagaguaugucgauuacaugagugugaugaagcgauauagcgcuccuucggaguccgaagggguauuguga

SEQ ID NO: 15785 - RNA, 9867 nt, Artificial Sequence
  derived and/or modified CDS sequence (opt3) from DENV-4__KJ596671__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaaucgccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguuggcauuuucacugauuaaaaacgcucagacaccccgaagaggaaccggcacugccggugagacacucggcgaaaaguggaaaaggcagcugaauucuuuagaccggaaggaguucgaagaguacaagcgcagugggauccuugagguugacagaaccgaagcgaaaucggcccugaaggauggaagcaaaauuaagcaugcaguguccaggggcucuucaaaaauccgauggauagucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuaucccgauggccacuuaugguuggaaucuggugaaauugcauuccggcgucgauguguuuuacaagcccaccgagcaaguugacacacugcucugugauauuggggagaguucuagcaacccaacuaucgaagagggaagaacccuucgcgugcugaagauggucgaaccuugguugucauccaaacccgaguucugcauuaaggugcugaauccuuauaugccaacaguaaucgaagagcucgagaaauuacagaggaagcacggcgguaaccuggugcgguguccccuuaguagaaauagcacccacgaaauguacuggguuucuggggcauccggaaacauugucucaagcgugaauacuacgucgaaaaugcugcuaaaccgcuuuacaaccaggcaucgaaagccuacuuaugagaaagacguggaucucggcgcuggcacccggucugucaguacagaaaucgagaagccagacaugacgauaauugggagaaggcugcagcgcuugcaggaggaacacaaggagaccuggcauuacgaucaagaaaaucccuaccguacuugggccuaucacggauccuacgaggccccgagcacagguucagcguccucuaugguuaacggcgugguaaaacugcucaccaagccuugggacgugaucccaauggucacucagcuugcuaugacagauaccacacccuucgggcagcagcggguguuuaaagaaaagguugacacuagaaccccucaaccaaaacccggaacgaggauggugaugaccacaacugcaaauuggcugugggccuuacugggcaagaagaaaaacccgcgcuugugcacccgagaggaguucaucagcaagguccggaguaaugcugccauuggugcaguguuucaggaagagcagggguggacauccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaauaugguacauguggcuuggugcuagguuccuggaauucgaggcccucggcuuucugaaugaagaccauugguucgggcgugagaacuccuggagcggagucgagggcgaagguuugcaccgacugggguauauccucgaggaaauugauaagaaagacggagaucuuauguacgcagacgauacugccggcugggacacccgcaucacggaggaugaccugcagaaugaggaauuaauuacagagcagauggcuccucaucacaagauccuggccaaagcgauauuuaaguugaccuaucagaacaagguggugaaaguccucagacccacuccacggggcgcaguuauggauaucauuucuaggaaggaccaacgcgggucgggacagguggguacauacggccugaauaccuucacuaacauggaaguacagcuaaucagacagauggaggccgaaggggugauuacccaagaugacaugcagaauccuaaaggacuuaaggagcgggucgagaaauggcugagggaaugcggcguggaccgacucaagcguauggcuaucucaggugaugacuguguugugaaaccccuggaugagagauuugggacaagcuuguuauuccugaacgacaugggaaagguccgcaaggauauaccacagugggaacccuccaaaggcuggaagaauuggcaggaggugccuuuuugcagucaucacuuccacaaaauuuuuaugaaggacggccggucucucguaguuccauguaggaaccaagaugaacuuaucgggagagcccgcaucagccagggagcagguuggucccugcgggagacggcuugccuaggcaaagccuacgcucagauguggucacugauguauuuccauaggcgagaccucagauuggccaguauggcaauuuguucugcggugccgaccgagugguuucccacuagccggacaaccugguccauacacgcccaucaccaguggaugacuacagaagauaugcugaaggucuggaauaggguguggaucgaggacaacccuaauaugauugauaagaccccaguucacucaugggaagacauccccuaccuugggaaacgcgaggaccuguggugcggaagccucauuggcuuaucuucccgugcuacgugggccaagaacauccauacagcaauaacccaagugagaaaucugaucgguaaagaagaguaugucgauuacaugagugugaugaagcgauauagcgcuccuucggaguccgaagggguauuguga

SEQ ID NO: 15786 - RNA, 9867 nt, Artificial Sequence
  derived and/or modified CDS sequence (opt3) from DENV-4__KJ579241__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaagaucccccaugccaaaaggcaggaugucaccgugcucggaucucaggaaggugcgaugcacuccgcccuggcaggcgcuacugagguugacucaggggauggaaaccacauguuugccggccaucuuaaguguaaggugcggauggaaaaacugcgaaucaaggguaugagcuauacaaugugcagugggaaauucucuauugacaaggagauggcugagacgcaacacggcaccacuguagucaaagugaaguacgaaggagccggcgcaccuuguaagguuccaauagagauccgcgaugugaauaaagaaaaggucguggggagaguaauuuccgccacacccuuggcugagaacaccaacagcgugacaaauaucgagcucgaaccgccuuucggagacucguauauaguuauuggugucggcaacucugcgcugacuuuacauugguuuaggaaaggguccucaaucggaaagauguucgagaguaccuaccggggcgcaaaacgcauggccauccugggugaaacggcuugggauuuugggagcgugggcggacuauucaccucccucggcaaggccgugcaccaggucuuugggucuguuuauacaacuauguucggaggcgugagcuggaugauuagaauccugauugguuuucuuguguuguggauagggaccaauucaaggaacacaaguauggcaaugacuugcaucgccguaggaggcauuacccuguuccucgguuuuacgguccaggcugacaugggcugugugguuuccuggagcgggcgugagcugaagugcggaucuggcaucuucguggucgauaaugugcauacauggaccgaacaauacaaauuucagcccgagucaccagcccggcuugcaagugcgauccugaacgcucacaaggacgggguuuguggaauucgaagcacuacaagauuggagaaugugauguggaaacagauaaccaacgaacucaauuauguacugugggagggcggucacgacuuaacugucguggccggggaugugaagggaguccugaccaaaggcaagagggcacuaacaccucccgccuccgaccucaaguacucuuggaaaacgugggguaaggcuaaaaucuucaccccagaagcccgcaacucgacuuuucugauugauggccccgacacaagcgagugcccuaaugaacggagagcauggaacuccuucgagguugaggauuacggguucggaauguuuaccacaaauaucuggaugaaguucagggaaggcucaagugaggugugugaccaucgccuuaugucugcugccauuaaagaucagaaggcgguacacgccgacaugggguauuggaucgaaagcuccaaaaaccaaacuuggcagauagagcgagcuucauugaucgaagugaagaccugccuguggccaaagacgcauacacucuggagcaauggaguccuggagucucagauguuaauuccgaaauccuacgcaggccccuuuagucagcacaacuaucggcaagguuacgccacccagacuguggggccuuggcaccugggaaagcuugagaucgauuucggcgaaugcccagguaccacaguuacuauucaggagaacugugaccaucguggccccagcuugagaaccacaacggcuucugggaaacucgugacccaguggugcuguagguccugcacuaugccuccacugcgcuuucuaggagaagauggcuguugguaugggauggagauccggccccugucagagaaggaagagaauauggucaaaagucaagugacagccggacagggcaccagcgaaacuuucucgaugggucuccugugccuuacauuguuuguugaggaaugucugagaaggcgagugacccgcaagcacaugauauuagcagucguaauuacgcucugcgcgaucauucuggggggacuuacuuggauggaccuguugcgggcccucaucauacugggcgauaccauguccggcagaaucgggggacagacacaucuagcuauuauggccguguucaagaugucuccggguuacguucugggcguguuucucaggaaacugaccagccgugagacugcacuuauggucaucgggauggcuaugacaaccacauugucaauuccucacgaccugauggaguuaaucgacggaauaagucucggccugauucuucugaagaucgugacucaguucgauaacacccaaguagguacgcuagcccucucccugacauuuauccgcucuaccaugagcuuggugauggcauggcggacuauuauggccguccuguucguugugaccuuaaucccacucuguagaacauccugccugcagaaacagucacauuggguggaaauuacugcucuuauacugggggcgcaagccuugcccgucuaucucaugacccugaugaagggagcaagcaggcgaaguuggccucuaaaugagggcaucauggcugugggccugguuucucuucucggguccgcccuguugaaaaacgacguaccccuggccggaccaaugguggcugguggcuuacuccuggcagccuacgucaugagcgggucgucagcggaucuuucucuggaaaaggcugccaaugugcagugggacgagauggcagauauuacgggaaguuccccuaucauugaaguuaagcaggacgaggauggcagcuuuucuauccgggacguggaggaaacaaacaugauaaccuugcucgucaaacuggcccuaaucacugugagcggucuguacccccuugcuauuccaaucacaaugacccucugguauauguggcagguaaagacucaacgcuccggggcacugugggaugucccgucaccugccgcgacacagaaagcugccuugagugagggaguguacagaauuaugcagaggggcuuauucggcaagacccagguuggggugggaauccacauggaaggugucuuccacacgauguggcaugugacucggggcagcguuauaugucacgagaccgggcgacuggaacccucuugggcagacgugagaaaugauaugauuuccuauggaggcgguuggcgccucggggacaaaugggauaaggaggaggacguccaagugcuggccaucgaaccaggaaagaaccccaaacauguacagacaaagccuggccuuuuuaaaacccugacaggcgagaucggggcugugacuuuggacuucaagccaggaaccucagguagucccauuauaaauaggaaaggcaagguuaucgggcuauacggaaacggcgucgugacgaaaagcggugauuauguguccgccauuacacaggcagaacguaucggggagccugacuacgaggucgaugaagacauuuuucggaagaagagacugacuaucauggaucuccacccgggagcuggcaaaaccaagaggauacugccaucuaucguacgcgaggcccuuaaacgaagauuacggacacugauucucgcgcccaccagggugguugccgcagaaauggaggaagcuuugcgcggccugccuauccguuaucagacuccagccgugaagucggagcauaccgggagagagauugucgaccucaugugccacgcuacauucacgacucggcugcuuagcucaaccagggugcccaauuacaaccugaucguuauggaugaagcacacuuuacagacccuuccaguguggccgcccgcggauacauaucuacccgagucgagaugggugaagcugcggcaauuuucaugacugccacaccgcccggcgcuaccgauccauuuccucaaagcaauucccccaucgaggacaucgaaagagagauuccagagcggucauggaacacgggguucgauuggaucacugacuaucagggaaaaacagugugguuuguaccuucuauaaaggccggcaaugacauugcaaacugcuugaggaagagcgguaaaaaggugauccagcuaagucgcaaaaccuucgauaccgaauaccccaagacuaaacugacagacugggauuuuguugucaccacagacauuuccgagaugggggccaacuucagagcuggcagggugaucgauccacggcguugucucaagccggugauauuaacugacggaccugaacgcgucauucuggcgggccccaucccaguuacgcccgccagcgcagcucaacgaagagggaggaucggacggaauccugcccaggaggaugaccaguauguguucucuggugauccacuuaagaacgacgaagaucaugcacacuggaccgaggccaaaaugcugcucgacaauauuuacacacccgagggcaucauuccuacuuuguuugggccggaacgcgagaagacccaggcuauagauggagaauucagacugaggggcgagcaacggaaaacauuuguagagcucaugcgaagaggugaccugccaguguggcuuucauauaaggucgccuccgcggggaucaguuacaaagaccgcgaauggugcuucaccggcgagaggaacaaucagauucuagaagagaacauggaaguggagaucuggacucgggagggagaaaagaagaaacugcgucccaagugguuggaugcaagaguuuaugccgacccuauggcuuuaaaagauuuuaaggaguucgccagcggcaggaaaucgaucacgcuggacauucucaccgaaauagcuucucugcccacauaccuuuccagccgcgcaaagcuggcccucgauaauaucgugauguugcauacuaccgagcgggggggacgagcuuaccagcacgcccugaacgaacuaccagagucacuggagacacucaugcuugucgcacuguuaggugcgaugaccgccggcauuuuuuuguucuuuaugcaggggaagggaaucggcaaacugaguaugggucucauuacuaucgcuguagccucugggcugcuuuggguggcagaaauacaaccucaguggaucgcugccuccauuauccuggaguucuuucucaugguuuugcugauucccgaaccagagaagcagagaacaccucaggacaaucaauuaaucuaugugauacuaacgauucugaccaucauuggccucaucgcagccaacgaaaugggacuuauagagaaaacuaagacagauuucggcuuuuaccaggucaaaaccgagaccacaauccuggacguggauuugaggccggcuagcgcguggacucuguaugccgucgcaacgaccauucucacacccaugcugcgccacacuaucgaaaauaccucagcuaaccuuagucucgccgccauugcaaaucaggcugccgugcugaugggguugggaaagggcuggccacugcaucggauggacuuagguguuccucuacuggcgaugggguguuacagccaggugaaccccacaacccucacugcuucccuuguaaugcuguuggugcacuaugccaucauaggaccaggccugcaagcaaaagccacgagagaggcucagaagcguacagcagccgguauuaugaagaauccuaccgucgauggcaucacuguuaucgaccucgaacccauuucuuacgauccgaaauucgagaagcagcuggggcaagugaugcuuuuaguccugugcgcgggacagcucuugcugaugaggaccacaugggcuuucugugaggugcuaacucuggccaccggcccaauccucacacuuugggaagggaacccuggacgguuuuggaacacgaccauagcaguaagcacugccaauauuuuccgcggcuccuaucuggcuggugccggguuggcauuuucacugaucaaaaacgcucagacaccccgaagaggaaccggcacugccggugagacacucggcgaaaaguggaaaaggcagcugaauucuuuagaccggaaggaguucgaagaguacaagcgcagugggauucuugagguggacagaaccgaagcgaaaucggcccugaaggauggaagcaaaaucaagcaugcaguuuccaggggcucuucaaaaauacgauggaucguggagcgggggauggucaagccaaagggaaaaguggucgaccucggcugcggucgugggggauggagcuacuauauggcuacgcuaaagaacgugaccgaaguuaaaggcuacacaaagggcgggcccggacacgaggaaccuauuccgauggccacuuaugguuggaaucugguaaaauugcauuccggcguggaugucuuuuacaagcccaccgagcaaguggacacacugcucugugauaucggggagaguucuagcaacccaacuauugaagagggaagaaccaugcgcguucuuaagaugguggaaccuuggcugucauccaaacccgaguucugcaucaaggucuugaauccuuauaugccaacagugauugaagagcuggagaaacuccagaggaagcacggcgguaacuuaguacgguguccccugaguagaaauagcacccacgaaauguacugggugucuggggcauccggaaacaucguuucaagcgucaauacuacgucgaaaaugcuucugaaccgcuuuacaaccaggcaucgaaagccuacuuaugagaaagacguggaucuaggcgcuggcacccggucugugaguacagaaacggagaagccagacaugaccauaauugggagaaggcuccagcgccugcaggaggaacacaaggagacuuggcauuacgaucaagaaaaucccuaccguacaugggccuaucacggauccuacgaggccccgagcaccgguucagcguccucuauggucaacggcguugugaaauugcugacuaagccuugggacguaaucccaauggugacacagcucgcuaugaccgauacaacucccuucgggcagcagcgggucuuuaaagaaaagguggacaccagaacgccucaaccaaaacccggaaccaggaugguuaugacaacuaccgcaaauuggcuuugggcccuguuaggcaagaagaaaaacccgcgccugugcacacgagaggaguucaucagcaaggugcggaguaaugcugccauuggugcagucuuucaggaagagcagggguggacuuccgccagcgaagcugugaacgacucuagauucugggaguugguagauaaagaaagggcgcuccaccaagagggaaagugugagucaugcguuuauaacaugaugggcaaacgcgaaaagaagcugggcgaguuugggagagccaaaggaagucgggcaauaugguacauguggcuaggugcuagguuccuugaauucgaggcccugggcuuucucaaugaagaccauugguucgggcgugagaacuccuggagcggaguggagggcgaaggucugcaccgauugggguauauccuggaggaaauugauaagaaagacggagaucucauguacgcagacgauaccgccggcugggacacgcgcaucacagaggaugaccuucagaaugaggaacugauuaccgagcagauggcuccucaucacaagaucuuagccaaagcgauauuuaagcugacuuaucagaacaaggucgugaaaguguugagacccacaccacggggcgcagucauggauaucauuucuaggaaggaccaacgcgggucgggacagguugguaccuacggccucaauacuuucaccaacauggaagugcagcugaucagacagauggaggccgaagggguaauuacacaagaugacaugcagaauccuaaaggacuaaaggagcggguggagaaauggcuuagggaaugcggcgucgaccgacugaagcguauggcuaucucaggugaugacugugugguuaaaccccucgaugagagauuugggacgagccuguuguucuuaaacgacaugggaaaggugcgcaaggauauaccacagugggaacccuccaaaggcuggaagaauuggcaggaggucccuuuuugcagucaucacuuccacaaaauuuuuaugaaggacggccggucucuggugguaccauguaggaaccaagaugaacucaucgggagagcccgcaucagccagggagcagguuggucccuucgggagaccgcuugccugggcaaagccuacgcucagauguggucacuaauguauuuccauaggcgagaccugagacucgccaguauggcaauuuguucugcgguuccgacugagugguuucccacaagccggaccacuugguccauacacgcccaucaccaguggaugacaaccgaagauauguugaagguguggaauagggucuggaucgaggacaacccuaauaugauugauaagacgccagugcacucaugggaagacauccccuaccuggggaaacgcgaggaccuuuggugcggaagccugauuggccucucuucccgugcuacaugggccaagaacauccauaccgcaauaacucaaguuagaaauuuaaucgguaaagaagaguauguggauuacaugccugucaugaagcgauauagugcuccaagcgagucggaaggggugcuguga

SEQ ID NO: 15787 - RNA, 9867 nt, Artificial Sequence
  derived and/or modified CDS sequence (opt3) from DENV-4__KJ596672__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaaucgccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccaguaucgccgcccgcggauacauaucuacccgagucgagaugggugaagcugcggcaauuuucaugacugccacaccgcccggcgcuaccgauccauuuccucaaagcaauucccccaucgaggacaucgaaagagagauuccagagcggucauggaacacgggguucgauuggaucacugacuaucagggaaaaacagugugguuuguaccuucuauaaaggccggcaaugacauugcaaacugcuugaggaagagcgguaaaaaggugauccagcuaagucgcaaaaccuucgauaccgaauaccccaagacuaaacugacagacugggauuuuguugucaccacagacauuuccgagaugggggccaacuucagagcuggcagggugaucgauccacggcguugucucaagccggugauauuaacugacggaccugaacgcgucauucuggcgggccccaucccaguuacgcccgccagcgcagcucaacgaagagggaggaucggacggaauccugcccaggaggaugaccaguauguguucucuggugauccacuuaagaacgacgaagaucaugcacacuggaccgaggccaaaaugcugcucgacaauauuuacacacccgagggcaucauuccuacuuuguuugggccggaacgcgagaagacccaggcuauagauggagaauucagacugaggggcgagcaacggaaaacauuuguagagcucaugcgaagaggugaccugccaguguggcuuucauauaaggucgccuccgcggggaucaguuacaaagaccgcgaauggugcuucaccggcgagaggaacaaucagauucuagaagagaacauggaaguggagaucuggacucgggagggagaaaagaagaaacugcgucccaagugguuggaugcaagaguuuaugccgacccuauggcuuuaaaagauuuuaaggaguucgccagcggcaggaaaucgaucacgcuggacauucucaccgaaauagcuucucugcccacauaccuuuccagccgcgcaaagcuggcccucgauaauaucgugauguugcauacuaccgagcgggggggacgagcuuaccagcacgcccugaacgaacuaccagagucacuggagacacucaugcuugucgcacuguuaggugcgaugaccgccggcauuuuuuuguucuuuaugcaggggaagggaaucggcaaacugaguaugggucucauuacuaucgcuguagccucugggcugcuuuggguggcagaaauacaaccucaguggaucgcugccuccauuauccuggaguucuuucucaugguuuugcugauucccgaaccagagaagcagagaacaccucaggacaaucaauuaaucuaugugauacuaacgauucugaccaucauuggccucaucgcagccaacgaaaugggacuuauagagaaaacuaagacagauuucggcuuuuaccaggucaaaaccgagaccacaauccuggacguggauuugaggccggcuagcgcguggacucuguaugccgucgcaacgaccauucucacacccaugcugcgccacacuaucgaaaauaccucagcuaaccuuagucucgccgccauugcaaaucaggcugccgugcugaugggguugggaaagggcuggccacugcaucggauggacuuagguguuccucuacuggcgaugggguguuacagccaggugaaccccacaacccucacugcuucccuuguaaugcuguuggugcacuaugccaucauaggaccaggccugcaagcaaaagccacgagagaggcucagaagcguacagcagccgguauuaugaagaauccuaccgucgauggcaucacuguuaucgaccucgaacccauuucuuacgauccgaaauucgagaagcagcuggggcaagugaugcuuuuaguccugugcgcgggacagcucuugcugaugaggaccacaugggcuuucugugaggugcuaacucuggccaccggcccaauccucacacuuugggaagggaacccuggacgguuuuggaacacgaccauagcaguaagcacugccaauauuuuccgcggcuccuaucuggcuggugccggguuggcauuuucacugaucaaaaacgcucagacaccccgaagaggaaccggcacugccggugagacacucggcgaaaaguggaaaaggcagcugaauucuuuagaccggaaggaguucgaagaguacaagcgcagugggauucuugagguggacagaaccgaagcgaaaucggcccugaaggauggaagcaaaaucaagcaugcaguuuccaggggcucuucaaaaauacgauggaucguggagcgggggauggucaagccaaagggaaaaguggucgaccucggcugcggucgugggggauggagcuacuauauggcuacgcuaaagaacgugaccgaaguuaaaggcuacacaaagggcgggcccggacacgaggaaccuauuccgauggccacuuaugguuggaaucugguaaaauugcauuccggcguggaugucuuuuacaagcccaccgagcaaguggacacacugcucugugauaucggggagaguucuagcaacccaacuauugaagagggaagaacccuucgcguucugaagaugguggaaccuugguugucauccaaacccgaguucugcaucaagguccugaauccuuauaugccaacagugauugaagagcucgagaaauuacagaggaagcacggcgguaaccugguacgguguccccuuaguagaaauagcacccacgaaauguacugggugucuggggcauccggaaacaucguuucaagcgucaauacuacgucgaaaaugcugcuaaaccgcuuuacaaccaggcaucgaaagccuacuuaugagaaagacguggaucucggcgcuggcacccggucugugaguacagaaauagagaagccagacaugacgauuaucgggagaaggcugcagcgcuugcaggaggaacacaaggagaccuggcauuacgaucaagaaaaucccuaccguacuugggccuaucacggauccuacgaggccccgagcacagguucagcguccucuauggucaacggcguugugaaacugcucaccaagccuugggacguaaucccaauggugacucagcuugcuaugacagauaccacacccuucgggcagcagcgggucuuuaaagaaaagguggacacuagaaccccucaaccaaaacccggaacgaggaugguuaugaccacaacugcaaauuggcugugggccuuacugggcaagaagaaaaacccgcgcuugugcacccgagaggaguucauuagcaaggugcggaguaaugcugccauaggugcagucuuucaggaagagcagggguggacauccgccagcgaagcugugaacgacucuagauucugggagcucguagauaaagaaagggcgcugcaccaagagggaaagugugagucaugcguuuauaacaugaugggcaaacgcgaaaagaagcuaggcgaguuugggagagccaaaggaagucgggcaaucugguacauguggcuuggugcuagguuccuggaauucgaggcccucggcuuucugaaugaagaccauugguucgggcgugagaacuccuggagcggaguggagggcgaagguuugcaccgacugggguauauucucgaggaaaucgauaagaaagacggagaucuuauguacgcagacgauacugccggcugggacacccgcauuacggaggaugaccugcagaaugaggaauuaaucacagagcagauggcuccucaucacaagauacuggccaaagcgaucuuuaaguugaccuaucagaacaaggucgugaaagugcucagacccacuccacggggcgcagucauggauauuaucucuaggaaggaccaacgcgggucgggacagguugguacauacggccugaauaccuucacuaacauggaagugcagcuaauuagacagauggaggccgaagggguaaucacccaagaugacaugcagaauccuaaaggacuuaaggagcggguggagaaauggcugagggaaugcggcgucgaccgacucaagcguauggcuauaucaggugaugacugugugguuaaaccccuggaugagagauuugggacaagcuuguuauuccugaacgacaugggaaaggugcgcaaggauauuccacagugggaacccuccaaaggcuggaagaauuggcaggaggucccuuuuugcagucaucacuuccacaaaaucuuuaugaaggacggccggucucucgugguaccauguaggaaccaagaugaacuuaucgggagagcccgcauuagccagggagcagguuggucccugcgggagacggcuugccuaggcaaagccuacgcucagauguggucacugauguauuuccauaggcgagaccucagauuggccaguauggcaauauguucugcgguuccgaccgagugguuucccacuagccggacaaccugguccauccacgcccaucaccaguggaugacuacagaagauaugcugaagguguggaauagggucuggauugaggacaacccuaauaugaucgauaagaccccagugcacucaugggaagacauucccuaccuugggaaacgcgaggaccuguggugcggaagccucaucggcuuaucuucccgugcuacgugggccaagaacauacauacagcaaucacccaaguuagaaaucugauugguaaagaagaguauguggauuacaugagugucaugaagcgauauagcgcuccuucggaguccgaagggguguuguga

SEQ ID NO: 15788 - RNA, 9867 nt, Artificial Sequence
  derived and/or modified CDS sequence (opt3) from DENV-4__KJ579242__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuauccugggcgauaccauguccggcagaauagggggacagacacaucuagcuaucauggccguuuucaagaugucuccggguuacgugcugggcgucuuucucaggaaacugaccagccgugagacugcacuuauggugauugggauggcuaugacaaccacauugucaaucccucacgaccugauggaguuaauugacggaaucagucucggccugauacuucugaagauuguaacucaguucgauaacacccaaguggguacgcuagcccucucccugacauuuauccgcucuaccaugagcuuggucauggcauggcggacuaucauggccguucuguucguggugaccuuaauuccacucuguagaacauccugccugcagaaacagucacauugggucgaaaucacugcucuuauucugggggcgcaagccuugcccguguaucucaugacccugaugaagggagcaagcaggcgaaguuggccucuaaaugagggcauaauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauaucacgggaaguuccccuauuaucgaagugaagcaggacgaggauggcagcuuuucuauucgggacgucgaggaaacaaacaugaucaccuugcucgugaaacuggcccuaauaacuguaagcggucuguacccccuugcuaucccaauuacaaugacccucugguauauguggcaggucaagacucaacgcuccggggcacugugggaugugccgucaccugccgcgacacagaaagcugccuugagugagggaguuuacagaaucaugcagaggggcuuauucggcaagacccaggugggggucggaauucacauggaagguguguuccacacgauguggcauguuacucggggcagcgugaucugucacgagaccgggcgacuggaacccucuugggcagacgucagaaaugauaugauauccuauggaggcgguuggcgccucggggacaaaugggauaaggaggaggacgugcaaguacuggccauugaaccaggaaagaaccccaaacaugugcagacaaagccuggccuuuuuaaaacccugacaggcgagaucggggcuguuacuuuggacuucaagccaggaaccucagguagucccaucauuaauaggaaaggcaaggucauagggcuauacggaaacggcguggugacgaaaagcggugauuaugucuccgccaucacacaggcagaacguauuggggagccugacuacgagguagaugaagacaucuuucggaagaagagacugacuauuauggaucuccacccgggagcuggcaaaaccaagaggauccugccaucuauagugcgcgaggcccuuaaacgaagauuacggacacugauccucgcgcccaccaggguuguggccgcagaaauggaggaagcuuugcgcggccugccuauucguuaucagacuccagccgucaagucggagcauaccgggagagagaucguggaccucaugugccacgcuacauucacgacucggcugcuuagcucaaccaggguucccaauuacaaccugauugugauggaugaagcacacuuuacagacccuuccagugucgccgcccgcggauacaucucuacccgaguggagaugggugaagcugcggcaauauucaugacugccacaccgcccggcgcuaccgauccauuuccucaaagcaauucccccauugaggacaucgaaagagagaucccagagcggucauggaacacgggguucgauuggauuacugacuaucagggaaaaacaguaugguuugugccuucuaucaaggccggcaaugacauagcaaacugcuugaggaagagcgguaaaaagguuauucagcuaagucgcaaaaccuucgauaccgaauaccccaagacuaaacugacagacugggauuuugucgugaccacagacaucuccgagaugggggccaacuucagagcuggcagggugauugauccacggcguugucucaagccggucaucuuaacugacggaccugaacgcguuauacuggcgggccccauuccagugacgcccgccagcgcagcucaacgaagagggaggaucggacggaauccugcccaggaggaugaccaguauguauucucuggugauccacuuaagaacgacgaagaucaugcacacuggaccgaggccaaaaugcugcucgacaauaucuacacacccgagggcauuaucccuacuuuguuugggccggaacgcgagaagacccaggcuauugauggagaauucagacugaggggcgagcaacggaaaacauuuguggagcucaugcgaagaggugaccugccagucuggcuuucauauaagguggccuccgcggggauaaguuacaaagaccgcgaauggugcuucaccggcgagaggaacaaucagauccuagaagagaacauggaaguugagauuuggacucgggagggagaaaagaagaaacugcgucccaagugguuggaugcaagaguguaugccgacccuauggcuuuaaaagauuuuaaggaguucgccagcggcaggaaaucgaucacgcuggacauccucaccgaaauugcuucucugcccacauaccuuuccagccgcgcaaagcuggcccucgauaauauagucauguugcauacuaccgagcgggggggacgagcuuaccagcacgcccugaacgaacuaccagagucacuggagacacucaugcuuguagcacuguuaggugcgaugaccgccggcaucuuuuuguucuuuaugcaggggaagggaauuggcaaacugaguaugggucucaucacuauugcuguggccucugggcugcuuuggguugcagaaauccaaccucaguggauagcugccuccaucauucuggaguucuuucucaugguguugcugauccccgaaccagagaagcagagaacaccucaggacaaucaauuaauuuaugucauccuaacgauacugaccauuaucggccucauugcagccaacgaaaugggacuuaucgagaaaacuaagacagauuucggcuuuuaccaggugaaaaccgagaccacaauacuggacgucgauuugaggccggcuagcgcguggacucuguaugccguggcaacgaccauccucacacccaugcugcgccacacuauugaaaauaccucagcuaaccuuagucucgccgccaucgcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccauuaucggaccaggccugcaagcaaaagccacgagagaggcucagaagcguacagcagccgguauaaugaagaauccuaccguugauggcauuacugugaucgaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauucucacacuuugggaagggaacccuggacgguuuuggaacacgaccaucgcagugagcacugccaauauauuccgcggcuccuaucuggcuggugccggguugguuuuuucacugauuaaaaacgcacagacaccccgaagaggaaccggcacugcuggugagacacucggcgaaaaguggaaaaggcagcugaauucuuuagaccggaaggaguucgaagaguacaagcgcagugggauccuugagguggacagaaccgaagccaaaucggcgcugaaggauggaagcaaaauuaagcaugccgucuccaggggcucuucaaaaauccgauggauaguggagcgggggauggucaagccaaagggaaaagugguugaccucggcugcggucgugggggauggagcuacuauauggcaacgcuaaagaacguaaccgaagugaaaggcuacacaaagggcgggcccggacacgaggaaccuaucccgauggcuacuuaugguuggaaucuggucaaauugcauuccggcguggauguuuuuuacaagcccaccgagcaaguggacacacugcucugugauauuggggagaguucuagcaacccaacuaucgaagagggaagaaccaugcgcguccuuaagaugguggaaccuuggcugucauccaaacccgaguucugcauuaagguauugaauccuuauaugccaacagugaucgaagagcuggagaaacuccagaggaagcacggcgguaacuuaguucgguguccccugaguagaaauagcacccacgaaauguacugggucucuggggccuccggaaacauugugucaagcgugaauacuacgucgaaaaugcuucugaaccgcuuuacaaccaggcaucgaaagccuacuuaugagaaagacgucgaucuaggcgcaggcacccggucuguuaguacagaaacggagaagccagacaugaccaucauagggagaaggcuccagcgccugcaggaggaacacaaggagacuuggcauuacgaucaagaaaaucccuaccguacaugggcuuaucacggauccuacgaggccccgagcaccgguucagccuccucuauggugaacggcguagugaaauugcugacuaagccuugggacgucauuccaauggugacacagcucgcgaugaccgauacaacucccuucgggcagcagcggguuuuuaaagaaaagguggacaccagaacgccucaaccaaaacccggaaccaggauggucaugacaacuaccgcuaauuggcuuugggcacuguuaggcaagaagaaaaacccgcgccugugcacacgagaggaguucaucagcaaggugcggaguaaugccgcuaucggugccguauuucaggaagagcagggguggacuuccgcaagcgaagccguuaacgacucuagauucugggaguugguggauaaagaaagggcucuccaccaagagggaaagugugagucaugcgucuauaacaugaugggcaaacgcgaaaagaagcugggcgaguuugggagagcgaaaggaagucgggccauuugguacauguggcuaggugcaagguuccuugaauucgaggcucugggcuuucucaaugaagaccauugguucgggcgugagaacuccuggagcggaguggagggcgaaggucugcaccgauugggguauauacuggaggaaaucgauaagaaagacggagaucucauguacgccgacgauaccgcaggcugggacacgcgcauuacagaggaugaccuucagaaugaggaacugaucaccgagcagauggccccucaucacaagauuuuagcuaaagccaucuuuaagcugacuuaucagaacaagguggucaaaguuuugagacccacaccacggggcgcggugauggauauaaucucuaggaaggaccaacgcgggucgggacagguagguaccuacggccucaauacuuucaccaacauggaagugcagcugauuagacagauggaggcagaaggggucaucacacaagaugacaugcagaauccuaaaggacuaaaggagcggguggagaaauggcuuagggaaugcggcguugaccgacugaagcguauggccauuucaggugaugacuguguggucaaaccccucgaugagagauuugggacgagccuguuguucuuaaacgacaugggaaaggugcgcaaggauaucccacagugggaacccuccaaaggcuggaagaauuggcaggagguaccuuuuugcagucaucacuuccacaaaauauuuaugaaggacggccggucucugguugugccauguaggaaccaagaugaacucauugggagagcucgcaucagccagggagccgguuggucccuucgggagaccgcaugccugggcaaagcuuacgcccagauguggucacuaauguauuuccauaggcgagaccugagacucgcuaguauggccaucuguucugcagucccgacugagugguuucccacaagccggaccacuugguccauucacgcgcaucaccaguggaugacaaccgaagauauguugaagguguggaauaggguuuggauagaggacaacccuaauaugaucgauaagacgccagugcacucaugggaagacauucccuaccuggggaaacgcgaggaccuuuggugcggaagccugaucggccucucuucccgugccacaugggcuaagaacauucauaccgccaucacucaagucagaaauuuaauagguaaagaagaguauguggauuacaugccuguaaugaagcgauauagugcaccaagcgagucggaaggggugcuguga

SEQ ID NO: 15789 - RNA, 9867 nt, Artificial Sequence
  derived and/or modified CDS sequence (opt3) from DENV-4__GQ398256__SS-prME
agcaccaugacacugcucugccuuauacccacugugauggccuuccaccuguccacgagagacggcgaaccuuugaugauugucgcuaagcaugaaagggggcggccauuacuguuuaaaaccaccgaaggaauaaacaaguguacucuuaucgcaauggaucucggugaaaugugcgaagacaccguuacauacaaauguccgcugcuugugaauaccgaacccgaggauauugacugcugguguaaccugacuucuacaugggugauguauggaaccugcacgcagaauggggagcgccgacgugaaaagagaucaguggccuugacuccucacaguggaaugggccucgagaccagggcggaaacauggaugagcuccgagggugcuuggaaacaugcccagcgggucgagucuuggauccugcgcaacccaggguucgcacugcucgccggauuuauggcuuacaugauuggccagacuggcauccagagaaccguguucuuuguuuuaaugaugcugguggcacccucguaugggaugaggugugucggaguggguaaucgggauuucguagaaggcguuucagggggagccuggguggaccuugucuuggagcacggcgguugcgugacaaccauggcucaggggaagccuacgcuggauuuugaacuaacuaagacaaccgccaaagagguggcgcuccugcgcacuuacuguauagaagcaagcaucaguaacauuacaaccgccacgcgaugcccaacccaaggagagcccuaucuuaaggaggaacaggaccagcaguacaucuguagaagggaugucguugaccggggcuggggcaaugggugcggacuguucgguaaaggcggggugguaacaugcgcuaaguuuuuguguuccggaaaaauuacuggcaaccucgugcaaaucgagaaucuggaauauaccgucgccgugacaguucauaacggugauacucacgcaguggggaaugacaccucuagccacggcgucacagcuaccauaacuccucguuccccaucaguggagguaaaguuaccggauuacggagaacugacgcucgacugcgagccccgcaguggcauugacuucaacgagaugauccuuaugaagaugaaaaagaaaacauggcugguucauaagcagugguuuuuggaucuaccucugccauggaccgccggggcggacacuagcgaagugcacuggaaucauaaagagagaauggucaccuucaaggugccccacgccaaaaggcaggaugucacagugcucggaucucaggaaggugcaaugcacuccgcucuggccggcgcuaccgagguugacucaggggauggaaaccauauguuugccggccaccuuaaguguaaggugcggauggaaaaacugcgaauuaaggguaugagcuacacuaugugcagugggaaauucucuaucgacaaggagauggcagagacacaacauggcacgaccguagucaaagugaaguaugaaggagccggcgcuccuuguaagguuccaaucgagauucgcgaugugaauaaagaaaaggucguggggagaauaaucuccagcacucccuucgcggagaacacaaacucgguaaccaauauugaguuggaaccgccuuuuggagacucuuacaucgugauagguguuggcgaguccgcacucacacugcacugguucaggaaagggucaaguauuggaaagauguuugaaagcacuuaucggggcgccaaacgcauggcuaucuuaggugagaccgccugggauuucggguccgucggcggacuguuuacgucucuaggcaaggcagugcaucagguguucgggagcgucuacaccacaauguuuggaggcguuucauggauggugagaauccucauugguuuccuggugcuuuggaucgggacuaacaguaggaauaccuccauggccaugacaugcauugcuguaggaggcauaacuuuguuucuggguuucaccguccaggccgacaugggcugugugguuagcuggaacgggaaggaacucaaaugcggaucuggcaucuuuguggucgauaaugugcacacguggacagagcaauauaaguuccagcccgagucaccagcacgucuggcgagugcuauucuuaacgcccacaaagacgggguuuguggaauccggagcaccacucgacuggaaaaugugauguggaagcagaucacaaacgaguugaauuacguacucugggaaggcggucaugaccugaccgucguggcaggggaugugaaaggagucuuaacuaagggcaagagagcccugaccccucccguuaacgaccuaaaauauuccuggaagacaugggguaaagcuaagauuuuuacgccagaggccagaaauucuaccuuccucauagauggccccgacacuucggaaugcccuaacgagcgccgggcauggaauuucuuugagguggaagauuacggguucggaauguuuacaaccaacaucuggaugaaauucagagagggcagcuccgaaguaugugaccacaggcugaugucagcugccauuaaggaucagaaagcggugcaugccgacaugggguacuggaucgagaguucuaagaaucaaacauggcagauugaaaaggcuagccuuaucgaggucaaaacuugcuuguggccaaagacccacacgcugugguccaacggagugcucgagucacagaugcugauaccgcgcagcuaugcaggccccuuuucucagcacaacuaccgacaagguuaugccacacagaccguugggccuuggcauuuaggaaaacuggaaaucgauuucggcgagugcccagguacuaccguggcuauucgggaagacugugaucaccguggccccucccuuagaacaacuaccgccagugggaaguuggucacacaguggugcuguaggagcugcacgaugccuccacuccgcuuucugggagaggacggcuguugguacgggauggagauccggccccuaucugaaaaagaggaaaauauggugaagucccagguuaccgcaggacaaggcacuucagagacauucaguaugggucugcucugccugacccuuuuuguggaagaguguuugagaaggcgagucacucgcaagcauaugauucugguagugguuaucacauucugcgcgauaauuuuagggggacucaccuggauggaucugcuucgggcccugaucauguugggcgacacgaugagcggcagaauugggggacagauccaccucgcuauaauggccguguuuaaaaugucgccggguuauguccugggcguguuccuaaggaagcugacuucccgugagaccgcacucaugguaaucgggauggcuaugacaaccguguuuucuauuccucaugaccugauggaacuuaucgauggaauuagcuugggccugaucuuacucaaaauagucacucacuucgacaacacacagguugguacccuggcccuuucacugacauuccuacgcaguacuauuccacucgugauggcauggcggaccaucauggccguguuuuucgucgugacgcugauccccuuguguagaacauccugccugcagaagcaaucucacuggguugagauuaccgcuuuaauccucggggcgcaggcccugccuguauaccuuaugacucugaugaaaggagcaagcaggcgauccuggcccuugaaugaaggcauuauggcugugggccucgucucacugcuagggagcgcccugcuuaagaacgaugugccacucgccggaccuaugguugcugguggccuguugcuggcagccuaugugaugagugggucuuccgcggacuuaagccucgagaaggcugccaauguccagugggaugaaauggcagacauaaccggaucgucacccaucauugaggugaaacaagaugaggacggcucuuuuaguauccgggauguagaagagacaaacaugauuacucugcuugucaagcuggccuugaucaccguguccggucucuacccacuggcuauaccgguuacgauggcacuaugguacaucuggcaagugaaaacacagcgcagcggggcccugugggacgucccuucucccgcggcuacccagaaggccacucuuagcgaaggaguguauagaauuaugcaaaggggccucuucggcaaaacacagguuggggugggaauccauauggagggugucuuucacaccauguggcaugugacucggggcuccguaauuugucacgaaacagggcgacuggagccaucaugggcagaugugagaaaugacaugaucaguuacggaggcgguuggcgcuugggggauaagugggacaaggaggaagacguucaggucuuagccauagagcccggcaagaacccuaagcaugugcagaccaaaccaggccuguucaagacgcucacuggcgaaauuggggcugugacccuggauuuuaaacccggaacaagcgguucuccuaucaucaauaagaaaggcaaggucauugggcuuuauggaaacggcguagugaccaaguccggugacuacguuucagccauaacacaagcagagaggaucggggagccggauuaugaaguggacgaggauauuuuccguaaaaagcggcugacuaucauggacuugcacccaggagcuggcaaaaccaagaggauucuacccaguaucgucagggaagcccugaaacgccgacucagaacgcugauacuugcgccuacacgggugguugccgcagagauggaagaggcuuuaaggggccugccaauccgcuaccagacucccgccguaaagagcgagcacaccgggcgugaaauugucgaucucaugugccaugcuacauuuaccacuagauugcuguccucuacccgggugccuaauuauaaccucaucguaauggacgaggcacacuucacagauccgugcucgguggccgccaggggauacauuagcacgcgcguugaaaugggugaggcugcggcaaucuuuaugacugccacacccccaggcgcuacagacccuuucccccagucaaauuccccaauagaagauauugagcgagagaucccugaaagaaguuggaacaccggguucgacuggaucacugacuaccagggaaagacagucugguuugugcccucuauuaaagccggcaaugauaucgcaaacugucugagaaagagcgguaaaagggugauacaacuuucccgcaagaccuucgacacggaguauccaaaaacuaagcugacagauugggacuuugucguuaccaccgauauuucagaaaugggggccaacuucagagcuggcagggugaucgacccgcggcguugcuugaagccuguaauucuaacugauggacccgagcgcgugauccuggcgggcccaauacccgucacuccugccucugcagcucagcgaagagggaggauuggacggaauccagcccaggaagacgaucaauacguguuuagcggugacccccucaaaaacgaugaggaccaugcacacuggaccgaggccaagauguuacuggauaauaucuauacaccugaaggcaucauuccgacucuuuucgggccagagcgcgagaaaacgcaggcuaucgacggagaguuuagacugaggggcgagcagcggaagaccuucguugaacucaugaaacgaggugacuugcccguguggcugaguuacaaggucgccuccgcggggauuagcuauaaggauagagagugguguuuuacaggcgaacgcaacaaucagauacucgaggaaaacauggagguagagaucuggacuaaagaaggagagaagaaaaagcugaggccuaaauggcuugacgcacggguguacgccgaucccauggcucuaaaggacuucaaggaauuugccucuggccguaaaucaauuacccuggauaucuugacagagaucgcuuccuuaccaaccuaucugaguagcaaggcaaaacucgcccuggacaauauuguuaugcuucacacuacggaaaaaggugggcgggcuuaccaacaugcccugaacgagcucccugagucguuggaaacccugaugcuaguggcacugcucggggcgaugacagccggcauauuccuauuuuucaugcaggggaaaggaaucggcaagcugucuauggguuuaauugcuaucgccgucgcauccggguugcuguggguggcugagauucagccccaguggaucgccgcaagcauaauccucgaguucuuucugaugguccuucugauuccagagccugaaaaacaaaggacuccgcaggauaaucagcucaucuacgugauuuugaccauccugacaauaauuggcuuaaucgccgcuaacgagaugggacuaauugagaagaccaagacugacuucggcuuuuaucagguuaaaacagaaacgaccauccuggauguggaccuccgccccgcgucagccuggacucuuuacgcaguagcuacaaccauacugaccccaauguugcggcacacaaucgagaauacaagugccaaccugucucucgccgcaauugcuaaucaagccgcggugcugauggggcuuggaaagggcuggccucuccaucgaauggaucuggguguccccuugcuggcuaucgggugcuauucccagguuaacccaacgaccuuaacagccagccuagugaugcugcucguccacuacgcaauuaucggaccuggccuucaggccaaagcuacuagagaagcacagaagaggaccgccgcggguauaaugaaaaaucccacaguggacggcauuaccguaaucgaucuggagccgaucucauaugacccaaaguucgagaagcaauugggacaggugaugcugcucguucugugugugggacagcuuuuacugaugcgcacuacgugggcucucugcgaagucuugacacuggccaccggcccugcaaugacucuaugggaggggaaccccggacgguuuuggaacaccacaauugccgugaguacugcuaauaucuucagaggcagcuaccuggccggugcagggcucgcuuuuucccuuaucaaaaacgcccaaaccccacguaggggaacaggcacgaccggugaaacucugggcgagaaguggaaacggcaguugaacucucuggaccgcaaggaguucgaagaguauaaacgaagcgggauucucgaagucgauagaacagaggcgaaguccgcccugaaggacggaucaaaaaucaagcaugcagugucuaggggcaguucgaaaauucgguggaucguugaacgcgggaugguaaagcccaaaggaaagguggucgauuuaggcugugguagagggggauggagcuacuacauggcuacccuuaagaaugugacugagguuaaaggcuauacaaagggcgggccuggacacgaagaaccgauacccauggccaccuacgguuggaaucuggugaaacuccacuccggcgucgacguguuuuauaagccaacggagcagguagauacccuacugugcgacaucggggaaucuucaagcaacccuacaauugaggaaggaaggacuuugcgagugcugaaaaugguugagcccuggcucuccaguaagccugaguucuguaucaaaguccuuaauccauacaugcccaccgugauugaggagcuggaaaaguugcagcggcguuauggcgguucucuggugagaugcccucucagccgcaacucaacacaugagauguacugggucuccggggcaaguggaaauaucguuagcucugugaacacuauuuccaagauguuacugaauagguuuaccacacggcacagaaaaccaaccuaugaaaaggauguagaccuuggcgcuggcacucgcucagugagcacggagacagagaaacccgauaugaccgucaucgggaggcgacugcaacggcuacaggaagaacauaaggaaacuuggcacuacgaccaggagaacccguacagaaccugggccuaucacggaucguacgaagccccuucuacagguagugcguccagcauggugaauggcauaguuaaacuccugacgaagccaugggaugugauucccauggucacccaguuggcuaugacugacacaaccccuuucgggcaacagaggguguuuaaggagaaaguagacacucgcacaccacagcccaagccgggaacccguaugaucaugacaacuaccgcaaacuggcugugggcccuccuuggcaaaaagaaaucaccucggcuguguacgagagaggaguucaucuccaagguuaggucuaaugcugccauuggugcaguguuccaggaggaacaaggguggaccagcgccagugaggcugucaacgauucccgcuuuugggaauuagugaauaaggagcgagcgcugcaucaggagggaaaaugcgaaagcugcguguauaacaugaugggcaagcgggagaaaaaguugggcgaguucgggagagccaaaggaucuagggcaauaugguacauguggcucggugcucgcuuucuggaguucgaagcccuaggcuuucuuaacgaggaccacugguucucaagagagaauaguugguccggggucgaaggagagggccugcaucggcucgguuauauccuggaagauauugacaagcaggauggggacuugaucuacgcagaugacacagccggaugggauacuaggauuaccgaggacgaucugcucaacgaggaacuuaucacagagcaaauggcuccccaccauaagacucuggccaaagcgauauuuaaguuaaccuaucagaauaaaguugugaagguacugcguccaacgccuaaaggcgcagugauggacaucauuagccgaaaggaucagcgcggcucugggcaggucggaacauacgguuugaacaccuucacuaauauggaagugcaacucaucagacagauggaggccgaaggcguuauuacacaggacgacaugcagaaccccaaagggcugaaggagcggguggagaaguggcuaaccgaauguggagucgauaggcuuaaacgcauggcuaucucgggcgacgauugcgugguaaagccacuggacgagagauuuucagccagccuccuguucuugaaugauauggguaaaguucggaaggacauaccccaaugggaaccuuccaaaggguggaagaacuggcaggaggugccauuuuguagucaccacuuccauaagauuuuuaugaaagauggaaggucuuuagucgugccgugccgaaaucaggacgaacugaucggccgugcaagaaucagccagggcgcuggguggucccuccgcgagacugccugucuuggaaaggcuuacgcccaaauguggucacugauguauuuccaccggagggaucuaagacuggcaaguauggcgauuugcucugccguucccaccgagugguucccuacaagccgcacgaccugguccauacaugcucaccaccaguggaugacuacagaagacaugcucaaaguguggaaccgggucuggaucgaggauaauccaaacaugaccgacaagacucccgugcauucaugggaagacauuccuuacuuggguaaaagggaggaucugugguguggcagccuuaucgggcugucuucccgagccacaugggcaaagaauauucacaccgcuaucacgcagguaagaaaccucauaggaaaggaagaguauguggacuacaugccagucaugaaacgguauagugcccccagcgagucggaaggcguuuuauga

SEQ ID NO: 15790 - RNA, 9867 nt, Artificial Sequence
  derived and/or modified CDS sequence (opt3) from DENV-4__KC333651__SS-prME
agcaccaugacucugcucugccuuauacccacugugauggccuuccaccuguccacgagagacggagaaccuuugaugauugucgcuaagcaugaaagagggcggccauuacuguuuaaaaccacggaagggauaaacaaguguacuuuaaucgcaauggaucucggugaaaugugcgaggacaccguuacauacaaauguccgcugcuugugaauaccgaacccgaggauauugacugcugguguaaccugacuucuacauggguuauguauggaaccugcacgcagaauggggagcgccgacgugaaaagagaucaguggccuugacuccucacaguggaaugggccucgagaccagagcggaaacauggaugagcuccgagggugcuuggaaacaugcccaacgggucgagucuuggauccugcgcaacccaggguucgcacugcucgccggauuuauggcuuacaugauuggccagacuggcauccagagaauaguguucuuuguuuuaaugaugcugguggcacccucguaugggaugaggugugucggaguggguaaucgggauuucguagaaggcguuucagggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaagcauuaguaacaucacuacagccacccgaugcccaacgcaaggagagcccuaucuuaaggaggaacaggaccagcaguacauuuguagaagggaugucguugaccggggcuggggcaaugggugcggacuguucgguaaaggcggggugguaaccugcgcuaaguuuuuguguuccggaaaaaucacaggcaaccucgugcaaauagagaaucuggaauauacugucgugguuaccgugcauaacggugauacacacgccgucgggaaugacacuucuaaccacggcgugaccgcaacaauuaccccucguagcccauccguagagguuaaguuaccggauuacggagaacugacucucgacugcgagccccgcucaggcaucgacuucaaugagaugauucuuaugaagaugaaaaagaaaacguggcuggugcauaagcagugguuuuuggaucuaccucugccauggacagcuggggccgacaccagugaaguccacuggaaccauaaagagagaauggugacuuucaaggucccccacgcgaaaaggcaggaugugaccguucucggaagccaggaaggugccaugcacucugcacuggcuggcgccacagagguggacuccggggauggaaaucauauguuugcuggccaccuuaaguguaagguacggauggaaaaacugcgaaucaaggguaugucauacaccaugugcagcgggaaauucaguaucgacaaggagauggccgagacucaacauggcacaacggucgugaaaguuaaguaugaaggagcaggcgccccuuguaaggugccaauugagauacgcgaugucaacaaagaaaaggugguagggagaaucauuucuuccacccccuucgcugagaacacuaauagcgugacaaacaucgaguuggaaccgccuuuuggagacucguacauaguuauuggugucggcgagucugcgcucacccugcacugguucaggaaaggguccucaaucggaaagauguuugaaaguacauaucggggcgcaaaacgcauggccaucuuaggugagacugcuugggauuucgggagcgugggcggacuguuuaccucccuaggcaaggccgugcaucaggucuucgggucuguuuacacgaccauguuuggaggcgugagcuggauggugaggauucucaucgguuuccugguacuuuggauugggacaaauucaaggaacacaaguauggcaaugaccugcauagccgucggaggcaucacauuguuucuggguuucacugugcaggcugacaugggcuguguuguguccuggaaugggaaggaacucaaaugcggaagcggcauuuuugucguggauaacguucacaccuggacggagcaauauaaguuccagcccgagucuccagcccgucuggcaucagcgauccuuaaugcucacaaagacgggguguguggaauccggaguacaacccgacuggaaaacguaauguggaagcagauuacuaaugaguugaacuacguccucugggaaggcggucaugaccugacagugguggccggggaugucaaaggaguuuuaaccaagggcaagagagcacugacuccucccgugaaugaccuaaaauauagcuggaagaccugggguaaagccaagauauuuacaccagaggcuaggaacuccacguuccucaucgauggccccgacaccucugaaugcccuaaugagcgccgggccuggaacuucuuugagguagaagauuacggguucggaauguuuacuacaaauauuuggaugaaauucagagagggcucgagcgaagugugugaccacaggcugauguccgcagcuaucaaggaucagaaagccguccaugcggacaugggguacuggauugagucaaguaagaaccaaaccuggcagaucgaaaaggccucucuuauagaggugaaaacaugcuuguggccaaagacucacacccuguggagcaacggaguucucgagucccagaugcugaucccgcgcucauaugcuggccccuuuagccagcacaauuaccgacaagguuaugcaacgcagacaguggggccuuggcauuuaggaaaacuggaaauugauuucggcgagugcccagguaccacugucgccauccgggaagacugugaucaccguggccccucucuuagaaccacaacugcuuccgggaaguuggugacccaguggugcuguaggaguugcacaaugccuccacuccgcuuucugggagaggacggcuguugguacgggauggagauucggccccuaagcgaaaaagaggaaaacaugguuaagucucaggugacggccggacaaggcaccuccgagacuuucucaaugggucugcucugccugacacuuuuugucgaagaguguuugagaaggcgaguaacccgcaagcauaugauccuggugguugugauaacuuucugcgcaauuaucuuagggggacucacauggauggaucugcuucgggcgcugauuauguugggcgacaccaugaguggcagaaucgggggacagauacaccucgccaucauggcugucuuuaaaaugagcccggguuaugugcugggcguauuccuaaggaagcugacgucgcgugagacugcccucauggugauugggauggcaaugaccacagucuuuuccaucccucaugaccugauggaacuuauugauggaaucucuuugggccugauauuacucaaaauuguuacccacuucgacaauacucagguggguacacuggcucuuagccugaccuuccuacgcucaacaaucccacucgugauggccuggcggacuaucauggcagucuuuuucgugguuacccugauucccuuguguagaacgaguugccugcagaagcacucccauuggguagagaucacagccuuaauucucggggcucaagcgcugccuguguaccuuaugacccugaugaaaggagccucuaggcgaagcuggcccuugaacgaaggcauaauggcagucggccucgugucccugcuagggucagcucugcuuaagaaugauguuccacucgccggaccuaugguggccgguggccuguugcuggcugcauaugucaugagcgggaguucugccgacuuacuccuggagaaggcggcuaacgugcagugggaugaaauggccgacaucacuggauccagccccauuaucgagguaaaacaggaugaggacggcucguuuucaauucgggaugucgaagagaccaauaugaugacacuucuggugaaguuggcacucaucacuguuucuggucuguacccacuagccauaccggugaccauggcucugugguacaucuggcaagucaaaacgcagcgcaguggggcacuuugggacgugccuucccccgccgcgacacagaaggcuacccucagcgaaggaguuuauagaauuaugcagaggggccuguucggcaaaacucaagugggggucggaauccacauggaggguguguuucauacaauguggcacguaacccggggcucugugauuugucaugaaacugggcgauuggagccaagcugggccgauguuagaaacgacaugaucuccuacggaggcgguuggcgcuuaggggauaagugggacaaggaggaagacguccaggugcuggcaauagagcccggcaagaauccuaagcacgugcagacaaaaccaggccucuucaagacccugacgggcgaaauuggggccgucacucuugauuuuaaacccggaaccucagguaguccuaucaucaacaagaaaggcaagguaauugggcuguauggaaauggcgugguuacaaagagcggugacuacgugucugcuauaacccaggccgagaggaucggggagccggauuaugaagucgacgaggauauuuuccguaaaaagcgguugacaaucauggaccuacacccaggagcaggcaaaacuaagaggauucugcccuccaucgugagggaagcucucaaacgccgacugagaacccuuauauuagccccuacgcggguuguggcggccgagauggaagaggcacugaggggccucccaauccgcuaccaaacacccgcugucaagucagagcauacugggcgugaaauuguggauuugaugugccacgccaccuuuacaaccagacugcucaguagcacucggguaccuaacuauaaucugaucgugauggacgaggcucauuucaccgauccgugcuccguugcagccaggggauacauuucuacacgcgucgaaaugggugaggccgcugcgaucuuuaugacggcaacucccccaggcgccaccgacccuuucccccagucgaacagcccaauagaagauauugagcgagagaucccugaaagaucauggaauacaggguucgacuggaucaccgacuaccagggaaagacugugugguuugugcccuccauuaaagcuggcaacgauaucgccaacugucuucggaagagugguaaaagggucauacagcugucucgcaagacauucgacaccgaguauccaaaaacgaaguugacugauugggacuuuguugugacaaccgauauuagcgaaaugggggcaaauuucagagccggcaggguaaucgacccgcggcguugccuaaagccugugauucugaccgauggacccgagcgcgucauccucgcuggcccaauacccgugacuccugcguccgccgcacaacgaagagggaggauuggacggaacccagcucaggaagacgaucaguacguauuuucaggugacccccuaaagaaugaugaggaccacgcccacuggacagaggcaaagaugcugcuugauaacaucuauaccccugaaggcaucauuccgacacuguucgggccagagcgcgagaaaacucaagccaucgacggagaguuuagacucaggggcgagcagcggaagacguucguggaauugaugaaacgaggugaccugcccgucuggcucucuuacaagguagcuagcgccgggauuaguuauaaggauagagagugguguuuuaccggcgaacgcaauaaccagauacuggaggaaaauauggagguggagaucuggacaaaagaaggagagaagaagaaacuuaggccuaaauggcuagacgcgcggguuuacgcagaucccauggcccugaaagacuucaaggaauuugcuuccggccguaaaagcauuacuuuggauaucuuaaccgagaucgccucucugccaacauaucucucauccaaggcuaaacuggcacuugacaacauugugaugcugcauaccacugaaaaagggggcagagccuaccagcacgcucucaaugaguugccugagagucuggaaacgcuaaugcuggucgcccuccuuggugcaaugaccgcgggcauauuccuguuuuucaugcaagggaaaggaaucggcaaguuaagcauggguuugauugccaucgcuguggccucggggcugcucugggucgcagagauucagccccaguggaucgcugccucuauaauccuggaguucuuucuuauggugcugcucauuccagagccugaaaaacagaggacaccgcaagauaaccaguugaucuacguuauucugacuaucuuaaccauaauuggccuaaucgcagccaaugagaugggacugauugagaagacaaagaccgacuucggcuuuuaucaggugaaaacugaaacaacgauccucgauguagaccuucgccccgcuuccgcguggacccuguacgccguggcaacuacaauauugaccccaaugcugcggcauaccaucgagaacacaagcgcuaaucucucacuggccgccauugcaaaccaggcugccguccuuauggggcucggaaagggcuggccucugcaccgaauggauuuggguguuccccuguuagcgaucgggugcuauagucaagugaauccaacuacgcuaaccgcuucucuggucaugcuccuugugcauuacgccauuaucggaccuggccugcaggcaaaagccacaagagaagcucagaagaggacugcagccgguauaaugaaaaaccccaccguagacggcauuacagugaucgauuuggagccgaucuccuaugacccaaaguucgagaagcagcuggggcaaguuaugcuccuggugcuuugugcgggacaguuacugcucaugcgcaccacuugggcuuugugcgaaguccugacgcuagccacaggcccugcaaugacccugugggaggggaaccccggacgguuuuggaauacuaccauugccgugagcacagcuaacaucuucagaggcucauaccucgccggugcagggcuugcuuuuagucugaucaaaaaugcccagacuccacguaggggaaccggcacaacgggugaaaccuugggcgagaaguggaaacggcaacugaacagccucgaccgcaaggaguucgaggaguauaaacgauccgggauucuggaagucgauagaacugaggcgaagucugccuuaaaggacggaagcaaaaucaagcacgcaguguccaggggcucaucuaaaauucgguggaucguugaacgcgggaugguaaagcccaaaggaaagguggucgaucuuggcugugguagagggggauggaguuacuacauggcuacacugaagaaugugaccgagguuaaaggcuauacuaagggcgggccuggacacgaagaaccgauacccauggccacauacgguuggaaccucgugaaacuacauucgggcgucgacguguuuuauaagccaaccgagcagguagauacgcuguugugcgacaucggggaaagcuccucuaauccuaccauugaggaaggaaggacacugcgagugcucaaaaugguugagcccuggcuuucaagcaagccugaguucuguaucaaaguccugaacccauacaugcccacugugauugaggaguuggaaaagcugcagcggcguuauggcgguucccucgugagaugcccuuuaagucgcaauucuacccacgagauguacugggucagcggggcaucaggaaacaucguuuccagugugaauacaauuagcaagaugcugcuuaacagguuuacuacccggcauagaaaaccaacauaugaaaaggauguagaccugggcgcuggcacccgcucuguguccacugagacggagaaacccgauaugacagucaucgggaggcgacuacagcggcuccaagaagaacacaaggaaaccuggcacuacgaccaggagaauccguacagaacuugggccuaucauggaucauacgaagccccuagcaccgguucggcgucuaguauggugaacggcguugugaaacuguugacaaagccaugggaugucauacccauggugacgcagcuggcuaugaccgacacuacaccuuucgggcagcaaaggguauuuaaggagaaaguugacacccgcacuccacagcccaagccgggaacacguaugauuaugaccacaacugcaaauuggcucugggcccuucugggcaaaaagaaauccccucgguuauguaccagagaggaguucaucagcaaggugaggucaaacgcugccaucggugcagucuuccaggaggaacagggguggacguccgccucugaggcugugaaugauagccgcuuuugggaacugguggacaaggagcgagcguugcaccaagagggaaaaugcgaaaguugcgucuauaacaugaugggcaagcgggagaaaaagcucggcgaguucgggagagccaaaggauccagggcaauuugguacauguggcugggugcucgcuuucuagaguucgaagcccuuggcuuucugaacgaggaucauugguucagcagagaaaauucuuggucagggguugaaggagagggccuccaccggcuggguuauauauuggaagacaucgauaagcaggagggggaccugauuuacgcagaugacaccgccggaugggauacaaggaucacugaggacgaucuccuuaacgaagaacugauuaccgaacagauggcuccccaucacaagacauuagccaaagcgaucuuuaagcugacuuaucaaaauaaagugguaaagguguugcguccaaccccuaaaggcgcagucauggacauaaucagucgaaaggaucagcgcggcuccggacaggugggaacguacggucucaacacauucaccaauauggagguucagcugauuagacaaauggaagccgagggcgugaucacucaggacgacaugcagaaccccaaagggcuaaaggagcgggucgaaaaguggcuuacagaguguggaguggauaggcugaaacgcauggcuauuagcggcgacgauugcguaguuaagccacucgacgaaagauuuucuaccucgcuguuguucuuaaaugauauggguaaagugcggaaggacaucccccagugggagccuucaaaaggguggaagaacuggcaagaagucccauuuuguagccaccauuuccacaagauauuuaugaaagauggaaggucccuggugguuccgugccgaaaucaggacgagcucauuggccgugccagaaucagucagggcgcaggguggucucuucgcgagacugcuugucugggaaaggccuacgcucagauguggagccuaauguauuuccaucggagggaucugagacucgccuccauggcaaucugcucagcggugcccaccgaaugguucccuacaagucgcacgaccuggucuauucacgcccaccaucaauggaugacuacagaggacauguugaaagucuggaaccggguguggauagaagauaauccaaacaugaccgacaagacucccguacacagcugggaggacaucccuuaccuggguaaaagggaagaucuuugguguggcucccugauugggcucucaagccgagcuacaugggccaagaauauccauaccgcaauuacacaggugagaaacuuaaucggaaaggaggacuaugucgauuacaugccaguuaugaaacgguauucugcucccuccgagagugaaggcgugcuguga

SEQ ID NO: 15791 - RNA, 9867 nt, Artificial Sequence
  derived and/or modified CDS sequence (opt3) from DENV-4__JN559740__SS-prME
agcaccaucacucugcucugccuuauucccacugugauggccuuccaccuguccacgagagacggcgaaccuuugaugauagucgcuaagcaugaaagggggcggccauuacuguuuaaaaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagcggaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagcggaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucgugccgucgggaacgacauuuccaaucacggcgugaccgcaaugaucacaccucgcucaccaaguguagagguuaagcugccggauuacggagaauuaacccuggacugcgagcccagaagcggcauugacuucaacgagaugauccucaugaagaugaaaaagaaaacuuggcuugugcacaagcagugguuucuggauuugccucuaccauggacggcuggggccgacacaucugaaguccauuggaauuacaaagagaggauggugaccuucaaggucccccacgcgaaacggcaggaugugacuguucugggaucccaggaaggugccaugcauucagcacucgcuggcgccaccgagguggacagcggggauggaaaccacauguuugcuggccaccugaaguguaagguacgaauggaaaaacuucgcaucaaggguaugaguuauacaaugugcucugggaaauucuccauugacaaggagauggccgagacccaacauggcacuacagucgugaaaguuaaguacgaaggagcaggcgccccuuguaaggugccaauagagaucagagaugucaauaaagaaaaggugguagggaggauuaucagcucgacgccccuggcugagaacaccaacucugugacuaauauagaguuggaaccgccuuucggagacuccuauauuguuaucggugucggcaacucagcgcucacacugcacugguuucggaaagggaguagcaucggaaagauguucgaguccaccuaccgcggcgcaaaaagaauggccauuuuaggugaaacagcuugggauuuugggucugugggcggacuguucacuagccuaggcaaggccgugcaucaggucuuugggucaguuuauaccacgauguucggaggcgugaguuggaugaucaggauucucauagguuuucuggugcuuuggaucgggaccaauucccguaacacaagcauggcaaugacuugcauugccguaggaggcaucaccuuguuccuggguuuuacaguccaggcugacaugggcugugugguuucuuggucagggaaggagcucaaaugcggaaguggcaucuucguggucgauaaugugcacacuuggaccgaacaauacaaguuucagcccgagagcccagcccggcuggcauccgcgauucuuaacgcucauaaagacgggguuuguggaauacgaucuacgacaagacuggagaaugugauguggaagcagaucaccaacgaauugaauuauguacucugggagggcggucacgaccugacugucguggccggggaugugaaaggagucuuaacaaagggcaagagggcacugaccccucccguuucggaccuaaaauacagcuggaagacuugggguaaagccaagauuuucaccccagaagcucgcaacuccacauuucucaucgauggccccgacacgucagagugcccuaaugaacggagagccuggaacagucuggagguggaggauuacggguucggaauguucaccacuaauauuuggaugaaauuuagggaaggcucuagcgagguaugugaccaccgccuuauguccgcagcuaucaaggaucagaaagccgugcaugcggacaugggguauuggauagaaucaagcaagaaccaaacauggcagaucgagaaggccucuuugauugaagucaaaaccugccuguggccaaagacacacacucucugguccaauggagugcuggagagucagauguuaaucccgaaaagcuacgcuggccccuucucucagcauaacuaucgacaagguuacgcaacccagacgguugggccuuggcaccugggaaaacuugagauugauuuuggcgaaugcccagguacaaccgugacuauccaggaggacugugaucaccggggccccuccuugcguaccacaacugccucagggaaacucgucacccaguggugcuguagaaguugcacaaugccuccacugagguuccuaggagaagacggcuguugguaugggauggagauacgcccccugagcgagaaggaagagaacauggugaagucgcaaguuacggcuggacagggcaccuccgaaacuuuuucuaugggucuccugugccuuacauuguucguggaggaaugucugcggagaagggucacccgaaaacauaugauuuuaguagugguuaucacucucugcgccauuauccuagggggccuuacauggauggaucuguugcgcgcacucauaaugcugggcgacaccaugagcggccggaucgggggacagauucaccuagcgaucauggccguguuuaagaugucaccggguuacguccugggcguguuccucagaaaacugacgaguagggagacugcucuuaugguaauugggauggccaugaccacaguguuguccaucccucaugaccugauggaguuaauagauggaauuucucucggccugauccuucugaagaucgucacccaguuugacaauacucaaguugguacacuagcacucagccugaccuucauucguuccacaaugccauuggugauggcuuggcgcacuaucauggccgugcuguuugucgugaccuuaauuccccucugucggacgucaugccugcagaaacagagccacuggguugaaauaacagcacuuauccugggggcccaggcuuugccuguauaucucaugacccugaugaagggagcgaguagaaggucuuggccccuaaacgagggcauuauggccgugggccuggucucccuucucgggagcgcacuguugaagaaugaugugccacuggcuggaccuaugguugccgguggcuuacuccuggccgcuuacgugaugucggggucaucugcagaccuuagucuggaaaaagccgcgaacguccagugggaugagauggcugacaucacuggauccagccccauuaucgaagugaagcaggaugaggacggcucuuucagcauacgagauguagaggaaaccaauaugaucacauugcucgucaaacuggcccuaauuacuguguccggucuguacccacuugcaaucccgguuaccaugacgcucugguauauguggcaagugaagacacaacggucaggggcccugugggacgucccuagucccgcugcaacccagaaagccgcguugagcgagggaguguaccgcauuaugcagagaggcuuauuuggcaagacucagguuggggugggaauccauauggaaggugucuuccacacaauguggcacgugaccaggggcucuguaauaugucaugagacugggcggcuggaaccauccugggcugaugugcgaaacgacaugauuucauauggaggcgguuggagacucggggauaagugggacaaagaggaggacguucaaguccuggccaucgaacccggaaagaauccuaaacacgugcagacaaagccaggccuuuucaaaacccugacgggcgagaucggggcagugacuuuggauuuuaagcccggaaccagugguagcccuauuauaaaccgcaaaggcaaggucaucgggcuauacggaaauggcguagugacaaaguccggugacuauguuucugccauuacccaggcugaaaggaucggggagccggauuacgagguggacgaagauauuuuccguaaaaagcggcugacaaucauggaccuccauccaggagccggcaaaacuaagagaauacugcccucgaucgucagggaggcacuuaaacgccgauuaagaacccugauucucgcuccuacgcgggugguugccgcggaaauggaggaagccuugaggggccugccaauccgcuaucagacacccgcagugaaaagcgagcacacugggcgugagauugucgaucucaugugccaugcuaccuuuacaaccagacugcuuucauccacucgggugccuaacuacaaucugaucguaauggacgaagcccacuucaccgauccgaguucuguggcugcaaggggauacauaagcacacgcguugagaugggugaagccgccgcuauuuuuaugacggcgacucccccaggcgcaaccgacccuuucccccaauccaacucaccaaucgaggauaucgaacgagagauuccugagagaucuuggaauacaggguuugacuggaucaccgacuaucagggaaagacugucugguucgugcccagcauaaaagccggcaacgauauugcuaauugcuugcggaagagugguaaaaaggugauccagcuauccaggaaaacauuugacaccgaauacccaaagacgaagcugacugauugggacuucgucguuacaaccgauauuagcgagaugggggccaacuuucgcgcaggcagagugaucgacccgaggcggugucucaaaccuguaauauuaaccgauggacccgaacgugugauucuggccggcccaauccccgucacuccugcuucugcggcccaacgccgagggagaaucggaaggaacccagcacaggaggacgaucaguauguguucucaggugacccccuuaagaaugaugaagaccacgcucauuggacagaggccaaaaugcugcucgauaacauuuacaccccugagggcaucauuccgacauuguucgggccagaacgggagaagacucaggcaauagacggagaauuucgccugagaggcgagcaaaggaaaacguucguugagcucaugcggcgaggugaccugcccguguggcuuuccuauaaggucgccagugcugggaucagcuacaaggauagagaauggugcuuuaccggcgagcgcaauaaccagauucuagaagagaauauggaaguagagaucuggacaagggagggagagaagaagaaacugcggccucguugguuggacgccagaguguaugcggaucccauggcauuaaaggacuucaaagaguuugccucgggcaggaagucuaucacucuggauauucucaccgaaauagcuucccugccaacauaccuuagcucacgcgccaagcuggcucucgacaacaucguuauguugcacaccacugagagagggggacgagcauaccagcaugcccugaaugaacuaccugagagucuggagacgcucaugcuuguggcucuguuaggugccaugaccgcaggcauuuucuuguuuuucaugcaggggaaaggaaucggcaagcugucuaugggucucauuacaaucgcggucgccuccgggcugcuuuggguggcugaaauacaaccccaguggaucgccgcaagcauuauccuggaguuuuuccucauggucuugcugauuccagaaccugagaaacagagaacuccgcaggauaaccaauuaaucuaugugauacuaaccauucugacaaucauuggccucaucgcugccaaugaaaugggacuuauagagaagaccaaaacugacuuuggcuucuaccagguuaagacagagacgaccauccuggauguggacuugaaacccgcaucagccuggacucuguaugcuguagcgacaaccauucucaccccaaugcugaggcacacaaucgaaaacacaagugccaaucuuagccucgcagcuauugccaaccaggccgcagugcugaugggguugggaaagggcuggccucugcaccgcauggauuuaggugucccccuacuggcuaugggguguuacucccagguuaauccaaucacgcucaccgccucucuugugaugcuguugguccauuaugcgauaauuggaccuggccugcaagcuaaggccacacgggaggcacagaaaagaacugccgcugguaucaugaagaaccccaccguggacggcaucacaguaauugaucucgaaccgaucagcuacgacccaaaauuugagaagcagcuggggcaagugaugcuuuuaguucugugcgcaggacagcucuugcugaugcguaccacuugggccuucugugaggugcuaacgcuggcgacaggcccuauacucacccuuugggaagggaaucccggaagguucuggaacacuaccauugcugucuccacagccaacaucuuucggggcucauaucuggcuggugcaggguuggcauucucucugauuaaaaaugugcagacuccacgccgaggaaccggcacaacgggugagacccucggcgaaaaguggaagagacagcugaacaguuuagacaggaaagaguuugaagaguacaagcggucggggauccuugaggucgaucgcacugaagccaaaagcgcacugaaggacggauccaaaauaaagcacgcugugucuagaggcucaagcaagaucagguggauuguugagcgagggaugguaaaacccaagggaaaaguggucgaucucggcugcgguagagggggaugguccuacuauauggccacacuaaagaaugugaccgaaguuaaaggcuacacuaagggcgggccuggacaugaggaaccgauccccauggcgacauaugguuggaaccuggugaaguugcacaguggcgucgacguguucuacaaaccaaccgagcaaguagauacgcugcucugugacauuggggagucuagcucaaauccuaccaucgaagagggacguacacuuagagugcugaagaugguugaacccugguuguccaguaaaccugaguuuugcauuaagguccugaacccauauaugcccacugugaucgaagaacucgagaaauuacagcgcaagcauggcgguaaucuggugagguguccucuuagccggaacucuacccacgaaauguacugggucuccggggccucaggaaauauaguuagcucggugaacacaacuucuaaaaugcugcuaaauagauucaccacacgccacaggaagccaaccuaugagaaggauguagaccucggcgcaggcacucgaaguguguccacggaaacagagaaacccgauaugaccauuaucgggcggagacugcagagguugcaggaggaacauaaggagacuuggcacuacgaccaagaaaacccguaccgcaccugggcuuaucauggaagcuacgaggccccuucaacagguuccgcaucuagcauggucaauggcgugguuaaacugcucacgaagccaugggaugugauccccauggucacccagcuugcuaugacugacacaaccccuuuugggcagcagcguguguucaaagaaaagguagacacucggacaccacaacccaagccgggaaccagaaugguuaugacaacuaccgccaacuggcugugggccuuacugggcaaaaagaaaaauccuagguugugcacgcgcgaggaguuuauuaguaaggugcgauccaacgcggcuauaggugcagucuuccaggaagaacagggguggaccagcgccucugaagcugugaaugauucacgguuuugggagcucguggacaaagaaagagcccugcaccaagagggaaagugugagaguugcgucuauaacaugaugggcaagagggagaaaaagcuaggcgaguucgggcgcgcaaaaggauccagagccaucugguacauguggcuuggugcucgguuucuggaguucgaggcgcucggcuuccugaacgaagaucacugguuugggagggagaauagcuggucuggaguugagggcgaagguuugcaucgucugggguauauucucgaggaaaucgacaagaaagauggagaccuuauguacgccgaugacacagcaggcugggauacucgaauuaccgaggacgaucugcagaacgaggaauuaaucacagagcagauggcuccccaccauaagauacuggccaaggcaaucuucaaauugacuuaucagaauaaggugguaaaagugcuccgcccaaccccuagaggcgccgucauggacauuaucucgcggaaggaucaaagggggucaggacagguggguacguacggccugaacacauuuaccaauauggaaguucagcuaauucgccagauggaggcugaaggggugaucacucaagacgacaugcagaaccccaaaggacuuaaggagagagucgagaaauggcugaaggaaugcggcguggaucggcucaagaggauggccauaagcggugacgauuguguaguuaaaccacuggacgagcgauucgggacauccuuguuauuucugaaugauaugggaaaggugcguaaagacauuccccagugggaaccuaguaagggcuggaaaaacuggcaggaggucccauucugcucucaccauuuucacaagaucuucaugaaggauggcagaagccucgugguuccgugucgcaaucaagacgaacuuaucgggcgggcgaggauuucccagggagcagguuggucacugagagagaccgccugccuaggcaaggcuuacgcccagauguggagucugauguauuuucaccgccgggaucucagguuggcaucuauggcuauauguagcgccgugcccacugagugguucccuaccucccgaacaacguggucaauccaugcucaccaucaguggaugaccacugaagacaugcugaaggucuggaacagaguguggauugaggauaauccaaacaugacagacaaaacccccguacacagcugggaagacaucccuuaccuugggaagcgggaggaucuguggugcggaucucucauuggcuuauccaguagggccacuugggccaaaaauauccacacagcgauaacccaagugcgcaaccugaucgguaaggaagaguaugucgacuacaugccaguuaugaagcguuauagcgcccccucggaguccgaagggguguuguga

SEQ ID NO: 15792 - RNA, 9867 nt, Artificial Sequence
  derived and/or modified CDS sequence (opt3) from DENV-4__JN559741__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucagcggaucuuucucuggaaaaggcugccaauguucagugggacgagauggcagauauaacgggaaguuccccuaucauugaagugaagcaggacgaggauggcagcuuuucuauccgggacgucgaggaaacaaacaugauuaccuugcucgugaaacuggcccuaaucacuguaagcggucuguacccccuugcuauaccaaucacaaugacccucugguauauguggcaggucaagacucaacgcuccggggcacugugggaugugccgucaccugccgcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuaugucuccgccauaacacaggcagaacguaucggggagccugacuacgagguagaugaagacauuuuucggaagaagagacugacuaucauggaucuccacccgggagcuggcaaaaccaagaggauucugccaucuaucgugcgcgaggcccuuaaacgaagauuacggacacugauacucgcgcccaccaggguuguggccgcagaaauggaggaagcuuugcgcggccugccuauccguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaagagcgguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaauucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagcgggggggacgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccguucugaugggguugggaaagggcuggccacugcaucggauggacuuaggugugccucuacuggcgaugggguguuacagccagguaaaccccacaacccucacugcuucccuugugaugcuguugguccacuaugccaucauuggaccaggccugcaagcaaaagccacgagagaggcucagaagcguacagcagccgguaucaugaagaauccuaccguugauggcauaacugugauugaccucgaacccaucucuuacgauccgaaauucgagaagcagcuggggcaagucaugcuuuuagugcugugcgcgggacagcucuugcugaugaggaccacaugggcuuucugugagguacuaacucuggccaccggcccaauccucacacuuugggaagggaacccuggacgguuuuggaacacgaccauugcagugagcacugccaauaucuuccgcggcuccuaucuggcuggugccggguuggcauuuucacugauaaaaaacgcucagacaccccgaagaggaaccggcacugccggugagacacucggcgaaaaguggaaaaggcagcugaauucuuuagaccggaaggaguucgaagaguacaagcgcagugggauucuugagguugacagaaccgaagcgaaaucggcccugaaggauggaagcaaaaucaagcaugcaguguccaggggcucuucaaaaauucgauggaucgucgagcgggggauggugaagccaaagggaaaagucguggaccucggcugcggucgugggggauggagcuacuauauggcuacgcuaaagaacguuaccgaaguaaaaggcuacacaaagggcgggcccggacacgaggaaccuauaccgauggccacuuaugguuggaaucuggugaaauugcauuccggcgucgauguguuuuacaagcccaccgagcaaguugacacacugcucugugauaucggggagaguucuagcaacccaacuauugaagagggaagaacccuucgcgugcugaagauggucgaaccuugguugucauccaaacccgaguucugcaucaaggugcugaauccuuauaugccaacaguaauugaagagcucgagaaauuacagaggaagcacggcgguaaccuggugcgguguccccuuaguagaaauagcacccacgaaauguacuggguuucuggggcauccggaaacaucgucucaagcgugaauacuacgucgaaaaugcugcuaaaccgcuuuacaaccaggcaucgaaagccuacuuaugagaaagacguggaucucggcgcuggcacccggucugucaguacagaaacggagaagccagacaugaccauuaucgggagaaggcugcagcgcuugcaggaggaacacaaggagacuuggcauuacgaucaagaaaaucccuaccguacaugggccuaucacggauccuacgaggccccgagcaccgguucagcguccucuaugguuaacggcgugguaaaacugcucacuaagccuugggacgugauaccaauggucacacagcuugcuaugaccgauacaacucccuucgggcagcagcggguguuuaaagaaaagguugacaccagaacgccucaaccaaaacccggaaccaggauggugaugacaacuaccgcaaauuggcugugggccuuacugggcaagaagaaaaacccgcgcuugugcacacgagaggaguucauuagcaagguccggaguaaugcugccaucggugcaguguuucaggaagagcagggguggacuuccgccagcgaagcuguaaacgacucuagauucugggagcucguugauaaagaaagggcgcugcaccaagagggaaagugugagucaugcguguauaacaugaugggcaaacgcgaaaagaagcuaggcgaguuugggagagccaaaggaagucgggcaaucugguacauguggcuuggugcuagguuccuggaauucgaggcccucggcuuucugaaugaagaccauugguucgggcgugagaacuccuggagcggagucgagggcgaagguuugcaccgacugggguauauucucgaggaaauagauaagaaagacggagaucuuauguacgcagacgauaccgccggcugggacacgcgcaucacagaggaugaccugcagaaugaggaauuaauuaccgagcagauggcuccucaucacaagauccuggccaaagcgauuuuuaaguugacuuaucagaacaagguggugaaaguccucagacccacaccacggggcgcaguuauggauaucauaucuaggaaggaccaacgcgggucgggacagguggguaccuacggccugaauacuuucaccaacauggaaguacagcuaaucagacagauggaggccgaaggggugauuacacaagaugacaugcagaauccuaaaggacuuaaggagcgggucgagaaauggcugagggaaugcggcguggaccgacucaagcguauggcuaucucaggugaugacuguguugugaaaccccuggaugagagauuugggacgagcuuguuauuccugaacgacaugggaaagguccgcaaggauauuccacagugggaacccuccaaaggcuggaagaauuggcaggaggugccuuuuugcagucaucacuuccacaaaaucuuuaugaaggacggccggucucucguaguuccauguaggaaccaagaugaacuuauagggagagcccgcauuagccagggagcagguuggucccugcgggagaccgcuugccuaggcaaagccuacgcucagauguggucacugauguauuuccauaggcgagaccucagauuggccaguauggcaaucuguucugcggugccgacugagugguuucccacaagccggaccacuugguccauccacgcccaucaccaguggaugacaaccgaagauaugcugaaggucuggaauaggguguggauugaggacaacccuaauaugauagauaagacgccaguucacucaugggaagacauccccuaccuugggaaacgcgaggaccuguggugcggaagccucauuggcuuaucuucccgugcuacaugggccaagaacauccauaccgcaauuacucaagugagaaaucugaucgguaaagaagaguaugucgauuacaugccugugaugaagcgauauagugcuccaagcgagucggaagggguauuguga

SEQ ID NO: 15793 - RNA, 9867 nt, Artificial Sequence
  derived and/or modified CDS sequence (opt3) from DENV-4__JQ513334__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccauggagguggcgcuccugcgcacuuacuguaucgaagcaaguauuuccaauaucacaaccgccacgcgaugcccaacccaaggagagcccuaucuuaaagaggaacaggaccagcaguacauuuguagaagggaugucguugaccggggcuggggcaacgggugcggacuguucgguaagggcggggugguaacaugcgcuaaauuuucuuguagcgagaagaucacuggaaauuuggugcaaauagaaaaccucgaguauaccgucgugguuacagugcauaauggcgauacucacgccgucgguaacgacaccuccaaucacggggugacagcaaccauuacuccucguucaccaaguguagaaguugagcugccggauuacggcgaguuaacgcuggacugcgaaccccgcagcggaaucgacuucaacgagaugauucucaugaaaaugaagaagaaaacauggcuugugcauaagcagugguuucuggauuugccucuaccaugggcugccggcgcggacaccucugaaguccacuggaauuacaaagagagaauggugacuuucaaggucccccaugccaaaaggcaggaugugaccguucuggggucccaggaaggagcaaugcacucagcucucgccggugcuacagagguggacagcggcgaugggaaccacauguuugccggacaucugaaguguaaaguacggauggagaagcuucgaaucaagggcaugaguuauaccaugugcucugguaaauucuccaucgacaaggaaauggcagagacucaacacgggacaacggucgugaaaguuaaguacgaaggcgccggagcuccuuguaaagugccaauugagauacgcgaugucaauaaggagaaggugguaggcagagugaucagcucgauuccccuggcggaaaacaccaacucuguuacuaauaucgaguuggaaccgccuuucggggacuccuauauagucauuggaguggguaacucagcacucacacugcauugguuuaggaaaggcaguagcaucgggaagauguucgaguccaccuaccggggagccaaacgcguggcuaucuuaggcgaaacagccugggauuuugguucugucgggggccuguucacuagccuaggaaaggcaguucaccagguguuuggcucaguguauaccacgauguucgggggaguaaguuggauggucagaauucucaucggccugcuuguguuguggauugguaccaauuccaggaacacaagcauggccaugacuugcauagcuguugggggaaucacccuguuucucggcuucacagugcaggccgacauggguugugucgugucuuggucaggccgugagcugaaaugcgggaguggaauuuuuguuguggauaauguacauacuuggaccgagcaauacaaguuccagcccgaaagcccagcacggcuugcguccgcuauccugaacgcccacaaggacggcgucugugggauccgaucuacgacaagauuggagaaugugauguggaaacagauuaccaacgaacucaauuaugugcugugggagggaggccacgacuuaacugucguugcaggugaugugaaggggguacugacaaaaggaaagagggcccuaaccccucccgugucggaccucaaauacagcuggaagacuuggggcaaggcuaaaauauuuaccccagaagcccgcaacuccacauuccugaucgauggucccgacacgucagagugcccuaaugagcggagagcauggaacagucuugaagucgaggauuacggcuuugggauguucaccacuaauauuuggaugaaguucagggaaggaucuagcgaggugugugaccaucgcuugauguccgcugccaucaaagaucagaaggcgguucacgccgacaugggcuauuggauugaaucaagcaaaaaccaaacauggcagaucgagaaggcuucucugauagaggugaaaaccugccucuggccaaagacacauacucugugguccaauggggucuuagaaagucagaugcugaucccgaagagcuacgcaggacccuuuucucagcacaacuaucgacaaggcuacgccacccagacgguggguccuuggcaccuugggaaauuggagauugauuucggagaaugcccaggcacaaccguuacuauccaggaggacugugaucaucggggucccucccuccguaccacaacugcuucaggcaagcuggugacccaguggugcuguagaaguugcacaaugccuccacuaagguuucugggggaggacggauguugguauggcauggaaauucgcccccucagcgagaaagaagagaacauggucaagucgcaaguagccgcagggcagggaacguccgaaaccuucucuaugggccugcuuugcuugacucuguuuguggaggaguguuuacggagaaggguuacacgaaaacacaugauccucgcgguggucauaacccugugcgccauuauccuuggugggcugacuuggauggauuugcuccgcgcucugauuaugcuaggagacacaaugagcggccggaucggcgggcagacccaucuggccauaauggcaguguucaagaugucaccgggauacguacucgguguguuucugagaaagcuuacgaguagggaaacugcuuugauggucaucggcauggccaugaccacaacccuguccauuccucacgacuuaauggagcucaucgaugggauuucucugggacuuauccugcuaaaaauaguuacucaguucgacaauacacaagugggcacccucgcacugagcuugacauuuauucguuccacuaugucacuggugauggccuggcgcaccaucauggcugucuuauucgugguuacgcucaucccacugugucggacaagcugccuucagaagcagagucauuggguagaaauuaccgcgcugaucuugggugcccaagcacuccccguguaucugaugacucuaaugaaaggggcuucuagaagguccuggccucugaacgagggaauuauggccgucggccuugugagccuccugggcucggccuugcugaagaaugauguucccuuagcugggccaaugguggcaggaggucuccugcuugccgcguacgucaugucaggcucuagugcugaccuguccuuggaaaaagccgcaaacgugcagugggaugagauggccgacauaaccgggagcucuccuaucauugagguaaagcaggaugaagacggaagcuuuuccauccgagaugucgaggaaacaaauaugauuacucuccuggugaagcuagcucugaucaccguuucaggccuuuacccccucgcaauaccagugacgaugacacugugguauauguggcaggucaaaacccaacggaguggugccuugugggacgugccgagcccugcggcuacucagaaggccgcauuaucugaggggguuuaccgcaucaugcagagaggacuguucggcaaaacacaggugggcgucgggauucacauggaaggaguguuucacaccauguggcauguaacuagggguuccgugaucugucacgagacaggccggcucgagcccucaugggccgauguucgaaacgacaugauuaguuaugggggaggcuggagacugggugauaagugggacaaagaagaggacguccaagugcuugcuaucgaaccagggaagaaucccaagcaugugcagaccaaaccuggacuguucaagacguugacuggcgagauaggcgccgucacccuagauuucaaaccagggacaagcggaucccccauuaucaaccgcaaggguaaaguaaucggccuguacgggaauggagugguuaccaagucuggcgacuaugugucggcaauuacacaggcugagaggauaggugaaccugauuacgaggucgacgaagauaucuuucguaaaaagcggcucacuauuauggaccugcacccgggggccggaaagaccaaaagaauccuuccaagcauugugagggaggcguuaaagcgccgacugagaacgcucaucuuggcccccacacggguuguggcagcugaaauggaggaggcccugaggggccucccuauacgcuaucagacuccagcugucaaaucagaacauaccggccgugagaucguggaucugaugugccacgcaacauucaccacuagacuucuguccaguacccggguacccaacuacaauuugauugugauggacgaagcccacuuuacagauccuucuagcguugccgcuaggggguacaucuccacgcgcgucgagaugggagaagcggcagccauuuucaugacugcuaccccgcccggugccacagacccauuuccucaaucaaacucucccaucgaggauauagagcgagaaauuccagagagaagcuggaauaccggcuucgacuggaucacugacuaucaggggaagacagugugguuugugccuaguaucaaagcaggaaacgauauugccaauugccuacggaaguccggcaagaaagucauccagcugagcaggaagaccuucgacacggaauaccccaaaacuaagcucacagauugggacuuuguugugaccaccgauauaucugagaugggugcuaacuuccgcgcggggagaguaauugacccaaggcgguguuuaaaaccggugauccugacugauggcccugaacgugucauucuugccggacccaucccagugacacccgcaucagcugcccaacgccgaggcagaauagggaggaacccugcacaggaggacgaucaguauguuuuuuccggagacccacugaagaaugaugaggaccaugcccacuggaccgaagcuaagaugcucuuggauaacauuuacacacccgaggguaucaucccuacucuguucggcccggaacgggagaaaacgcaggccauugacggggaguuccgccucagaggagaacaaaggaagaccuuuguggagcugaugcggcgaggcgaccuuccagucuggcuaaguuauaaaguagcgagcgcagguaucucguacaaggauagagaauggugcuucacaggggagcgcaauaaccagauucuggaagagaauauggagguggaaauauggacuagggagggcgaaaaaaagaaguugcggccccguugguuagacgccagaguuuaugcugauccuauggcccugaaagacuuuaaggaguucgcuucuggaaggaaauccaucacccucgauauucugacagaaaucgcaagccuucccaccuaccugucaagucgcgccaagcucgcuuuggacaacaucgugaugcugcauacuacggagcggggcgggcgagccuaccagcacgcacuaaaugagcugccagaaucucucgagacccuuaugcuggucgcguuauugggagccaugacagcugguauuuuucuguucuuuaugcagggcaaagggauaggaaagcucuccaugggccugaucacuauugccguggcaagcggucuucugugggucgcugaaauccaaccucaguggauugccgcaucaaucauacucgaguucuuuuugauggugcuguuaauccccgaaccagagaagcagagaaccccucaggauaaccaacuaauuuauguuauccuggccauucucacaaucauagggcuuauugcugcgaaugagaugggccugaucgaaaaaaccaagacugacuucggauuuuaccaggugaaaacagagacgaccauuuuggauguagaccugaggccggccagugcauggacucucuaugcuguggccacaaccauccugacccccaugcuucgccacacaauagaaaacacuagcgccaaucucucccuggcagcuaucgccaaccaggcggcugucuugaugggccuggggaagggauggccauuacaucggauggaucuaggcguuccucugcucgccauggguuguuacucucaggugaaucccacgacccuuacagcaagccuggucauguugcuggugcacuaugccauuaucgggccaggacuccaagcuaaagcaacuagagaggcccagaagcguaccgcggcuggcauuaugaaaaacccuacaguagacgguaucaccgugauagaucuggagcccauuuccuacgacccgaaguucgaaaagcagcuuggccaaguuauguuacuggugcucugcgccgggcaguugcugcuaaugaggacuacgugggcauuuugugagguccugacacucgccaccggaccaauccuuacucugugggaaggcaauccugggcgguucuggaacaccacaaucgcugugucaacugccaacauuuuccgcggaucuuauuuggcaggcgcuggucuggccuuuagucucaucaaaaaugcgcagaccccccgaagagggacaggaacgaccggcgagacucugggugaaaaguggaaaaggcaguuaaacucgcuugaccggaaggaguucgaggaauacaaacgcagcggcauacuggaggucgauagaacagaagccaaguccgcacucaaggacgggucuaaaauuaagcaugcugugucaaggggaagcuccaaaauccgauggauuguugagcggggcaugguaaagccaaaagggaagguggucgaucuaggaugcggccgugguggguggaguuacuauauggccacccugaagaaugugacugaaguuaaaggauacacaaagggcggccccgggcacgaggagccuaucccgauggcaaccuauggauggaacuuggugaaacugcauucuggugucgacguguuuuacaagcccacggaacaaguagauacccuccuuugugacauaggcgagagcucauccaauccaacaaucgaagaggggagaacucugcgcguguugaaaaugguugaaccuuggcugaguagcaagcccgaguucugcauuaagguccucaacccuuauaugccaaccgugaucgaggaauuagagaaacugcagaggaagcacggaggcaaucuugugcgguguccccugucuagaaacuccacacacgaaauguacugggucucaggugcuagcgggaauauuguuucgucugugaacacuaccaguaaaaugcuacucaaucgcuuuacaaccaggcaucgaaagccuacuuaugagaaagauguagaccugggagccggcacgcgguccgugagcacagagaccgaaaagccagauaugacuaucauuggcagaagguugcagcgccugcaggaggaacacaaagagaccuggcauuacgaccaagaaaaccccuaccguacaugggccuaucacgggucauacgaggcgccguccacgggaucugcuagcaguauggucaauggugugguuaagcuccuuaccaagccuugggaugugaucccaauggucacucagcuggcaaugacagacaccacucccuucggccagcagcggguguuuaaagagaagguagacacaagaaccccucaaccaaaacccgggacaaggaugguuaugacuaccacggccaacugguuaugggcucuguugggaaagaaaaagaauccgcgccucugcacccgagaagaguucauauccaaggugcggagcaacgccgcaauuggcgccgucuuucaggaagagcaggguuggacaucugcuucagaagcggugaaugauaguagauucugggagcugguggacaaagagagggcccuacaccaagaagggaagugugaguccugcgucuauaacaugaugggaaaacgcgaaaagaaacuuggcgaguuuggcagagcaaaggggagccgggcuaucugguacauguggcugggagccagguuccucgaauuugaggcacuggguuucuugaacgaggaucauugguucggccgugaaaauucuuggucggggguugagggagaaggccugcaccgacucgguuauauccuugaggagauugacaagaaagauggggaccugauguacgccgaugacacugcuggaugggauacccgcauaacagaagacgauuuacagaacgaggaacugaucacugagcagauggccccucaucacaagauuuuggcgaaagcaaucuuuaagcucaccuaucagaauaaagugguaaaggugcugagacccacgccacggggcgccgucauggacauuaucucaaggaaggaucaacgcggcagcgggcaggugggaacauacggucuaaacaccuucacuaauauggaaguucagcuuauaagacagauggaggcugagggcgugaucacacaagacgacaugcagaacccuaaagggcugaaggaacgggucgagaaauggcucagggaaugcggaguggaucgacugaagcguauggccauuuccggcgacgauuguguaguuaaacccuuggacgagagauuugguaccaguuuacuguuccucaaugauauggggaaggugcgcaaagacaucccacagugggaacccucuaagggauggaagaacuggcaggaggucccuuuuugcagccaucacuuccacaaaauuuuuaugaaggauggccggucccuugugguuccauguaggaaucaagacgagcugaucggcagagcacgcauaucacagggggcuggauggagucuacgggaaacugccugccuggguaaagcuuacgcccagauguggucucucauguauuuccauaggcgagauuugagacuggcaagcauggcgauuuguuccgccgugccgaccgagugguuucccacaucacggacgaccuggagcauccacgcucaucaccaguggaugacuacagaagacaugcuuaaggucuggaacaggguguggaucgaggauaauccuaacaugauugacaaaaccccaguacacucuugggaagacauacccuaccugggcaagcgcgaggaucucuggugcggguccuuaaucggacugaguagccgugccacuugggcaaagaauauucauacagcuaucacccaagugagaaacuugauuggcaaagaggaauaugucgacuacaugccuguuaugaagcgauauucggccccauccgagucugaaggugugcuguga

SEQ ID NO: 15794 - RNA, 9867 nt, Artificial Sequence
  derived and/or modified CDS sequence (opt3) from DENV-4__JQ513336__SS-prME
agcaccaucacccugcucugccuuauucccacugugauggcauuccaccuguccacgagagacggcgaaccuuugaugauagucgcuaagcaugaaagagggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacaugggugauguauggaaccugcacgcagucaggggagcgccgacgugaaaagagaaguguggcauugacuccucacagcggaaugggccucgagaccagggcggaaacauggauguccucugagggugcuuggaaacaugcccagcgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguggaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcgagaaaaucacuggaaauuuggugcaaauagaaaaccucgaguauaccgucgugguuacagugcauaauggcgauacucacgccgucgguaacgacaccuccaaucacggggugacagcaaccauuacuccucguucaccaaguguagaaguugagcugccggauuacggcgaguuaacgcuggacugcgaaccccgcagcggaaucgacuucaacgagaugauucucaugaagaugaagaaaaagacauggcuugugcauaaacagugguuucuggauuugccucuaccaugggcugccggcgcggacaccucugaaguccacuggaauuacaaggagagaauggugacuuucaaagucccccaugccaagaggcaggaugugaccguucuggggucccaggaaggagcaaugcacucagcucucgccggugcuacagagguggacagcggcgaugggaaccacauguuugccggacaucugaaauguaagguacggauggagaaacuucgaaucaaaggcaugaguuauaccaugugcucugguaaguucuccaucgacaaagaaauggcagagacucaacacgggacaacggucgugaagguuaaauacgaaggcgccggagcuccuuguaaggugccaauugagauacgcgaugucaauaaggagaaagugguaggcagagugaucagcucgauuccccuggcggaaaacaccaacucuguuacuaauaucgaguuggaaccgccuuucggggacuccuauauagucauuggaguggguaacucagcacucacacugcauugguuuaggaagggcaguagcaucgggaaaauguucgaguccaccuaccggggagccaagcgcauggcuaucuuaggcgaaacagccugggauuuugguucuguagggggacuguucacuagccuaggaaaagcaguccaccagguuuuuggcucaguguauaccacgauguucgggggagugaguuggaugguaaggauucucaucggccugcuugucuuguggauugguaccaauuccaggaacacaagcauggccaugacuugcauagcuguagggggaaucacccuguuucucggcuucacaguucaggccgacauggguuguguggucucuuggucaggccgugagcugaagugcgggaguggaauuuuugugguugauaaugugcauacuuggaccgagcaauacaaguuccagcccgaaagcccagcacggcuugcguccgcuauccugaacgcccacaaagacggcguaugugggauccgaucuacgacaagauuggagaaugucauguggaagcagauuaccaacgaacucaauuaugugcugugggagggaggccacgacuuaacuguggucgccggugauguuaaaggggugcugacaaagggaaaaagggcccuaaccccucccguaucggaccucaaguacagcuggaagacuuggggcaaagcuaagauauuuaccccagaagcccgcaacuccacauuccugaucgauggucccgacacgucagagugcccuaaugagcggagagcauggaacagucuugaaguggaggauuacggcuuugggauguucaccacuaauauuuggaugaaauucagggaaggaucuagcgaggucugugaccaucgcuugauguccgcugccaucaaggaucagaaagcggugcacgccgacaugggcuauuggauugaaucaagcaagaaccaaacauggcagaucgagaaggcuucucugauagagguuaagaccugccucuggccaaagacacauacucugugguccaaugggguguuagaaagucagaugcugaucccgaaaagcuacgcaggacccuuuucucagcacaacuaucgacaaggcuacgccacccagacggucgguccuuggcaccuugggaaguuggagauugauuucggagaaugcccaggcacaaccgugacuauccaggaggacugugaucaucggggucccucccuccguaccacaacugcuucaggcaaacugguuacccaguggugcuguagaaguugcacaaugccuccacuaagguuucugggggaggacggauguugguauggcauggaaauucgcccccucagcgagaaggaagagaacauggugaaaucgcaagucgccgcagggcagggaacguccgaaaccuucucuaugggccugcuuugcuugacucuguuuguagaggaguguuuacggagaagggugacacgaaagcacaugauccucgcgguugugauaacccugugcgccauuauccuuggugggcugacuuggauggauuugcuccgcgcucugauuaugcuaggagacacaaugagcggccggaucggcgggcagacccaucuggccauaauggcagucuucaagaugucaccgggauacgugcucgguguauuucugagaaaacuuacgaguagggaaacugcuuugauggugaucggcauggccaugaccacaacccuguccauuccucacgacuuaauggagcucaucgaugggauuucucugggacuuauccugcuaaagauagucacucaguucgacaauacacaaguuggcacccucgcacugagcuugacauuuauucguuccacuaugucacuggugauggccuggcgcaccaucauggcuguguuauucgucgugacgcucaucccacugugucggacaagcugccuucagaaacagagucauuggguugaaauuaccgcgcugaucuugggugcccaagcacuccccguauaucugaugacucuaaugaagggggcuucuagaagguccuggccucugaacgagggaauuauggccgugggccuugucagccuccugggcucggccuugcugaaaaaugaugugcccuuagcugggccaaugguugcaggaggucuccugcuugccgcguacgugaugucaggcucuagugcugaccuguccuuggaaaaggccgcaaacguccagugggaugagauggccgacauaaccgggagcucuccuaucauugaggugaagcaggaugaagacggcagcuuuuccauccgagauguagaggaaacaaauaugauuacucuccuggucaaacuagcucugaucaccgugucaggccuuuacccccucgcaauaccaguuacgaugacacugugguauauguggcaagugaagacccaacggaguggugccuugugggacgucccgagcccugcggcuacucagaaagccgcauuaucugaggggguguaccgcaucaugcagagaggacuguucggcaagacacagguuggcguggggauucacauggaaggagucuuucacaccauguggcaugugacuagggguuccguaaucugucacgagacaggccggcucgagcccucaugggccgaugugcgaaacgacaugauuaguuaugggggaggcuggagacugggugauaaaugggacaaggaagaggacguucaaguccuugcuaucgaaccagggaagaaucccaaacaugugcagaccaagccuggacuguucaaaacguugacuggcgagauaggcgccgugacccuagauuucaagccagggacaagcggaucccccauuaucaaccgcaaagguaaggucaucggccuguacgggaauggaguagugaccaaaucuggcgacuauguuucggcaauuacacaggcugagaggauaggugaaccugauuacgagguggacgaagauaucuuucguaagaagcggcucacuauuauggaccugcacccgggggccggaaaaaccaagagaauccuuccaagcauugucagggaggcguuaaaacgccgacugagaacgcucaucuuggcccccacacgggugguugcagcugaaauggaggaggcccugaggggccucccuauacgcuaucagacuccagcugugaagucagaacauaccggccgugagaucgucgaucugaugugccacgcaacauucaccacuagacuucuguccaguacccgggugcccaacuacaauuugauuguaauggacgaagcccacuuuacagauccuucuagcguggccgcuaggggguacaucuccacgcgcguugagaugggagaagcggcagccauuuucaugacugcuaccccgcccggugccacagacccauuuccucaaucaaacucucccaucgaggauauagagcgagaaauuccagagagaagcuggaauaccggcuucgacuggaucacugacuaucaggggaaaacagucugguuugugccuaguaucaaggcaggaaacgauauugccaauugccuacggaaguccggcaaaaaggugauccagcugagcaggaaaaccuucgacacggaauaccccaagacuaaacucacagauugggacuuugucguuaccaccgauauaucugagaugggugcuaacuuccgcgcggggagagugauugacccaaggcgguguuuaaagccgguaauccugacugauggcccugaacgugugauucuugccggacccaucccagucacacccgcaucagcugcccaacgccgaggcagaauagggaggaacccugcacaggaggacgaucaguauguguuuuccggagacccacugaagaaugaugaggaccaugcccacuggaccgaagcuaaaaugcucuuggauaacauuuacacacccgaggguaucaucccuacucuguucggcccggaacgggagaagacgcaggccauugacggggaguuccgccucagaggagaacaaaggaaaaccuuuguugagcugaugcggcgaggcgaccuuccaguguggcuaaguuauaaggucgcgagcgcagguaucucguacaaagauagagaauggugcuucacaggggagcgcaauaaccagauucuggaagagaauauggagguagaaauauggacuagggagggcgaaaagaagaaauugcggccccguugguuagacgccagaguguaugcugauccuauggcccugaaggacuuuaaagaguucgcuucuggaaggaaguccaucacccucgauauucugacagaaaucgcaagccuucccaccuaccugucaagucgcgccaaacucgcuuuggacaacaucguuaugcugcauacuacggagcggggcgggcgagccuaccagcacgcacuaaaugagcugccagaaucucucgagacccuuaugcugguggcguuauugggagccaugacagcugguauuuuucuguucuuuaugcagggcaaggggauaggaaagcucuccaugggccugaucacuauugccgucgcaagcggucuucuguggguggcugaaauccaaccucaguggauugccgcaucaaucauacucgaguucuuuuugaugguccuguuaauccccgaaccagagaaacagagaaccccucaggauaaccaacuaauuuaugugauccuggccauucucacaaucauagggcuuauugcugcgaaugagaugggccugaucgaaaagaccaaaacugacuucggauuuuaccagguuaagacagagacgaccauuuuggauguggaccugaggccggccagugcauggacucucuaugcuguagccacaaccauccugacccccaugcuucgccacacaauagaaaacacuagcgccaaucucucccuggcagcuaucgccaaccaggcggcuguguugaugggccuggggaaaggauggccauuacaucggauggaucuaggcgucccucugcucgccauggguuguuacucucagguuaaucccacgacccuuacagcaagccuggugauguugcugguccacuaugccauuaucgggccaggacuccaagcuaaggcaacuagagaggcccagaaacguaccgcggcuggcauuaugaagaacccuacaguggacgguaucaccguaauagaucuggagcccauuuccuacgacccgaaguucgaaaaacagcuuggccaagugauguuacugguucucugcgccgggcaguugcugcuaaugaggacuacgugggcauuuugugaggugcugacacucgccaccggaccaauccuuacucugugggaaggcaauccugggcgguucuggaacaccacaaucgcugucucaacugccaacauuuuccgcggaucuuauuuggcaggcgcuggucuggccuuuagucucaucaagaaugcgcagacaccccgaagagggacaggaacgaccggcgagacucugggugaaaaauggaagaggcaguuaaacucgcuugaccggaaagaguucgaggaauacaagcgcagcggcauacuggagguggauagaacagaagccaaguccgcacucaaagacgggucuaagauuaaacaugcugucucaaggggaagcuccaagauccgauggauuguggagcggggcaugguuaaaccaaaggggaagguaguggaucuaggaugcggccgugguggguggaguuacuauauggccacccugaaaaaugucacugaagugaagggauacacaaaaggcggccccgggcacgaggagccuaucccgauggcaaccuauggauggaacuugguuaagcugcauucugguguggacgucuuuuacaaacccacggaacaaguggauacccuccuuugugacauaggcgagagcucauccaauccaacaaucgaagaggggagaacucugcgcguauugaagaugguggaaccuuggcugaguagcaagcccgaguucugcauuaaaguucucaacccuuauaugccaaccgucaucgaggaauuagagaagcugcagaggaaacacggaggcaaucuugugcgguguccccugucuagaaacuccacacacgaaauguacugggugucaggugcuagcgggaauauugucucgucuguuaacacuaccaguaagaugcuacucaaucgcuuuacaaccaggcaucgaaaaccuacuuaugagaaggauguggaccugggagccggcacgcgguccguaagcacagagaccgaaaaaccagauaugacuaucauuggcagaagguugcagcgccugcaggaggaacacaaggagaccuggcauuacgaccaagaaaaccccuaccguacaugggccuaucacgggucauacgaggcgccguccacgggaucugcuagcaguauggugaauggugucgugaagcuccuuaccaaaccuugggauguuaucccaauggugacucagcuggcaaugacagacaccacucccuucggccagcagcgggucuuuaaggagaaaguggacacaagaaccccucaaccaaagcccgggacaaggaugguaaugacuaccacggccaacugguuaugggcucuguugggcaagaagaagaauccgcgccucugcacccgagaagaguucauauccaaaguucggagcaacgccgcaauuggcgccguguuucaggaggaacaggguuggacaucugcuucagaagcggucaaugauaguagauucugggagcugguggacaaggagagggcccuacaccaagaagggaaaugugaguccugcguguauaacaugaugggaaagcgcgagaagaaacuuggcgaguuuggcagagcaaaagggagccgggcuaucugguacauguggcugggagccagguuccucgaauuugaggcacuggguuucuugaacgaggaucauugguucggccgugaaaauucuuggucgggggucgagggagaaggccugcaccgacucgguuauauccuugaggagauugacaaaaaggauggggaccugauguacgccgaugacacugcuggaugggauacccgcauaacagaagacgauuuacagaacgaggaacugaucacugagcagauggccccucaucacaaaauuuuggcgaaggcaaucuuuaaacucaccuaucagaauaagguugugaagguacugagacccacgccacggggcgccgugauggacauuaucucaaggaaagaucaacgcggcagcgggcaggucggaacauacggucuaaacaccuucacuaauauggaagugcagcuuauaagacagauggaggcugagggcguuaucacacaagacgacaugcagaacccuaaggggcugaaagaacggguggagaaguggcucagggaaugcggagucgaucgacugaaacguauggccauuuccggcgacgauugugugguaaagcccuuggacgagagauuugguaccaguuuacuguuccucaaugauauggggaaaguucgcaaggacaucccacagugggaacccucuaagggauggaaaaacuggcaggaggugccuuuuugcagccaucacuuccacaagauuuuuaugaaagauggccggucccuugucgugccauguaggaaucaagacgagcugaucggcagagcacgcauaucacagggggcuggauggagucuacgggaaacugccugccuggguaaggcuuacgcccagauguggucucucauguauuuccauaggcgagauuugagacuggcaagcauggcgauuuguuccgccguuccgaccgagugguuucccacaucacggacgaccuggagcauccacgcucaucaccaguggaugacuacagaagacaugcuuaaaguguggaacagggucuggaucgaggauaauccuaacaugauugacaagaccccagugcacucuugggaagacauacccuaccugggcaagcgcgaggaucucuggugcggguccuuaaucggacugaguagccgugccacuugggccaaaaauauucauacagcuaucacccaaguaagaaacuugauuggcaaggaggaauauguggacuacaugccugucaugaaacgauauucggccccauccgagucugaagguguucuguga

SEQ ID NO: 15795 - RNA, 9867 nt, Artificial Sequence
  derived and/or modified CDS sequence (opt3) from DENV-4__JQ513338__SS-prME
agcaccauaacucugcucugccuuauucccacugugauggccuuccaccuguccacgagagacggcgaaccuuugaugauagucgcuaaacaugaaagggggcggccauuacuguuuaaaaccacagaaggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggagcagcaguacauuuguagaagggacgucguugaucggggcuggggcaacgggugcggauuguucgguaaaggcggggugguaacaugcgcuaaguuuuccuguucuggaaaaaucacuggcaaucucgugcaaauagaaaaccuggaguauaccgucgugguuacagugcauaaugguaacacuccugccgucgggaaugacaccagcaaccacggcgugacagcaccaauuaccccgcguucccccucaguagaaguuaaguuaccugauuacggagagcugacucucgacugcgagccacgcaguggcaucgauuucaaugaaaugauucuuaugaagaugaaaaagaaaacguggcuggugcacaagcagugguuuuuggaccuaccccugccuuggacaaccggggcugacacuagcgagguccauuggaacuacaaagaaagaauggugaccuucaaggucccacacgccaaaaggcaggaugugacaguucucggaucucaggagggugcgaugcauuccgcccuggcaggcgcuaccgaaguggacucaggggaugagaaucacauguuugccggacaccuuaaguguaagguacggaugggcaaacugcgaaucaaggguaugagcuauacuaugugcagugggaaauucucuaucgacaaggagauggcugaaacacaacauggcacgaccgucgugaaaguuaaguacgagggagccggcgcacccuguaaggugccgauugaaauacgcgaugucaacaaagagaaggugguagggagagugaucuccgccacuccuuuggcugagaacacaaauagcguuaccaacauugaacucgagcccccauucggagacagguauaucgucauaggugugggcaauucggcgcugacauuacacugguuucggaaagggucuuccauuggaaagauguucgaaucaacuuaccgcggcgcaaaaagaauggccauccugggugagaccgcuugggauuuugggagugugggcggacuauucacgagccucggcaaggccguccaucagguuuuuggguccguguauaccacaauguucggaggcgugucuuggaugaucaggauucugaucgguuuucuuguauuguggauugggacuaacagccguaauaccucaauggcaaugacaugcauagccgucggaggcaucacucuguuccucgguuuuaccgugcaggcugacaugggcuguguugugaguugguccgggcgggaacugaagugcggaagcggcauuuucgucguggauaacguucacacguggacagagcaauacaaauuucagccugagucucccgcccgacuugcaucagcgauccugaaugcucauaaggacgggguguguggaaucagaaguaccacuagguuggaaaacguaauguggaaacagauuacaaaugagcucaacuauguccugugggaaggcggucacgauuuaaccgugguggccggggacgucaagggaguucugacuaaaggcaagcgcgcacuaaccccacccgccagcgaccucaaguacuccuggaaaacaugggguaaggcuaaaauauucacgccugaggccagaaauucuaccuuucugaucgauggcccagacacuucggaaugcccgaacgagagaagggcauggaauagcuucgagguggaagauuacggguucggaauguuuacaaccaacauuuggaugaaguuccgcgagggcuccucagaaguaugugaccaccgacuuaugagugcugccaucaaagaucagaaggcggugcaugccgacaugggguauuggauugagucuagcaaaaaucaaacauggcagaucgaacgggcuuccuugauagaggucaagacuugccuguggcccaagacccacacgcucuggucaaacggagugcuggagagccagauguuaaucccuaaaucuuacgcaggcccauuuucccagcauaacuaucgucaagguuacgccacacagaccguugggcccuggcaccugggaaaacuugaaauugauuucggcgagugcccugguacuaccgugacaauccaggaaaauugugaccacagaggcccaaguuugaggacuaccacagcuagcgggaaacucgucacgcaguggugcugucgcucuugcaccaugcccccgcugcgguuucuaggagaggauggcuguugguaugggauggagauuagaccucuguccgaaaaggaggaaaacauggugaaaucacaaguuacugccggacagggcacaagugagaccuucagcaugggucuccugugccuuacuuuguuuguggaagagugucugaggcgacgcgucacacggaagcauaugaucuuagcaguagugauaacccucugcgcgauuauccuagggggccuuacguggauggaccuguugagagcccucauuaugcugggcgauacuaugucgggcaggaucgggggacagacccaccuagcuauaauggccguuuucaagauguccccagguuacgugcugggcgucuuucuccguaaacugacaucucgcgagaccgcacuuauggugaucgggauggcuaugacuacaaccuugagcauuccccaugaccugauggaauuaaucgauggaauuucacucggccugauccuucugaagauaguaacacaguucgacaauacucaaguggguacccuagcccucagucugacguuuauucgguccacaaugucuuuggucauggcauggagaaccaucauggccguucuguucguggugacuuuaaucccucucuguaggaccagcugccugcagaaacagucccacugggucgagauuacagcucuuauccugggggcgcaagccuugcccguguaucucaugacucugaugaagggagcaucacgacggagcuggccacuaaacgaaggcauuauggcuguuggccugguaagucuucucgggucugcccuguugaaaaaugacgugccucuggccggacccauggucgcugguggcuuacuccuggcagccuacgugauguccgggagcucggcggaucuuucacuggagaaggcugccaacguucagugggacgaaauggcagauauaaccggaucuaguccaaucauugaggugaagcaggacgaggauggcuccuuuagcauccgcgacgucgaagagacgaauaugauuacauugcucgugaaacuggcccuaaucaccguaucuggucuguacccgcuugcuauaccuaucacuaugacacucugguauauguggcaggucaagacccaaagaagcggggcacugugggaugugcccuccccagccgcgacucagaaagcugccuugucagaaggaguuuacaggauuaugcagcggggcuuauucggcaagacacaggugggggucggaauccauauggaggguguguuccacaccauguggcacguuacgcgaggcagugugauuugucaugaaacugggagacuggagcccagcugggcagacguccgcaacgauaugaucucuuauggaggcgguuggaggcucggggacaaaugggauaaggaggaagacgugcaaguacuggccauagagccuggaaagaauccaaaacacgugcagaccaagcccggccuuuuuaaaacacugaccggcgaaauuggggcuguuacauuggauuucaagccuggaacuuccgguucaccgaucaucaaccguaaaggcaaggucauugggcuauacggaaauggcguggugaccaaaaguggugacuaugucagcgccauaacgcaggcagagcggaucggggagccagacuacgaaguagaugaggacauuuuuagaaagaagaggcugacaaucauggaucuccaucccggagcuggcaaaacuaagcgcauucugccuuccaucgugcgagaagcccuuaaaagacgguuaaggacccugauacucgcgccaacacgcguuguggccgcagagauggaagaggcuuugcguggccugcccaucagauaucagaccccugccgucaagucugagcacacugggcgggaaauuguggaccucaugugccaugcuaccuucacaacgaggcugcuuucgagcacucgcguuccgaacuacaaucugaucgugauggaugaggcacacuuuaccgaccccucauccgucgccgcccgaggauacauuaguacaagaguggaaaugggugaggcugcggcaaucuucaugaccgccacuccaccuggcgcuacagaucccuuuccacaaucuaacagcccuauagaagacauugagcgggagauccccgaaagguccuggaauaccggguucgauuggaucacggacuaucagggaaaaacuguaugguuugugccaucaauuaaggccggcaacgauaucgcaaacugcuugcgcaagucugguaaaaagguuauacagcuaagcagaaaaacauucgacaccgaguacccgaagaccaaacugacugacugggauuuugucgugacaaccgacauuagugaaaugggggccaauuucagggcuggccgggugaucgauccucgucgcugucucaagcccgucauuuuaacagacggaccagagcgaguuauccuggcgggccccauaccugugacuccagccuccgcagcucaaagaagggggcggauuggacgcaaccccgcccaggaagaugaccaguauguauucagcggugauccucuuaagaaugacgaggaucacgcacauuggacggaggccaaaaugcugcucgacaacaucuacaccccggaaggcaucauuccaacauuguuugggcccgagagagaaaagacucaggcuaucgauggagaguucaggcugcggggcgagcaacgaaaaaccuuuguggaacucaugagacgcggugaccugccugucuggcuuucuuauaagguggccucagcggggauuuccuacaaagauagggaguggugcuucacaggcgaacggaauaaccagauacuagaggaaaauauggagguugagaucuggacccgugaaggagagaagaagaaacugagacccaagugguuggacgcaaggguguaugccgacccaauggcuuuaaaagauuuuaaggaguucgccaguggccgcaaaagcauuacucuggacauccucacggagaucgcuucgcugccuaccuaccuuucuucccgggcaaagcuggcccucgauaacauugucauguugcacacaacugaacgagggggacgggcuuaccagcaugcccugaaugagcuacccgagagccuggaaacccucaugcuuguagcacuguuaggugcgaugacagccggcauauuuuuguucuuuaugcaggggaagggaaucggcaaacugucaaugggucucauuaccaucgcuguggccagugggcugcuuuggguugcagagauucaaccacaguggaucgcugccucuauaauccuggaguucuuucucaugguguugcugauuccugagccggaaaagcagaggacuccccaggacaaccaauuaaucuaugucauucuaacaauccugacgauaauuggccucaucgcagccaaugagaugggacuuauugagaaaaccaagacugauuucggcuuuuaccaggugaaaacagaaaccaccauccuggacgucgauuugcgcccagcuuccgcguggacacuguaugccguggcaacuacgauacucaccccuaugcugcggcacacaaucgagaacacuagcgcuaaucuuucacucgccgccauugcaaaccaggcugccguucugaugggguugggaaagggcuggccccugcacagaauggacuuaggugugccacuacuggcgaugggguguuacagucagguaaauccuaccacacucaccgcuagccuugugaugcuguugguccauuaugccaucauuggacccggccugcaagcaaaagccacucgugaagcucagaagaggacggcagccgguaucaugaagaacccgacaguugauggcauaaccgugauugaccucgagccaaucuccuacgauccuaaauucgagaagcagcuggggcaagucaugcuuuuagugcugugcgcgggacagcucuugcugaugcggacuaccugggcuuucugugaaguacuaacacuggccacuggccccauccucacccuuugggaggggaacccaggacgcuuuuggaauacaacgauugcagugucuaccgccaacaucuuccgaggcagcuaucuggcuggugccggguuggcauuuucccugaucaagaaugcucagacucccagaaggggaacaggcaccacuggugaaacacucggcgagaaguggaaacggcagcugaacucauuagaccgcaaggaguucgaagaguacaagagaucugggauucuugaaguugauaggaccgaggccaaaagugcgcugaaggacggaucgaaaaucaagcacgccgugagccgaggcuccucuaaaauucgguggaucgucgaacgugggauggugaagccuaagggaaaagucauagaccucggcugcgguagagggggauggucauacuauauggcaacgcuaaagaaugugaccgagguuaaaggcuacacaaagggcgggccgggacaugaagaacccaucccaauggcuacuuaugguuggaaccugguaaaauugcacagcggcguggaugucuuuuacaagccuaccgagcaaguggacacacugcucugugauauuggggaauccaguucuaaucccacuaucgaggaaggacgcacccuuaggguucugaagaugguggagccuugguugagcucaaaaccagaguucugcauuaagguccugaaccccuauaugccuacagugaucgaggagcucgaaaaauuacagcggaagcauggcgguaaucugguaagauguccacuuucccgcaacaguacccacgagauguacugggugagcggggccucuggaaauauuguuuccucagucaacacuacgagcaaaaugcugcuaaauagguuuacaacccgacaccggaagcccacuuaugaaaaagacguggaucucggcgcaggcaccagaucggugucuacagagacggagaagccggacaugaccaucauagggaggcgccugcagcguuugcaggaagaacauaaggaaacuuggcacuacgaucaagagaacccuuaccggacaugggcuuaucauggaaguuacgaagccccauccaccgguagcgccucauccauggucaauggcguugugaaacugcucacuaagcccugggacguaauuccuauggugacacagcuugcgaugaccgauacaacuccauucgggcagcagagagucuuuaaagagaagguggacaccaggacgccccaaccgaaaccuggaacccgcaugguuaugacaacuaccgcuaacuggcugugggcauuacugggcaagaagaaaaauccccgauugugcacacgggaggaguucaucucuaaggugagaagcaacgccgcuaucggugccgucuuucaggaggaacagggguggacaagugcauccgaggccgugaacgauagcagguucugggaacucguagacaaagagcgcgcucugcaccaagagggaaagugugaaucuugcguuuauaauaugaugggcaaaagagagaagaagcuaggcgaauuugggcgggcgaaaggaucaagggccauuugguacauguggcuuggugcacguuuccuggaguucgaagcucucggcuuucugaacgaggaccacugguucgggcgagagaauaguugguccggaguggaaggcgaggguuugcaucgccugggguauauacucgaagagaucgauaagaaagacggagaucuuauguacgccgacgauaccgcaggcugggacacgagaauuacagaggaugaccugcagaacgaagaguuaaucaccgaacagauggccccacaccauaagauucuggcuaaagccaucuuuaaguugacuuaucagaauaaggucgugaaagugcuccggccuacacccaggggcgcggucauggauauaaucagccgcaaggaccaaagagggucuggacagguugguaccuacggccugaacacuuucaccaauauggaggugcagcuaauucggcagauggaagcagaggggguaaucacacaagaugacaugcagaacccaaaaggacuuaaggagaggguggaaaaauggcugcgagagugcggcgucgaucgucucaagagaauggccauuucgggugacgacugugugguuaaaccccuggaugaacgcuuugggacgucauuguuauuccugaaugacaugggaaaggugcggaaggauaucccucagugggagccaagcaaaggcuggaagaacuggcaggaagucccguuuugcucccaccauuuccacaaaauauuuaugaaggacggcaggagucucgugguacccuguagaaaucaagaugagcuuauugggcgcgcucggaucucucagggagccgguuggagccugagggagaccgcaugccuaggcaaggcuuacgcccagauguggucccugauguauuuccaccgaagagaccuccgguuggcuucaauggccaucuguagugcaguuccuacugaaugguuuccaacaucuaggaccacuuggagcauucaugcgcaccaucaguggaugacaaccgaggauaugcugaagguguggaaccgcgucuggauagaagacaaucccaacaugaucgauaagacgccugugcacuccugggaggacauuccauaccuugggaaacgugaagaucuguggugcggaucacucaucggcuuaagcucuagagccacaugggcuaagaauauucacaccgccaucacucaaguucgaaaccugauagguaaagaggaguauguggacuacaugcccgucaugaagagguauuccgcaccuagugaaagcgaggggguguuguga

SEQ ID NO: 15796 - RNA, 9867 nt, Artificial Sequence
  derived and/or modified CDS sequence (opt3) from DENV-4__JQ513339__SS-prME
agcaccaucacucugcucugccuuauucccacugugauggcauuccaccuguccacgagagacggcgagccuuugaugauagucgcuaagcaugaaagggggcggccauuacuguuuaaaaccaccgagggaaucaacaaguguacucugauugcaauggaucucggugaaaugugcgaggacaccguuacguacaaauguccgcugcuugugaauaccgaacccgaggauaucgacugcugguguaaccugacuucuacaugggugauguauggaaccugcacgcagucaggggagcgccgacgugaaaagcggaguguggccuugacuccucacagcggaaugggccucgagaccagggcggaaacauggauguccucugagggugcuuggaaacaugcccagcgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacugacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggccacauucaaggugccccaugcgaaaaggcaggaugucacccuccugggaucucaggaaggugccaugcacuccgcacuugcuggcgccacugagguggacucaggggaugaaaaccacauguuugcuggacaucugaaguguaagguucggaugggcaaauugcgaaucaaggguaugagcuauacaaugugcagugggaaauucucuaucgacaaggagauggccgagacgcaacacggcaccacugugguaaaagucaaguacgaaggagcaggcgccccuuguaaggugccaauugagauacgcgauguuaauaaagaaaagguggucgggagagugcucuccgcuacaccccuggcggagaacaccaacagcguaacaaauaucgaguuagaaccgccuuucggagacucguauauugugaucgguguuggcaacucugcacugacucuacauugguuuaccaaaggguccucaauaggaaagauguucgagaguacguacaggggcgccaaacggauggcuauucucggugaaaccgccugggauuuugggagcgucggcggacuguucacaucccuuggcaaggcagugcaccagguguuugggucugucuauacuaccauguucggaggcguuagcuggaugauccgcaucuugauugguuuucuggugcucuggaucgggacaaauucaagaaacacaaguauggccaugaccugcauugcugugggaggcauaacgcuguuccuugguuuuacaguacaggccgacaugggcugugucguguccuggagcgggagggagcugaagugcggaucuggcaucuucguuguggauaauguccauaccuggacugaacaauacaaauuucagcccgagucaccagcacguuuggcgagugcuauucucaacgcccacaaggacgggguguguggaauccggagcacaacccgacuggagaauguuauguggaaacagaucacuaacgaauuaaauuaugugcugugggagggcggucacgaccuaaccguagucgcaggggaugugaagggagugcucacaaaaggcaagagagcccugacgccucccgcuuccgaccuuaaguacucuuggaaaaccugggguaaggccaaaauuuucacuccagaagcaaggaacucgacauuuuugauagauggccccgacaccagcgagugcccuaaugaacgccgggcuuggaacuccuucgaggucgaggauuacggguucggaauguuuacaacuaauaucuggaugaaguucagagaaggcucaagugagguuugugaccauaggcugaugucugccgcgauuaaagaucagaaggccgugcacgcugacaugggguauuggaucgaaagcuccaaaaaccaaaccuggcagauugagcgcgcaucacucaucgaaguaaagacgugccuguggccaaagacacauaccuuauggagcaauggagugcuggagucucagaugcuuauaccgaaauccuacgccggccccuuuagucagcacaacuaucgacaagguuacgcuacucagaccgucgggccuuggcacuugggaaagcucgagaucgauuucggcgaaugcccagguacaacugugaccauucaggagaacugugaccaucggggccccagccugcguacaacgaccgccucugggaaguuaguuacucaguggugcuguagauccugcacaaugccuccacugagguuucucggagaagauggcuguugguaugggauggagauccgcccccugucagagaaggaagagaauauggugaaaagucaagucaccgcaggacagggcacuagcgaaacauucucgaugggucuuuugugccugaccuuauuuguggaggaaugucuccggagaaggguuacgcgaaagcacaugauucuggcgguggucaucacucuuugcgccauaauucuagggggcuugaccuggauggaccuccugcgcgcucuaaucaugcugggcgauacaauguccggccggauugggggacagacccaucucgccaucauggcaguauucaagaugucuccggguuacgugcugggcguuuuucuuagaaaauugacuagcagggagacagcucugauggugauagggauggccaugaccacaacuuuaucaaucccucacgaccucauggagcugauugacggaaucagucuuggccugauucuacucaagaucgucacccaguucgauaacacgcaaguggguacacuggcauugucccugaccuuuauacguucuacuaugagcuuaguaauggccuggcgcaccauuauggcuguacucuucgucguuacacugaucccacuuugucggacuuccugccugcagaaacagucacauuggguggaaaucaccgcguugauucucggggcccaagcacugcccguguaucuaaugacgcugaugaagggagcuagcagaaggaguuggccucuuaaugagggcaucauggccgucggccucgugucucuguugggguccgcccugcucaaaaacgacguuccccuagcuggaccaaugguagccgguggccugcuucuggccgcguacgugaugagcgggucgucagcugauuugucucucgaaaaggccgcaaauguccagugggacgagauggccgauauuacaggaaguuccccuauaaucgaagugaagcaggacgaggauggcagcuuuucuauucgagacguugaggaaaccaacaugaucacucugcuagugaaacuggcucuuauuacagucagcggucucuacccccuggcaaucccaauaaccaugacuuugugguauauguggcaagugaagacacaacgguccggggccuuaugggauguaccgagcccugcggcuacccagaaagccgcacugagugagggagucuaccgcaucaugcagagaggccucuucggcaagacacagguggggguuggcauucacauggaagguguguuccacacuauguggcaugucaccaggggcagcgugaucugucacgagacagggcggcuggaacccucuugggccgacguucgaaaugauaugauuuccuauggaggcgguuggagacuuggggacaaaugggauaaggaggaggacgugcaaguccuggcuaucgaaccaggaaagaaccccaaacaugugcagaccaagccuggcuuguuuaaaacacuaacuggcgagauaggggccguaacccuggacuucaagccaggaacgucagguagucccauuaucaaucgcaaaggcaaggugaucgggcucuacggaaacggcguugucacaaaaagcggugauuauguguccgcaauuacucaggcugaaaggauaggggagccugacuacgagguggaugaagacaucuuucguaagaagcggcugaccauuauggaucuucacccgggagccggcaaaacaaagagaaucuuaccaucuauugucagggaggcgcugaaacgccgacucagaaccuugauccuggcccccacucggguaguggcagcugaaauggaggaagcccucaggggccugccuauacgcuaucagaccccagcuguuaagucggagcauacagggcgugagaucguggaccuuaugugccacgcaacguucacuaccagacuguugagcucaacacggguccccaauuacaaccuaauugugauggaugaagcccacuuuaccgacccuuccaguguugccgcuaggggauacaucucuacucgcguggagaugggugaagcggcagccauuuucaugacagcuaccccgcccggcgccacggauccauuuccucaaagcaauucccccaucgaggacauagaacgagagauuccagagagaucauggaacacuggguucgauuggaucacagacuaucagggaaaaaccgucugguuugugccuucuaucaaggcaggcaaugacauugccaacugccugcggaaaucagguaaaaagguaauccagcucaguaggaaaaccuucgauacugaauaccccaagacaaaauuaaccgacugggauuuugugguuacaacugacauauccgagaugggggcuaacuuccgcgcgggcagagucauugauccaaggcggugucugaagccggugauccuuacggacggaccugaacgugugauucuggccggccccaucccagucacccccgcaagcgcugcccaacgccgagggagaauaggaaggaauccugcacaggaggaugaccaguauguuuucucuggugauccacucaagaacgacgaagaucaugcccacuggacagaggcuaaaauguugcuggacaauauuuacacucccgagggcaucaucccuacccucuuugggccggaacgggagaagacacaggccauugauggagaguuccgccugagaggcgagcaaaggaaaaccuuuguggagcuuaugcggcgaggugaccuaccaguauggcugucauauaagguggcguccgcagggaucaguuacaaagacagagaauggugcuucacuggcgagcgcaacaaucagauuuuggaagagaacauggaagucgagauauggacgagggagggagaaaagaagaaauuacggcccaaguggcuggaugcccguguguaugcugacccuauggcccucaaagauuuuaaggaguucgcuagcggcagaaaaucgaucacccuggacauucuuacagaaaucgcaucucugcccacuuaccucuccagcagggccaaguuggcucuggauaauaucguuaugcuacauaccacagagcgcgggggacgggccuaccagcacgcacugaacgaacucccagagucacuugagacccugauguuaguggcguugcugggugccaugacugcuggcauuuuucucuucuuuaugcaggggaagggaauaggcaaacugaguaugggucuuaucacaauugccgucgcaucugggcugcucuggguagcugaaauccaaccucaguggauugccgcauccaucauauuggaguucuuucugaugguguuacuaauccccgaaccagagaagcagcgaacgccucaggacaaucaacugauuuauguuauccucaccauucuuacuaucauaggccugauugccgcuaacgaaaugggauugaucgagaaaacaaagaccgauuucggcuuuuaccaggugaaaaccgagacaacuauucuggacgucgaucucagaccggcgagcgccuggacgcuguaugcaguggcuaccacaauccuuacucccaugcucaggcacaccauagaaaauacaucagccaaccugaguuuggccgcaaucgcuaaucaggccgcgguccugaugggguuaggaaagggcuggccacuacaucgcauggaccugggugugccucuccuugcuaugggguguuacagccagguuaaccccaccacucugacggccuccuuggugaugcugcucguacacuaugcaauuaucggaccaggccugcaagccaaagcuacacgggaggcacagaagagaaccgccgcggguauuaugaagaauccuacuguggauggcaucaccgucauagaccuugaacccauuucuuacgauccgaaauucgagaagcaguuagggcaaguuaugcugcucguguugugcgcuggacagcugcuacugaugcguacaacuugggccuucugugagguccucacccuugcaacaggcccaauccugacguugugggaagggaacccuggaagguuuuggaacaccacuaucgccgugagcacagcuaauauuuuccggggcuccuaucuggccggugcagggcucgcuuuuucacugaucaaaaacgcccagacaccccgccgaggaacuggcacaaccggugagacguuaggcgaaaaguggaaaagacagcuuaauucucuggacaggaaggaguucgaagaguacaagcggagugggauacucgagguagaccgcaccgaagcgaaaucggcccuaaaggauggaagcaaaauuaagcaugcaguguccagaggaucuucaaaaaucagguggauuguugagcgagggauggugaagccaaagggaaaagucaucgaccugggcugcgguagagggggauggagcuacuauauggcuacauugaagaacgugacugaagucaaaggcuacaccaagggcgggcccggacacgaggaaccuauaccgauggccacauaugguuggaaucuggugaaacuccauuccggcguugauguauuuuacaagcccacugagcaaguggacacccuucugugugauaucggggagaguucuagcaacccaacaauugaagagggacguaccuugagaguccugaagaugguggaaccuuggcucucauccaaacccgaguucugcaucaagguuuuaaauccuuauaugccaacugugauugaagaacuggagaaacuucagcgcaagcacggcgguaaccuggucagguguccccuaagucggaauagcacgcacgaaauguacugggugucuggggcauccggaaacaucguaucaagcgugaauacaaccucgaaaaugcuccugaacagauuuacuacccgccauaggaagccuacauaugagaaagacguugauuugggcgcuggcacgcgaucugucaguaccgaaacugagaagccagacaugacaauuaucgggcggagacugcagaggcuccaggaggaacacaaggagaccuggcauuacgaucaagaaaaucccuaccgcacuugggccuaucacggauccuacgaggccccgagcacagguucagcguccucuauggugaacggcguggucaaacuucugaccaagccuugggacguuauaccaauggugacacaguuagcuaugacugauaccacgcccuucgggcagcagcguguauuuaaagaaaagguggacacccggacaccucaaccaaaacccggaacuagaauggucaugaccacaacugcaaauuggcugugggccuugcucggcaagaagaaaaacccgaggcugugcacccgcgaggaguucauuagcaaggugcgaaguaaugcugccaucggugcaguuuuucaggaagaacagggguggacguccgccagcgaagcugugaacgacucucgguucugggagcuagucgauaaagaaagagcgcuucaccaagagggaaagugugagucaugcguguauaacaugaugggcaaaagggaaaagaagcugggcgaguuugggcgcgccaaaggaaguagagcaaucugguacauguggcucggugcucgguuccuggaguucgaggccuugggcuuucugaaugaagaccauugguucgggagggagaacuccuggagcggaguagagggcgaaggucuccaccgucuuggguauauucuggaggaaauagauaagaaagacggagauuuaauguacgcagacgauacagccggcugggacacccgaaucacugaggaugaccugcagaaugaggaauugauuacagagcagauggcuccucaucacaagauccucgccaaagcgauuuuuaagcugaccuaucagaacaagguugugaaaguccuacgccccacuccaagaggcgcagugauggauaucauaucucggaaggaccaaagggggucgggacagguggguaccuacggccuuaauacauucacgaacauggaaguccagcugauccgccagauggaggccgaagggguuauuacccaagaugacaugcagaauccuaaaggacucaaggagagaguggagaaauggcugcgggaaugcggcguagacagguugaagcgaauggcuaucucaggugaugacuguguggucaaacccuuagaugagcguuuugggacuagccuacucuuccuuaacgacaugggaaaggugagaaaggauauuccacagugggaacccuccaaaggcuggaagaauuggcaggagguuccuuuuugcagucaucacuuccacaaaaucuuuaugaaggacggccgcucucugguggucccaugucggaaccaagaugaacuaauagggagggccagaauuagccagggagcagguuggucccugcgcgagacagcuugccucggcaaagccuacgcucagauguggucauugauguauuuccaucggagggaccugcgacuugccaguauggcaaucuguucugcggugccgaccgagugguuucccacuagcagaacaaccugguccauccacgcccaucaccaguggaugacgacagaagauaugcugaagguauggaaucggguuuggauugaggacaacccuaauaugauagauaagaccccagugcacucaugggaagacauccccuaccucgggaaaagggaggacuuauggugcggaagccugauuggcuugucuucccgcgcuacuugggccaagaacauccauaccgcaauuacacaaguccguaaucugaucgguaaagaagaguauguggauuacaugccuguuaugaagagauauagugcuccaagcgagucggaaggggugcucuga

SEQ ID NO: 15797 - RNA, 9867 nt, Artificial Sequence
  derived and/or modified CDS sequence (opt3) from DENV-4__JQ513343__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggaaacauucaaggugccccaugccaaaaggcaggaugucacccuccugggaucucaggagggugcgaugcacuccgcccuugcaggcgcuacugaaguggacucaggggaugagaaccacauguuugccggacaucugaaguguaagguucggauggagaaauugcgaaucaagggcaugagcuauacaaugugcagugguaaauucucuaucgacaaggaaauggcugagacgcaacacgggaccacugugguaaaagucaaguacgaaggcgccggagcaccuuguaaggugccaauugagauacgcgauguuaauaaagagaagguggucggcagagugaucuccgccacaccccucgcugaaaacaccaacagcguaacaaauauugagcuggaaccgccuuucggggacucguauaucgugauaggaguugguaacucugcguuaacucugcauugguuuaggaaaggcuccucaauugggaagauguucgagaguaccuaccggggagcaaaacgcauggccauccuaggcgaaacggcuugggauuuugguagcgucgggggccucuucaccucccugggaaaggccgugcaccagguguuuggcucugucuauacaacuauguucgggggaguuagcuggaugaucagaauucuuaucggcuuuuuggugcuguggauugguaccaauucaaggaacacaaguauggcaaugacuugcauagccguggggggaaucacccucuuccugggcuuuacgguacaggcugacauggguugugucguguccuggagcggccgugagcuuaagugcgggucuggaauuuucguuguggauaauguccauacauggaccgagcaauacaaauuucagcccgaaucaccagcccggcuggcaagugcgaucuugaacgcucacaaggacggcgugugugggauccgaagcacuacaagacucgagaauguuauguggaaacagauuaccaacgaacugaauuauguguuaugggagggaggccacgaccugacuguagucgccggugaugugaagggggugcuaaccaaaggaaagagggcacucacaccucccgccuccgaccugaaguacucuuggaaaacguggggcaaggcuaaaauauucaccccagaagcccgcaacucgacuuuucuuaucgauggucccgacacaagcgagugcccuaaugagcggagagcauggaacuccuucgaagucgaggauuacggcuucgggauguuuaccacaaauauuuggaugaaguucagggaaggaucaagugagguuugugaccaucgcuugaugucugcugccaucaaagaucagaaggcggugcacgccgacaugggcuauuggauugaaagcuccaaaaaccaaacuuggcagaucgagcgagcuucacugauagagguaaagaccugccucuggccaaagacgcauacacuguggagcaaugggguguuagaaucucagaugcugaucccgaaauccuacgcaggacccuuuagucagcacaacuaucggcaaggcuacgccacccagacugucgguccuuggcaccuugggaaguuggagauugauuucggagaaugcccaggcaccacagugacuauccaggagaacugugaccaucguggucccagccucagaaccacaacggcuucuggcaaacugguuacccaguggugcuguagguccugcacuaugccuccacuacgcuuucugggggaggauggauguugguauggcauggaaauucggccccucucagagaaggaagagaauauggugaaaagucaagucacagccgggcagggaaccagcgaaacuuucucgaugggccugcuuugcuugacacuguuuguggaggaguguuuaagaaggcgaguuacccgcaagcacaugauccucgcaguggucauaacgcugugcgcgauuauccuuggugggcugacuuggauggacuugcuccgggcccugauuaugcuaggagauaccauguccggcagaaucggcgggcagacacaucuggcuauaauggccguauucaagaugucuccgggauacgugcucgguguuuuucugaggaaacuuaccagccgugaaacugcauugauggugaucggcauggcuaugacaaccacacugucaauuccucacgacuuaauggagcucaucgacgggauuagucugggacuuauccugcuaaagauagucacucaguucgauaacacccaagugggcacgcucgcccuguccuugacauuuauucgcucuaccaugagccugguaauggcauggcggacuaucauggccguguuauucgucguuacccucaucccacuguguagaacauccugccuucagaaacagucacauuggguggaaauuacugcucugaucuugggugcgcaagcccuccccguguaucugaugacccuaaugaagggggcaagcaggcgaaguuggccucugaaugagggaauuauggcugucggccuugugucucuccugggcuccgccuugcugaaaaacgacguucccuuagccgggccaaugguagcuggaggucuccugcuugcagccuacgugaugagcggcucgucagcggaucugucuuuggaaaaggcugccaauguccagugggacgagauggcagauauaacggggaguuccccuaucauugaggugaagcaggacgaagauggaagcuuuucuauccgggacguugaggaaacaaacaugauuacccuccuggugaaacuagcccugaucacugucagcggccuuuacccccucgcuauaccaaucacaaugacccugugguauauguggcaggugaagacucaacgcuccggugcauugugggauguaccgucaccugccgcgacacagaaagcugccuuaagugagggggucuacagaauuaugcagaggggacuguucggcaagacccaggugggcguugggauccacauggaaggaguguuccacacgauguggcaugucacucgggguagcgugauuugucacgagaccggccgacucgagcccucuugggcagacguuagaaaugauaugaucuccuaugggggaggcuggcgccugggugacaaaugggauaaggaagaggacgugcaaguccuugccauagaaccagggaagaaccccaaacaugugcagacaaagccuggacuguuuaaaaccuugacaggcgagauuggcgcuguaacucuagacuucaagccagggaccucaggaagucccaucaucaauaggaaagguaaggugauuggccuguacgggaacggaguugucacgaaaagcggcgauuauguguccgccauaacacaggcagagcguaucggugaaccugacuacgagguggaugaagacauuuuucggaagaagagacucacuaucauggaucugcacccgggggcuggaaaaaccaagaggauucuuccaucuaucguccgcgaggccuuaaaacgaagacugcggacacucauauuggcgcccaccaggguaguggccgcagaaauggaggaggcucugcgcggccucccuauccguuaucagacuccagccguuaagucggaacauaccggcagagagauuguggaccugaugugccacgcuacauucacgacucggcuucugagcucaaccaggguccccaauuacaacuugaucgugauggaugaagcacacuuuacagacccuuccaguguugccgcccgcggguacauuucuacccgaguggagaugggagaagcugcggcaaucuucaugacugccacaccgcccggugcuaccgauccauuuccucaaagcaauucccccauagaggacauugagagagaaaucccagagcggucauggaacacgggcuucgauuggaucacugacuaucaggggaaaacagucugguuugugccuucuauuaaggccggaaaugacaucgcaaacugccuaaggaagagcggcaaaaagguaauacagcugagucgcaaaaccuucgauaccgaauaccccaagacuaaacucacagacugggauuuugugguuaccacagacauuuccgagaugggugccaacuucagagcugggagggucaucgauccacggcguuguuuaaagccggugauucugacugacggcccugaacgcgugauccuugcgggacccauaccagucacgcccgccagcgcagcucaacgaagaggcaggauugggcggaauccugcccaggaggaugaccaguauguuuucucuggagauccacugaagaacgacgaggaucaugcacacuggaccgaagccaaaaugcucuuggacaauaucuacacacccgaggguaucauuccuacucuguuuggcccggaacgcgagaagacccaggcuaucgauggggaguucagacucaggggagaacaacggaaaacauuuguggagcugaugcgaagaggcgaccuuccaguauggcuaucauauaagguggccuccgcggguauuaguuacaaagaccgcgaauggugcuucaccggggagaggaacaaucagauacuggaagagaacauggaggucgaaaucuggacucgggagggcgaaaagaagaaauugcgucccaagugguuagaugcaagaguguaugccgacccuauggcucugaaagauuuuaaggaguucgccagcggaaggaaaucgauuacgcucgacauccugaccgaaaucgcuucucuucccacauaccuguccagccgcgcaaagcucgccuuggauaauauuguuaugcugcauacuaccgagcggggcgggcgagcuuaccagcacgcccuaaacgagcugccagaaucacucgagacacuuaugcugguggcauuauugggagcgaugaccgccgguauauuucuguucuuuaugcagggcaaggggaucggaaaacucaguaugggccugauuacuaucgcugucgccucuggucuucuguggguagcagaaauucaaccucaguggaucgcugccuccauaauccucgaguucuuuuugauggugcuguuaauucccgaaccagagaagcagagaacaccucaggacaaucaacuaaucuauguuauucugacgauccucaccauaauugggcuuaucgcagccaacgagaugggccugauugaaaaaacuaagacagauuucggauuuuaccaggugaaaaccgagaccacaaucuuggacgucgaucugaggccggcuagcgcguggacucucuaugccguggcaacgaccauacugacacccaugcuucgccacacuaucgaaaauaccucagcuaaccucagucuggccgccauugcaaaucaggcugccgucuugaugggccuggggaagggauggccauuacaucggauggaccuaggcgugccucugcucgcgauggguuguuacagccagguuaaccccacaacccuuacugcuucccuggugauguugcugguacacuaugccaucauugggccaggacuccaagcaaaagccacgagagaggcucagaagcguacagcagccggcaucaugaagaauccuaccguggaugguauaacugucauugaccuggagcccaucucuuacgauccgaaauucgaaaagcagcuuggccaaguuauguuacuggugcucugcgcggggcaguugcugcuaaugaggaccacaugggcuuucugugagguccugacucucgccaccggaccaauccuuacacugugggaaggcaacccugggcgguuuuggaacacgaccauugcagugagcacugccaauaucuuccgcggauccuauuuggcuggcgccggucuggcauuuucacucauaaaaaacgcucagacaccccgaagagggaccggaacuacaggcgagacccugggugaaaaguggaaaaggcaguuaaauucucuugaccggaaggaguucgaggaauacaagcgcaguggcauucuggagguagacagaacggaagccaaaucggcgcucaaggaugggagcaaaaucaagcaugccguguccaggggaucuucaaaaauucgauggaucguugagcggggcauggugaagccaaaggggaaagucauagaccuaggaugcggccgugguggguggagcuacuauauggcaacccugaagaacgugacagaagucaaaggauacacuaagggcggccccgggcacgaggagccuaucccgauggcuaccuauggauggaauuuggugaaacugcauuccgguguugauguauuuuacaagcccacagaacaaguggacacucuccuuugugauauuggcgagaguucuagcaacccaaccaucgaagaggggagaacacugcgcgucuugaagaugguggaaccuuggcugucauccaaacccgaguucugcauuaagguucucaauccuuauaugccaaccgugaucgaggaauuagagaaacugcagaggaagcacggaggcaaccuuguccgguguccccugaguagaaauagcacucacgaaauguacugggugucuggugccuccgggaacauuguaucaagcgugaauacgacaucgaaaaugcuacucaaccgcuuuaccacuaggcaucgaaagccuaccuaugagaaagacguugaucugggagcaggcacacggucugucaguacggagaccgaaaagccagacaugacuaucauaggcagaagguugcagcgccugcaggaggaacacaaggagacauggcauuacgaucaagaaaaucccuaccguaccugggcuuaucacggguccuacgaggccccgagcacuggaucagccuccucuauggugaacgguguggucaaacuccuuacaaagccuugggacguuauuccaauggugacccagcuggcgaugacagauacuacccccuucggccagcagcggguauuuaaagagaagguggacacgagaaccccucaaccaaaacccgggacaaggauggucaugacuaccacagcuaauugguuaugggcacuguugggaaagaagaaaaacccgcgccucugcacucgagaagaguucaucagcaaggugcggaguaaugccgcuaucggcgccguuuuucaggaagagcaggguuggaccuccgcaagcgaagccgugaacgacucuagauucugggagcuggucgauaaagagagggcucuacaccaagaagggaagugugagucaugcguguauaacaugaugggaaaacgcgaaaagaagcuuggcgaguuuggcagagcgaaagggagucgggccauuugguacauguggcugggagcaagguuccucgaauucgaggcucuggguuuuuugaaugaggaccauugguucggccgugaaaacuccuggagcgggguagagggagaaggccugcaccgacucgguuauauacuugaggagaucgauaagaaagacggggaucugauguacgccgacgauacggcaggaugggacacacgcauuaccgaagaugacuuacagaaugaggaacugaucacugagcagauggccccucaucacaagauuuuggcuaaagccaucuuuaagcucacauaucagaacaagguugugaaaguccugagacccaccccacggggcgcggugauggauauaaucucuaggaaggaccaacgcggcucggggcaggugggaacuuacggucuaaauaccuucacaaacauggaaguccagcuuauuagacagauggaggcagagggcguuaucacgcaagaugacaugcagaauccuaaagggcugaaggaacggguggagaaauggcucagggaaugcggaguagaccgacugaagcguauggccauuucaggcgaugacuguguggucaaacccuuggaugagagauuugguaccagcuuacuguuccucaacgacauggggaaggugcgcaaggauaucccacagugggaacccuccaaaggauggaagaauuggcaggagguuccuuuuugcagucaucacuuccacaaaauauuuaugaaggacggccggucucuuguggucccauguaggaaccaagaugagcugauuggcagagcucgcaucagccagggggccggauggucccuacgggaaacugcaugccuggguaaagcuuacgcccagauguggucacucauguauuuccauaggcgagacuugagacuggcuaguauggccaucuguucugcagugccgacagagugguuucccaccagccggacuacaugguccauucacgcgcaucaccaguggaugaccacggaagauaugcuuaagguauggaauaggguuuggauagaggacaacccuaauaugaucgauaagacaccagugcacucaugggaagacauucccuaccugggcaaacgcgaggaccucuggugcgggagcuuaaucggacugucuucccgugccaccugggcuaagaacauucauacugccaucacccaagucagaaauuugauaggcaaagaggaauauguggauuacaugccuguuaugaagcgauauagugcaccaagcgagucggaaggugugcuguga

SEQ ID NO: 15798 - RNA, 9867 nt, Artificial Sequence
  derived and/or modified CDS sequence (opt3) from DENV-4__KT276273__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggcgcccuacgcuggauuuugaacuaacuaagacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaauuuucuuguagcggaaagaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguugaacugccggauuacggagaguuaacgcuggacugcgagcccagaagcggcaucgacuucaacgaaaugauucucaugaaaaugaauaagaagacauggcuugugcauaaacagugguuucuggauuugccucuaccauggaccgcuggggccgacacuucugagguccacuggaacaauaaggaaaggauggugaccuucaaagucccccaugcgaagcggcaggaugugacaguucugggaucccaggagggugccaugcacucagcacucgcuggcgccaccgaaguggacagcggggauggaaaccacauguuugcuggccaucugaaauguaagguacgaauggagaaacuucgcaucaaggguaugaguuacacuaugugcucugggaaguucuccaucgacaaagagauggccgaaacacaacacggcacgaccgucgugaagguuaaauaugagggagcaggcgccccuuguaaggugccaauugaaauaagagaugucaacaaagagaaggugaucgggaggguaauuagcucgaucccccuggcugagaauacuaacucugugacaaauauagaauuggagccgccuuucggagacuccuacauuguuaucggugucggcaacucagcgcucacccugcauugguuucggaaggggaguagcaucggaaaaauguucgaauccacauaucgcggcgcaaagagaauggccauuuuaggugagacugcuugggauuuugggucugugggcggacuguucaccagccuaggcaaagccgugcaccaggucuuugggucaguuuacacgaccauguucggaggcgugaguuggaugaucaggauucucauagguuuucuggugcuuuggaucgggacaaauucccguaacacuagcauggcaaugaccugcauugccguaggaggcaucacauuguuccuggguuuuacuguccaggcugacaugggcugugugguuucuuggucagggcgggaacucaagugcggaaguggcaucuucgugauugauaauguccauaccuggacggagcaauauaaauuucagcccgagagcccagcccgacuggcauccgcgauacuuaacgcucacaaggacgggguguguggaaucagaucuacaaccaggcuggaaaauguuauguggaagcagauuacuaacgaguugaauuacgugcucugggaaggcggucacgaccugacaguagucgccggggaugugaaaggaguguuaaccaagggcaaacgcgcacugacuccucccgccucggaccuaaaguauagcuggaaaaccugggguaaggcuaagaucuucacaccagaggcccggaacuccacguuucucauugauggccccgacaccucagaaugcccuaaugagagaagggcauggaacagucuggaggucgaagauuacggguucggaauguucacuacaaauaucuggaugaaauuucgcgagggcucuagcgaaaugugugaccaucgacuuauguccgcugccauaaaggaucagaaagcgguucacgccgacaugggguacuggaucgagucaagcaagaaccaaaccuggcagauugaaaaagcuucuuugaucgaggugaagacaugccuguggccaaaaacucauacccucugguccaacggaguacuggagagucagauguuaauuccgaagagcuaugcaggccccuucucucagcacaauuaccggcaagguuaugccacgcagaucgcugggccuuggcaccugggaaagcuugaaauagauuuuggcgagugcccagguacaaccgugacuauucaggaagacugugaucaucguggccccuccuugagaaccacaacugccucagggaaacucgucacccaguggugcuguaggaguugcacaaugccuccacugcgcuuccuaggagaggacggcuguugguacgggauggagauccggccccugagcgaaaaggaggaaaacauggugaaaucgcaaguugcagcgggacagggcacguccgagaccuuuucuaugggucuccugugccuuacuuuguucguggaagagugucugagaaggcgagucacacgcaagcacaugauuuuagugguugugaucaccuuuugcgccauaauccucgggggacugacuuggauggaucuucugcgggcuuugauuaugcucggcgacacaaugagcggcagaaucgggggacagauucaucuggccaucauggcagucuucaaaaugucaccggguuauguacuaggcguguuucugaggaagcucaccagucgugagacggcucugaugguuauagggauggccaugacuaccgugcuuuccauuccuuacgacuugauggaacugaucgauggaaucucuuuaggccucauucugcuuaagaucgucacacaguucgacaauacccaaguggguacucuggcacuaagccucacauuuauucgcuccaccaugccacugguaauggccuggcggacaauaauggcuguguuguucgucguuacucugauccccuuauguagaaccucaugccuccagaaacagagccacuggguggagauuacggcgcugauccuuggggcccaagcacugccuguguauuugaugacacucaugaagggagcuaguaggcgaucuuggccccugaacgaaggcauuauggccgucggccuagugucccugcuugggagcgcccuccugaaaaaugauguuccauuggcuggaccuaugguagcagguggccuguuacucgccgcguacgugaugucggggucaucugcugaccugagucuugagaaggccgcaaacguccagugggaugaaauggccgacaucaccggauccagccccauaaucgaggugaaacaggaugaggacggcucuuuuagcauucgggauguugaagagacuaauaugaucacccuguuggugaagcucgcucugauuacagucuccggucuauacccacuggcaaucccggugacuaugacccuuugguauauguggcagguaaagacgcaacgcucaggggcccucugggacgucccuagucccgcggcuacacagaaagccgcacugagcgaaggaguguacagaauaaugcagaggggcuuguucggcaagacccagguuggggugggaauucauauggagggugucuuccacacuauguggcacgugacacggggcucuguuaucugucaugaaaccgggcgauuagagccauccugggccgaugugagaaacgacaugaucucauauggaggcgguuggcgccugggggauaaaugggacaaggaggaagacguccaagugcucgcuauugagcccggaaaaaauccuaagcacguacagacuaagccaggccuguuuaaaacacuuaccggcgaaauaggggccgugacgcuggauuucaagcccggaacuagugguagcccuaucauuaacaggaaaggcaagguuaucggguuguacggaaauggcgucgugaccaaauccggugacuaugugucugcaauuacacaggcugagcguaucggggagccggauuacgaagucgacgaggauauauuucggaagaaaagacuaaccaucauggaccugcauccaggagccggcaagacaaagaggauucuccccucgaucguacgcgaagcgcugaaacgaagacuucggacuuuaauucuggccccuaccagggugguugcagcugagauggaagaggcccuccgcggcuugccaauccguuaucagacgcccgcugugaagagcgagcacacagggagagaaauagucgaucugaugugccaugcaacuuucaccacacggcuccugucauccaccagggugccuaacuacaaucuuauuguuauggacgaggcccacuuuacugauccgaguucuguggccgcucgcggauacaucagcacccgagucgaaaugggugaggcggcagccaucuucaugacagcuacgcccccaggcgccacugacccuuuuccccaauccaacucaccaauugaagauaucgagagagagauaccugaacggucuuggaauaccggguucgacuggauuacagacuaucagggaaaaaccgugugguuuguacccagcaucaaggcaggcaacgauauugccaacugccugaggaaaagugguaagaaggugauccaguugucccgcaaaacuuucgacacagaguacccaaagaccaaacuaacggauugggacuuuguugucacuacagauauaagcgaaaugggggcuaauuucagagcgggcagggugauugacccgcggcguugucugaagccugugauccucaccgauggacccgagcgcgucaucuuagccggcccaauucccguuaccccugcaucugcugcccaacgaagagggaggaucggacggaacccagcacaggaagacgaucaguauguguucucaggugacccccugaaaaaugaugaggaccacgcccauuggacugaggcuaagaugcuucuggauaacauuuacacaccugaaggcauaaucccgacccucuuugggccagagcgcgaaaagacacaggccauugacggagaguucagauugaggggcgagcaacggaaaacuuuuguagaacugaugcgaagaggugaccuccccguguggcuguccuauaaggucgcgagugcagggaucagcuacaaagaucgcgaguggugcuucacgggcgaaaggaauaaccagauccuugaggaaaauauggagguggagauuuggacccgggaaggagagaagaaaaagcuacguccuagauggcuggacgccaggguuuaugcugaucccauggccuugaaggacuuuaaagaauucgcuucgggccgcaagucuauaacauuagauauccugacugagauugcaucccucccaaccuaccugagcucacgggccaaacuugcucuggacaacaucgugaugcuccacacaaccgaacgagggggaagagccuaccagcaugcauugaaugagcugccugagagucuagaaacucugaugcucgucgcgcuucugggugccaugacggcuggcauuuuuuuauucuuuaugcaggggaagggaaucggcaaauugucuaugggucugauaaccaucgccguagcauccgggcuccuguggguggcugagauucaaccccaguggaucgccgcaagcauuauccuugaauucuuucugaugguucucuugauaccagagccugaaaagcagaggacaccgcaggauaaccaacugauuuaugugaucuuaacuauucuaaccaucauaggccugaucgccgcuaaugagaugggacucauugagaagacaaaaaccgacuucggcuuuuaccaggucaagacugaaacaacgauccuugauguggaccugcgccccgcgucagccuggaccuuguaugcagucgcuacuacaauucugaccccaaugcuccggcacaccaucgagaacacaagugccaaucugagccuugccgcaauagcuaaccaggccgcggugcucauggggcugggaaaaggcuggccuuugcacagaauggaucuggguguucccuuacuagcuaugggguguuacucccaggugaauccaacuacgcugaccgccucucucguaaugcuucuggugcauuaugcaauuaucggaccuggcuugcaagccaaggcuacacgugaagcacagaaaaggacugccgcggguaucaugaagaaccccaccgucgacggcauuacaguuaucgaucuggagccgauaagcuacgacccaaaauucgagaagcagcucgggcaagugaugcugcuugucuuaugcgcuggacagcugcucuugaugcggaccacuugggccuucugugaagugcugacgcuagcaacaggcccuauucugacccucugggaggggaaccccggacgcuuuuggaauacuaccaucgccguauccacagcuaacauuuuccgaggcucauaucuugccggugcagggcuggcuuuuucuuugaucaagaaugcccagacuccaagaaggggaaccggcacaacgggugaaacccugggcgagaaauggaagcggcagcucaacagucuggaccgcaaagaauucgaggaguacaagagaucggggauauuagaaguggauaggacugaggcgaaaagcgcccuuaaggacggauccaagaucaaacacgcaguuucucgaggcucaagcaagauucgguggaucguggaacgugggauggucaaacccaagggaaaaguggucgaucugggcugcgguagagggggaugguccuacuauauggcuacacucaagaaugugaccgagguuaagggcuacacuaaaggcgggccuggacaugaagagccgauucccauggccacauaugguuggaaccuaguaaagcugcacaguggcguggacgucuuuuacaaaccaaccgagcaaguggauacguugcugugugacaucggggaaucuagcucaaauccuaccauugaggaaggacgcacacucaggguucuuaagaugguggagcccuggcuguccaguaaaccugaauucugcaucaaggucuugaacccauauaugcccacugugauagaggagcuggaaaagcuccagcggaaacauggcgguaauuuaguaagauguccucugagccgcaacucuacccacgagauguacuggguguccggggcaucaggaaauauuguuagcucggucaacacaacuucuaagaugcuucugaauagguuuaccacacgacaccggaaaccaaccuaugaaaaggauguggaccuaggcgcuggcacuagaaguguguccacggagacagagaaacccgauaugaccaucaucgggaggcgccuccagcgucugcaggaagagcauaaggaaacuuggcacuacgaccaagagaacccguaccggaccugggccuaucauggaagcuacgaagccccuucaacagguuccgcgucuagcauggucaauggcguugugaaauugcugacgaagccaugggauguaauucccauggugacccagcucgcuaugacugacacaaccccuuucgggcagcagagagucuuuaaggagaaaguggacacuaggacaccacaacccaagccgggaacccgcaugguuaugacaacuaccgcaaacuggcuuugggcccuguuaggcaaaaagaaaaauccucgacugugcacgaaggaggaauucauaaguaaggugcgggcuaacgccgcaaucggugccgucuuucaggaggaacagggguggaccuccgcuagcgaggcggugaacgauucuagauucugggaauugguagacaaagagagggcccuccaccaagagggaaagugugaaucaugcguuuauaauaugaugggcaaacgcgagaagaaacugggcgaauuugggagagcaaagggaagucgggcuauuugguacauguggcuaggugccagguuccuugaguucgaagcacugggcuuucucaacgaggaucacugguucgggcgugagaauuccuggagcggaguggaaggcgagggucugcaucgauugggguauauccuggaagagauugacaagaaagauggagaccucauguacgccgaugacacagcuggcugggauacucgcaucaccgaggacgaucuucagaacgaagagcugauaacagaacagauggccccccaccauaagaucuuagcgaaagcaauuuuuaagcugacuuaucagaauaaagucgugaagguguugagaccaaccccucggggcgccgucauggacaucauuucuaggaaggaucaacgcgggucgggacagguugguacguacggccucaacacauucaccaauauggaggugcagcugaucagacagauggaagcugaggggguaauaacucaagacgacaugcagaaccccaaaggacuaaaggagcggguggaaaaauggcuuagggagugcggcgucgaucgacugaagcguauggccauuucaggugacgauugugugguuaaaccacucgacgaaagauuugcaacaagccuguuguucuuaaaugauauggggaaggugcgcaaagacaucccccagugggagccuuccaagggauggaagaacuggcaggaagucccauuuugcagucaccauuuccacaaaaucuuuaugaaggauggccggucucuggugguaccguguaggaaucaagacgagcucauuggcagagcucgcauaagccagggggccggauggucccuuaaagagaccgcuugccuggccaaggcauacgcgcagauguggucacuaauguauuuccaccggagggaucugcgacucgccaguauggcuaucuguucugccguucccacugaaugguuuccuaccagcagaacaacgugguccauucaugcacaccaucaguggaugaccacugaggacauguugaaaguguggaaccgggucuggaucgaagauaauccaaacaugauugacaagacacccgugcacucaugggaggacaucccuuaccuggguaagagggaagaucuuuggugcggcagccugauagggcucucuucccgcgcuaccugggccaaaaauauccacacugcaauuacacaaguucguaacuuaaucggaaaggaggaguauauggacuacaugccagugaugagacgauauagugcccccagcgaaucggagggcguccuguga

SEQ ID NO: 15799 - RNA, 9867 nt, Artificial Sequence
  derived and/or modified CDS sequence (opt3) from DENV-4__KU523872__SS-prME
agcaccaugacgcugcucugccuuauccccacugugauggccuuccaccuguccacgagagacggcgagccuuugaugauugucgcuaagcaugaaagggggcggccauuacuguuuaagaccaccgagggaauaaacaaguguacucuaaucgcaauggaucucggugaaaugugcgaggacaccguuacauacaaguguccgcugcuugugaauaccgaacccgaggauauugacugcugguguaaccugacuucuacauggguaauguauggaaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauccugcgcaauccaggguucgcacugcucgccggauuuauggcucacaugauuggccagacuggcauccagagaaccguguucuuuguuuuaaugaugcugguggcacccucauacgggaugaggugugucggaguggguaaccgggauuucguagaaggcguuagcgggggagccuggguggaccuugucuuggagcauggcgguugcgugacaaccauggcucaggggaagccuacgcuggauuuugaacuuacuaagacaaccgccaaagagguggcgcuccugcgcacuuauuguauagaagcaaguaucuccaauauuacaaccgccacgcgaugcccaacccaaggagagcccuaccuuaaggaggaacaggaccagcaguauaucuguagaagggaugucguugaccggggcuggggcaacgggugcggacuguucgguaaaggcggggugguaacaugcgcuaaguuuucuuguagcggaaaaauuacuggcaauuuggugcaaaucgagaaccucgaauacaccgucgugguuacagugcacaauggugauacucacgccgucgggaacgacaccuccaaucauggcgugacagcaaccauaacuccucguucaccaaguguagagguuaagcugccggauuauggagaauuaacgcuggacugcgagccccgcagcggcauugacuucaacgagaugauccucaugaagaugaaaaagaaaacauggcuugugcacaagcagugguuucuggauuugccucuaccauggaccgcuggggccgacacuucugaaguccauuggaauuacaaagagagaauggugaccuucaaggucccccacgcgaaaaggcaggaugugacaguucugggaucccaggaaggugccaugcacucagcacucgcuggcgccaccgagguggacagcggggauggaaaccauauguuugcuggccaccugaaguguaagguacggauggaaaaacuucgaauuaaggguaugaguuacacuaugugcucugggaaauucuccaucgacaaggagauggccgagacacaacauggcacgaccgucgugaaaguuaaguaugaaggagcaggcgccccuuguaaggugccaaucgagauucgcgaugucaauaaagaaaaggugguagggagaauaaucagcucgacucccuucgcugagaacacaaacucugugaccaauauugagcuggaaccgccuuuuggagacuccuacaucguuauaggugucggcgauucagcguugacacuccacugguucaggaaagggaguagcauuggaaagauguuugaguccacuuaucggggcgcaaaacgcauggccauccugggugaaaccgcuugggacuucgggucugugggcggauuauuuacgagccugggcaaggccgugcaucaggucuucgggucaguuuacaccacaauguuuggaggcgugaguuggaugaucaggauucugaucgguuuccucgugcuguggauugggacuaacuccaggaauaccagcauggcaaugacaugcauagccguaggaggcaucacucuauuuuuggguuucaccguccaggcugauaugggcugugugguuucuuggaacgggaaggagcugaaaugcggaaauggcauuuuuguggucgacaacgugcacacguggacagaacaauauaaguuccagcccgagucaccagcccgucucgcaagugcgauccugaaugcucacaaagacgggguuuguggaauccggagcaccacucgacuugagaacgugauguggaagcagauuacaaaugaacugaacuacguauugugggagggcggucaugaucucaccgucguggccggggacgugaaaggaguccugacuaagggcaagagagcauuaaccccucccguuaaugaucugaaauauuccuggaagacaugggguaaagccaagauauuuacgccagaagcuaggaacucuaccuuccuaaucgacggccccgauacuucggagugcccuaaugaacgccgggccuggaacuucuuugagguggaggacuacggguucggaauguuuacaaccaauauuuggaugaaauucagagaaggcagcuccgagguaugugaucacaggcucaugucagcagcuaucaaggaccagaaagccgugcaugcggauaugggguacuggauugaaaguucuaagaaccaaacauggcagaucgagaaggccagccugauagaagucaaaacuugccuuuggccaaagacccacacguugugguccaacggagugcuggagucacagaugcucaucccgcgcagcuaugcuggccccuuuucucagcacaauuaccgacaagguuaugcaacacagaccgccgggccuuggcaucugggaaaauuagagauugacuucggcgaaugcccagguacuaccguuacaauccaggaggauugugaccaccggggccccucccugcguacuaccacagcuagugggaaacuugugacgcaguggugcuguagaagcugcaccaugccuccauugagguuucucggagaagauggcuguugguacgggauggagauucgcccccugucugagaaagaagagaacauggucaagucccaagugacugccggacagggcacaucagaaaccuucaguaugggucuacugugccucacucuguuuguugaggaaugucuucggagaagggugacacgaaagcauaugaucuuggucguagugauaaccuucugcgcaauuauccuagggggcuuaacguggguugaccuccugcgcgcgcuuauuaugcugggcgacacuaugagcggccggaucgggggacagauacacuuggccaucauggcuguguuuaaaaugucgccggguuauguccucggcguguuccugagaaagcuaaccuccagggagacagcccugaugguaauugggauggcaaugaccacuguguuuucuaucccucaugaucucauggagcugauugacggaaucagccuuggcuugauacuguuaaaaauugucacacacuucgauaauacccagguugguacacucgcucugucacuuacuuucauccguaguaccacgccacuggugauggccuggcgcacaaucauggcaguguuuuucgucgugacccuaauuccccucugucggacuuccugccugcaaaagcagucucacuggguugaaaucaccgccuugauucugggggcucaggcguuaccuguauaccucaugacacugaugaaaggagccagcagaagguccuggccccuuaacgagggcauaauggcagugggccuggucucauugcucgggagcgcucugcuaaagaaugacgugccacuggccggaccuaugguugccgguggccuucuccuggcugcauaugugaugagugggucuuccgccgauuugagccuggaaaaggcggcuaacguccaaugggacgagauggccgauaucacuggaucgucacccgugauugaaguaaaacaggacgaggauggcucuuuuaguauccgagacgucgaggaaaccaauaugauuacguuacucgugaagcuggcacuuaucacaguuuccggucuguacccauuggccauaccggugaccauggcuaucugguacauuuggcaggucaaaacucagcggagcggggcacucugggaugugccuucucccgccgcgacacaaaaggcuacccugagcgagggaguuuaucgcaucaugcagagaggccuauucggcaaaacucaggugggggucgggauucacauggaagguguguuucacacaauguggcauguaaccaggggcuccgugaucugucacgagacggggcggcuggaaccaucaugggccgacguucgaaacgauaugauaaguuacggaggcgguuggaaacuuggggacaagugggacaaagaggaggauguccaggugcucgcaauugaacccggaaagaauccuaaacaugugcaaacuaagccaggccuguucaaaaccuugacaggcgagaucggggccgucaccuuagacuuuaagcccggaacaagcgguucuccuaucauuaacaaaaagggcaagguaauagggcuguauggaaauggcgugguuacuaaauccggugauuacgugucagcuaucacccaggccgaaagaauuggggagccggacuaugaggucgaugaagacaucuuccgcaagaaaaggcucacgauuauggaucugcacccaggagcaggcaagacaaaacguauccuucccaguauagugcgggaggcucugaagagaagguugcgcacucuaauccuggccccuacccgaguuguggcggccgaaauggaggaagcacucagaggccugccaauucgguaccagacacccgcugucaagagcgagcacaccgggagggagaucguggaccuuaugugccaugccacuuuuaccacacgcuuacuguccucuacgcguguaccuaacuauaaucucauugugauggaugaagcucacuucacugacccgugcucgguugcagccagaggauacaucagcacccgggucgagaugggugaagccgcugcgauauuuaugacagcaacacccccaggcucaauugauccuuucccccaguccaacaguccaaucgaggacaucgaaagggagauuccugagcgcucuuggaauacuggguucgacuggaucacagauuaccaaggaaaaaccgugugguuugugcccagcauaaaggccggcaacgacauugcuaacuguuugcgaaaauccgguaagagagucauccagcugucacggaaaacguucgauacugaauauccaaagacaaagcucaccgacugggauuuuguugugaccacugacauuucugagaugggggccaauuucagggcaggccgcguaaucgauccgagaaggugccugaaaccugugauacuuacagacggacccgaacgggucauucuggccggcccaauccccgugaccccugcuagcgcggcccagcgucgcgggcgaaucggaagaaacccagcacaagaggaugaccaguacguuuuuaguggugaucccuugaggaaugacgaagaucaugcucacuggacagaggccaagaugcuacuggacaacauuuauacuccugagggcaucauuccgacacucuucgggccagaacgggagaaaacccaggcaauagacggagaauuucgcuuaagaggcgagcagaggaagacauucguggagcugaugcggcgaggugaucuucccgucuggcuguccuacaaaguagccagcgcugggaucucuuauaaggacagagaaugguguuuuacuggcgagcgcaauaaccaaauucucgaagagaauauggaaguggagaucuggaccagggagggagaaaagaaaaaguugcggccuaaauggcuggaugcccguguuuacgcggaccccauggcacucaaggauuucaaagaguuugccucaggcagaaaguccaucacacuggacauucuuaccgaaauagcuacucuaccaacguaucugaguagcaaggccaaauuggcuuuagauaacaucgugaugcugcacaccacagagaaagggggaagggcauaccagcaugcccucaaugaacugccugagucgcuugagacucugaugcucgucgcuuugcugggugccaugaccgcaggcauuuuccuauuuuucaugcaggggaaaggaaucggcaagcugucuaugggucucauugcgaucgccguggcuuccgggcuucugugggucgccgaaauacagccccaauggaucgcagcuagcauuaucuuagaguucuuuuugauggugcugcucauuccagaaccugagaaacagcgcacaccgcaggacaaccagcugaucuacguuauacuuaccauucugacuaucauuggccucguggccgcaaaugaaaugggauugaucgagaagacaaaaacggauuucggcuuuuaucaaguaaagaccgagacuacaauacuggacguggauuuacggcccgccucagcuuggacccuauacgcggucgccaccacaauccugacuccaaugcuccgacacacgauugaaaacaccagugcaaaucuuucucuggcugccaucgccaaccaggcagcuguuuugauggggcugggaaagggcuggccucuccauagaauggaccugggugugccccuucucgccauugggugcuauucccaggucaauccaacaacucugaccgcgagcuuggugaugcuguuaguacacuacgcuaucauaggaccuggccuacaggccaaagcaacaagggaggcccaaaagcgcaccgcugcagguauuaugaaaaaccccacuguggauggcaucacgguuaucgaccuggaaccgauuucauaugacccaaaguucgagaaacagcucggacaggugaugcuucuggucuugugugugggacaacugcuccugaugcggacaaccugggcccuuugcgaggucuuaacucuggcgaccggcccuaucaugacacucugggaagggaaccccggaagauuuuggaauacuaccauagcugugaguacagccaacauuuuccguggcagcuacuuggccggugcagggcuggcuuuuucccuaaucaagaaugcccagacgccaaggcggggaaccggcacuacaggugagacccugggcgaaaaguggaaacgccagcucaacucucuugaucgaaaggaguucgaagaguauaaaagaagcgggauucuggagguugacaggacugaagcaaaguccgcuuugcgggauggaucaaaaacaaagcaugccguaucucgcggcaguucgaagaucagauggauaguggagagggggaugaucaaacccaagggaaaagucguggaccugggcuguggucgagggggauggagcuacuacauggcgacccucaagaauguuacggaagugaaaggcuauaccaagggcgggccuggacacgaggaaccgauucccauggccacauacgguuggaaccuggucaaguuacacuccggcguggauguauuuuauaaaccaacugaacagguggacacccuucugugcgauaucggggagucuucaagcaauccuacaauugaagagggaaagacucuccggguucuaaaaauggucgaacccuggcuguccaguaagccugaguucuguaucaaaguguugaacccauacaugcccaccgugauugaagaacuggagaagcuccaacguagacauggcgguucucuuguccgcugcccucugagcagaaauucaacacacgaaauguauuggguuuccggggcaaguggaaacaucgugagcucuguaaauaccauauccaaaauguugcugaaccgguuuacuacgagauaccgcaagccaacauaugagaaggacguggaucucggcgcuggcaccaggucagucagcacugaaaccgagaaacccgacaugacaauuaucgggcgacgguuacagagacugagggaggaacauaaggagacguggcacuacgaucaggaaaauccguaccgcaccugggccuaucacggaucguacgaggcaccuucuacugguagugcuuccagcauggugaacggcguugugaaacuucugacaaagccaugggacgucgugcccaugguaacccagcuagccaugacugacacaaccccuuucgggcaacagcguguuuuuaaagaaaagguggauacacggacuccacagcccaagccgggaaccagaaaaaucaugacgaccacagccaauuggcucugggcgcuguugggcaagaaaaagucaccuaggcuguguacucgcgaggaguucauuuccaaaguccgaucuaacgcugcaauaggugccguguuccaggaggaacaaggguggaccagcgcuagugaagccgugaaugacucccgguuuugggagcucgucgauaaggaaagagcacuucaucaggagggaaggugcgagagcugcguuuauaacaugaugggcaagcgcgagaagaagcugggcgaguucgggagagccaaaggaucucgggcuaucugguacaugugguuaggugcgagguuucuggaguucgaggccuugggcuuucucaacgaagaccacugguucucacgugagaauaguugguccgggguggagggagaaggccugcaucgacuagguuauauucuugaggauaucgacaagaaagauggggaccugauuuacgcagaugacacagcuggaugggauacucgcaucaccgaagacgaucuccugaacgaggaguugauaacggaacagauggcaccccaucauaagacacuggccaaggccaucuuuaaacucaccuaucaaaauaagguagugaaaguccuuagaccaacuccuaagggcgcugugauggacauuaucagccggaaagaccagaggggcucugggcagguuggaacauacggucugaacaccuucacuaauauggaggugcaguuaauucgccaaauggaagccgagggcgucaucacccaggaugacaugcagaaccccgaagggcugaaggagagaguggagaaaugguugaaggaauguggaguagaucggcucaagaggauggcgauaucgggcgacgauugcguugugaaaccacuggacgagcgauuuucaacaagccuacuuuuccugaaugauauggguaagguccguaaagacauuccccagugggaaccuuccaagggguggaaaaacuggcaagaggugccauuuuguagucaccacuuccauaagaucuuuaugaaggauggaagaucucucguugugccgugccgcaaucaggacgaacugaucggccgggcaaggauuagccagggcgccgggugguccuugagagagacggcuuguuuaggaaaagccuacgcacagauguggucacugauguauuuccaccgccgggaucucaggcuugcuaguauggccauaugcucugcuguccccaccgagugguucccuacuagccgaacaaccugguccauccaugcccaccaccaauggaugacuacagaagacaugcugaagguguggaacagaguauggauugaggacaauccaaacaugaccgauaaaacgcccgugcauucaugggaagacaucccuuaccuagguaagcgggaggaucugugguguggcagccucauuggguugucuuccagggcaacaugggcgaaaaauauccacaccgccauaacucagguccgcaaccugaucggaaaggaagaguauguugacuacaugccagcuaugaagcguuauagugcccccuuugagagcgaaggcgugcuuuga

SEQ ID NO: 15800 - RNA, 9867 nt, Artificial Sequence
  derived and/or modified CDS sequence (opt3) from DENV-4__KP140942__SS-prME
agcaccaucacacugcucugccuuauucccacugugauggcauuccaccuguccacgagagacggcgagccuuugaugauagucgcuaagcaugaaagggggcggccauuacuguuuaagaccacagagggaaucaacaaguguacucugauugcaauggaucucggugaaaugugcgaggacaccguuacauacaaauguccgcugcuugugaauaccgaacccgaggauaucgacugcugguguaaccugacuucuacauggguaauguauggaaccugcacgcaaucaggggagcgccgacgugaaaagcggaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggcgcccuacgcuggauuuugaacuaacuaagacaaccgccaaggagguggcgcuccugcgaacuuacuguaucgaagcaaguauuuccaauaucacaaccgccacgagaugcccaacccaaggagagcccuaucuuaaagaggaacaggaccagcaguacauuuguaggcgggaugucguugaccguggcuggggcaacgggugcggacuguucgguaagggcggggugguaacaugcgcuaaauuuucuuguagcggaaagaucacuggcaauuuggugcaaauagagaaccucgaauauaccgucgugguuacagugcauaauggugauacucacgccgucgggaacgacaccuccaaucacggcgugacagcaaccauuacuccucgcucaccaaguguagagguugaacugccggauuacggagaguuaacgcuggacugcgagcccagaagcggcaucgacuucaacgaaaugauucucaugaaaaugaauaagaagacauggcuugugcauaaacagugguuucuggauuugccucuaccauggaccgcuggggccgacacuucugagguccacuggaacaauaaggaaaggauggugaccuucaaagucccccaugcgaagcggcaggaugugacaguucugggaucccaggagggugccaugcacucagcacucgcuggcgccaccgaaguggacagcggggauggaaaccacauguuugcuggccaucugaaauguaagguacgaauggagaaacuucgcaucaaggguaugaguuacacuaugugcucugggaaguucuccaucgacaaagagauggccgaaacacaacacggcacgaccgucgugaagguuaaauaugagggagcaggcgccccuuguaaggugccaauugaaauaagagaugucaacaaagagaaggugaucgggaggguaauuagcucgaucccccuggcugagaauacuaacucugugacaaauauagaauuggagccgccuuucggagacuccuacauuguuaucggugucggcaacucagcgcucacccugcauugguuucggaaggggaguagcaucggaaaaauguucgaauccacauaucgcggcgcaaagagaauggccauuuuaggugagacugcuugggauuuugggucugugggcggacuguucaccagccuaggcaaagccgugcaccaggucuuugggucaguuuacacgaccauguucggaggcgugaguuggaugaucaggauucucauagguuuucuggugcuuuggaucgggacaaauucccguaacacuagcauggcaaugaccugcauugccguaggaggcaucacauuguuccuggguuuuacuguccaggcugacaugggcugugugguuucuuggucagggcgggaacucaagugcggaaguggcaucuucgugauugauaauguccauaccuggacggagcaauauaaauuucagcccgagagcccagcccgacuggcauccgcgauacuuaacgcucacaaggacgggguguguggaaucagaucuacaaccaggcuggaaaauguuauguggaagcagauuacuaacgaguugaauuacgugcucugggaaggcggucacgaccugacaguagucgccggggaugugaaaggaguguuaaccaagggcaaacgcgcacugacuccucccgccucggaccuaaaguauagcuggaaaaccugggguaaggcuaagaucuucacaccagaggcccggaacuccacguuucucauugauggccccgacaccucagaaugcccuaaugagagaagggcauggaacagucuggaggucgaagauuacggguucggaauguucacuacaaauaucuggaugaaauuucgcgagggcucuagcgaaaugugugaccaucgacuuauguccgcugccauaaaggaucagaaagcgguucacgccgacaugggguacuggaucgagucaagcaagaaccaaaccuggcagauugaaaaggcuucuuugaucgaggugaagacaugccuguggccaaaaacucauacccucugguccaacggaguacuggagagucagauguuaauuccgaaaagcuaugcaggccccuucucucagcacaauuaccggcaagguuaugccacgcagaucgcugggccuuggcaccugggaaaacuugaaauagauuuuggcgagugcccagguacaaccgugacuauucaggaagacugugaucaucguggccccuccuugagaaccacaacugccucagggaaacucgucacccaguggugcuguaggaguugcacaaugccuccacugcgcuuccuaggagaggacggcuguugguacgggauggagauccggccccugagcgaaaaggaggaaaacauggugaaaucgcaaguugcagcgggacagggcacguccgagaccuuuucuaugggucuccugugccuuacuuuguucguggaagagugucugagaaggcgagucacacgcaagcacaugauuuuagccgugguuaucacccucugcgcuauaauccuaggcgggcuuacuuggauggaucuguugcgggcccucauuaugcugggggacacaaugagcggcagaaugggaggccagacccaucuagcaaucauggcuguguuuaaaaugucaccggguuauguccugggcguauuccucaggaagcugacgagucgugagacugcccuuauggugauugggauggcaaugaccacaaccuuguccaucccucacgaccugauggaauuaauagauggaauuucucucggccugauccuucugaagaucguuacucaguuugacaauacacaaguggguacccuagcccucagccugacauucauucgcuccacuaugucauuggucauggcuuggcggaccaucauggcggugcuguuuguagugacguuaauuccacucuguagaacaagcugccugcagaaacagagucauugggucgagauaaccgcccuuauccugggggcacaggcuuugcccguuuaccucaugacucugaugaagggagccucuaaaagguccuggccucuaaacgaaggcauuauggccgugggccuggugagccuucucgggucggcucuguugaagaaugaugucccccuggcaggaccaaugguggccgguggcuuacuccuggcggcuuauguuaugucagggucuagugccgaccuuucccuggagaaagcagccaacguacagugggaugaaauggcugacaucaccggaagcucuccuauuaucgaggugaagcaggaugaggacggcagcuucuccauacgagaugucgaagagacaaauaugaucacuuugcucgugaagcuggcacuaauuaccguuucaggucuguacccccuugccaucccagugacgaugacacucugguacauguggcaggucaaaacccaacggaguggggcgcugugggacgugccgagcccugcugccacucagaaggcagccuugucugaaggaguauaucgcauuaugcagagaggcuuauuuggcaaaacacaggucggggugggaauccacauggaggguguuuuccacaccauguggcaugugacuaggggcuccgucauaugucacgaaacagggcggcuggagcccucaugggcugaugugcgaaacgacaugauuaguuacggaggcgguuggagacucggggauaagugggacaaagaggaagacguucaagugcuggccaucgagccaggaaagaaucccaagcauguccagaccaaaccuggccuuuucaagacgcugacuggcgaaaucggggcagugaccuuggauuuuaaaccaggaacaagcgguucccccauuauaaaccgcaagggcaaaguaaucgggcuauauggaaauggcgugguuaccaagucuggugacuacgucucggcuauuacacaggccgagaggaucggggagccugauuaugaaguggacgaggauauuuuccguaaaaagcggcugacuaucauggaccuccacccgggagcgggcaagaccaaaagaauacugccaagcaucgugagggaagcccuuaagcgccgauuaagaacgcugauucucgcacccacacgggucguagcugccgagauggaagaggcuuugaggggccugccuauccgcuaccagacuccagcagugaaaucagagcauaccgggcgugaaauuguugaucucaugugccacgccacauuuaccacuagacugcuuuccaguacccgggugcccaacuauaaucugaucgucauggacgaggcccacuucacagauccuucuagcguggcugcgaggggauacauauccacgcgcguugaaaugggugaggcagccgcuauuuuuaugacugccaccccgcccggcgcaacagacccauucccucaaucaaacucucccaucgaagauaucgagcgagagauuccagaaagaagcuggaauaccggguuugacuggaucacugacuaccagggaaagacagugugguucgucccuaguauaaaagccggcaacgauauugcuaacugcuugcggaaguccgguaagaaagugauccagcuaagcaggaagaccuuugacacggaguaucccaaaacuaagcugacagauugggacuucguagugaccaccgauauuucugaaaugggggcgaauuuucgcgccggcagaguuaucgacccaaggcggugucucaaaccggucauauuaacugauggaccugagcgugugauucuggcaggccccaucccagugacacccgcuucagccgcacaacgccgagggagaaucggaaggaacccugcccaggaagacgaucaguacgucuucuccggugacccacuuaagaaugaugaggaccaugcucacuggaccgaggccaagaugcugcucgauaacauuuauacacccgaaggcaucauuccuacuuuguucgggccggagcgggagaagacgcaggcgauagacggagaguuucgccugagaggcgagcaaaggaagaccuucguugaacucaugcggcgaggugaccugccaguguggcuuaguuacaaaguagcaagcgccgggaucucguauaaggauagagaguggugcuuuacaggcgaacgcaauaaccagauucuagaggaaaauauggagguggagaucuggacuagggaaggagagaaaaagaagcugcggccccguugguuggacgcuagagucuacgccgauccuauggcuuuaaaagacuucaaggaauuugcaucuggcaggaaaucccugacccucgauauccugacagagauugccagccuucccaccuaucugucaagucgcgcuaagcucgccuuggacaacauagugaugcugcauacuacggaaagagggggacgagcauaccagcacgcgcuaaaugagcugccagagucucucgaaacccuuaugcugguugccuuauugggugcuaugacagccggcaucuuccuguuuuucaugcaggggaaaggaauuggcaagcucuccaugggucugaucacuauugcaguggcuagcgggcuucugugggucgccgagauccaaccucaguggauagcagccucaaucauucucgaauuuuucuugaugguacuguuaauccccgagccagaaaagcagagaaccccucaggauaaccaacuaauuuacgugauccugacaauacucaccauuaucggccuuauugcugcgaaugagaugggacugaucgagaaaacuaagacagacuuuggcuucuaucagguuaaaacggaaaccacuauauuggauguggaccugaggccggccagugcauggacacucuacgcugucgccaccaccauccugacacccaugcuucgccacacuauugagaacacgagcgccaaucucucccuggcagcuaucgccaaccaggcggcuguguugauggggcugggaaagggcuggccauuacaucggauggaucuaggugucccucugcucgccaugggguguuauucucaggugaaucccaccacacuuacugcaagccugguuauguugcuggugcacuacgccauuaucggaccaggccuccaagcuaaagcaaccagagaagcccagaagcguacagcggcugguauaaugaaaaacccuaccguagacggcauuacugugaucgaucuggagcccaucuccuaugacccgaaguuugagaagcagcuugggcaagucauguuacugguucucugcgccggacaguugcugcuaaugaggacgacaugggcauucugugaagugcugacccucgccacuggcccaauucuuacccugugggaggggaacccuggacgguucuggaauacaacuaucgcugucucaaccgccaacauauuucgcggcucuuacuuggccggugcugggcuggccuucagucucauuaaaaaugcgcagacaccccgaagaggaacgggcaccacuggugaaacacugggcgagaaguggaaaaggcaguuaaacucgcuugaccggaaggaauuugaggaguauaaacgcagcgggauccuggaaguggauagaaccgaggccaaguccgcacucaaggacggaucuaaaauuaagcaugcuguaucaaggggcagcuccaaaauccgauggauaguggaacgggggaugguuaagccaaaaggaaagguggucgaucuaggcugcggucgugggggauggaguuacuacauggccacucugaagaaugugacagaggucaaaggcuauaccaagggcgggcccggacacgaagaaccuaucccgauggcaacguacgguuggaacuuggugaaacugcauucuggcguugacguauucuauaagcccaccgagcaaguggauacacuccuuugugacauuggggaaagcucauccaauccaacuaucgaggaaggaagaacccugcgcgucuugaaaaugguggagccuuggcugaguagcaagcccgaauuuugcauuaagguucucaacccuuacaugccaacagugaucgaggaguuagaaaaacugcagaggaagcacggcgguaaucuuguccgguguccccugucuagaaacuccacucacgagauguauugggugucaggggcuagcggaaauauuguaucgucugugaacaccacaaguaaaaugcuacucaaucgcuucaccacuaggcaucgaaagccuacguacgaaaaagauguugaccugggcgccggcacacgguccgucagcaccgagacugagaagccagauaugaccaucauagggagaagguugcagcgccugcaggaagaacacaaagaaacauggcauuaugaccaagagaaccccuaccguacgugggccuaccacggaucauaugaagcgccguccaccgguucugcuagcaguauggugaauggcguggucaagcuccuuacuaagccuugggauguuauuccaauggugacacagcuggcaaugaccgacacuacacccuuugggcagcagcggguauucaaagagaagguggacaccagaacaccucaaccaaaacccggaacuaggauggucaugaccacgaccgccaacugguuaugggcucuguugggcaagaaaaagaauccgcgccucugcacaaaggaggaauuuaucuccaaagugcgagccaacgcagccaucggugcuguuuuccaggaggaacagggguggacuagcgcgucugaggccgugaacgauucacgguuuugggaacuggucgacaaggagagagcacuacaccaagagggaaaaugugaaaguugcguguacaauaugaugggcaagagggagaagaaacuuggcgaguucgggcgcgcuaaaggauccagagccauuugguauauguggcugggugcacgguuucucgaguucgaagcccugggcuucuugaacgaggaucauugguuugggagggagaauagcuggucuggaguagaaggcgagggucugcaccgucucggguacauacuugaagagaucgacaaaaaggauggagaccugauguaugcugaugacaccgccggcugggauacacgaauuacugaggacgauuuacagaacgaggaacugaucaccgaacagauggcgccucaucacaaaauuuuggcaaaggccaucuucaaacucacguaccagaauaagguugugaagguccugcgccccacaccaagaggcgcugugauggacauaaucucgcggaaagaucaaagggggucaggacagguggguaccuauggccuaaacacuuuuacaaauauggagguccagcuuauucgccagauggaagccgaggggguuaucacccaagacgacaugcagaacccuaagggacugaaagagagaguggaaaaguggcuccgggagugcggcguagauaggcugaaacgaauggcaauuagcggugacgauuguguggucaagcccuuggacgaacguuucgcuacuuccuuacuguuucucaaugauauggggaaagugagaaaggacaucccacagugggagcccaguaagggauggaaaaacuggcaggaaguuccuuucugcucucaucacuuucacaagauauucaugaaagauggccgcagccuuguggucccaugucggaaucaagacgagcugauuggcagggccagaaucucccagggggcuggauggucacuaaaggagaccgccugccuggcaaaagcguacgcccagauguggagucucauguacuuucaucgccgggauuugaggcuggcuucuauggccaucuguagcgcagugccgacagaaugguuccccacgucccgaaccacuuggucaauucacgcucaucaccaguggaugacaaccgaggacaugcuuaagguauggaacagaguuuggauagaagauaauccuaacaugaucgacaagacuccagugcacagcugggaggacauucccuaucuggguaaacgggaagaucucuggugcggcucuuuaaucgggcuguccaguagggccacaugggcaaagaauauucauaccgccaucacgcaaguccgcaacuugauaggaaaagaggaguacauggacuauaugccugugaugcguagauacagcgcgccaucggaauccgagggcguucuguga

SEQ ID NO: 15801 - RNA, 9867 nt, Artificial Sequence
  derived and/or modified CDS sequence (opt3) from DENV-4__KU523871__SS-prME
agcaccaugacacugcucugccuuauccccacugugauggccuuccaccuguccacgagggacggcgaaccuuugaugauugucgcuaagcaugaaagggggcggccauuacuguuuaaaaccacagaaggaauaaacaaguguacucuuaucgcaauggaucucggugaaaugugcgaagacaccguuacauacaaauguccgcugcuugugaauaccgaacccgaggauauugacugcugguguaaccugacuucuacauggguaauguauggaaccugcacgcagaauggggagcgccgacgugaaaagagaucaguggccuugacuccucacaguggaaugggccucgagaccagggcggaaacauggaugagcuccgagggugcuuggaaacaugcccagcgggucgagucuuggauccugcgcaacccaggguucgcacugcucgccggauuuauggcuuacaugauuggccagacuggcauccagagaauaguguucuuuguuuuaaugaugcugguggcacccucguaugggaugaggugugucggaguggguaaucgggauuucguagaaggcguuucagggggagccuggguggaccuugucuuggagcacggcgguugcgugaccacaauggcucaggggaagccuacccuggauuuugaacuaacgaagacuacagccaaagagguggcgcuccugcgcaccuacuguaucgaagcaagcauuaguaacaucacuacagccacccgaugcccaacgcaaggagagcccuaucuuaaggaggaacaggaccagcaguacauuuguagaagggaugucguugaccggggcuggggcaaugggugcggacuguucgguaaaggcggggugguaaccugcgcuaaguuuuccuguucuggaaaaaucacaggcaacuuggugcaaauagagaaucucgaauauacugucgugguuaccgugcauaacggugauacacacgccgucgggaaugacacuagcaaccacggcgugaccgcaacaauuaccccucguuccccaucaguagagguuaagcugccggauuacggagaauuaacucuggacugcgagccccgcaguggcaucgacuucaaugagaugauucucaugaagaugaaaaagaaaacguggcuugugcauaagcagugguuucuggauuugccucuaccauggacagcuggggccgacaccagcgaaguccacuggaaccauaaagagagaauggugacuuucaaggucccccacgcgaaaaggcaggaugugaccguucugggaucucaggaaggugccaugcacuccgcacucgcuggcgccacagagguggacucaggggauggaaaucauauguuugcuggccaccugaaguguaagguacggauggaaaaacuucgaaucaaggguaugagcuacaccaugugcagugggaaauucucuaucgacaaggagauggccgagacucaacauggcacaacggucgugaaaguuaaguaugaaggagcaggcgccccuuguaaggugccaauugagauacgcgaugucaacaaagaaaaggugguagggagaaucauuuccagcacccccuucgcugagaacacuaauucggugacaaacaucgagcuggaaccgccuuuuggagacucuuacauaguuauuggugucggcgaguccgcguugacccuccacugguucaggaaagggucaaguaucggaaagauguuugaaagcacauaucggggcgcaaaacgcauggccauccugggugagacugcuugggauuucggguccgugggcggauuauuuaccucucugggcaaggccgugcaucaggucuucgggagcguuuacacgaccauguuuggaggcgugucauggauggugaggauucugaucgguuuccucguacuguggauugggacaaauaguagaaacacuuccauggcaaugaccugcauagccgucggaggcaucacacuauuuuuggguuucacugugcaggcugacaugggcuguguugugagcuggucugggaaggaacugaaaugcggaucaggcauuuuugucguggauaauguucacaccuggacggagcaauauaaguuccagcccgagaguccagcccgucucgcaagcgcgauccugaacgcucacaaagacgggguguguggaauccgguccacaacccgacuugaaaauguaauguggaagcagauuacuaacgagcugaauuacgucuugugggaaggcggucaugaccucacagugguggccggggaugucaaaggaguucugaccagaggcaagagggcauuaacuccucccgugaacgaccugaaguauucuuggaaaaccugggguaaggccaaaauauuuacaccagaggcucgcaauucgacguuccuaaucgauggccccgacaccagcgaaugcccuaacgagcggagagccuggaauuucuuugagguagaagauuacggguucggaauguuuacuacaaacauuuggaugaaguucagggagggcuccucagaagugugugaccaccgccucaugagugcagcuaucaaagaucagaaggccguccaugcggacaugggguacuggauugagucuagcaaaaaucaaaccuggcagaucgaaaaggccucccugauagaggugaagacaugccuuuggccaaaaacucacaccuuguggucaaacggaguucuggagagccagaugcucaucccgcgaucuuaugcuggccccuuuucccagcacaacuaccggcaagguuaugcaacgcagacaguggggccuuggcaucugggaaaguuagaaauugauuucggcgagugcccagguaccacugucgccauccgugaagacugugaucacagaggccccagucugaggaccacaacugcuagcgggaaacuugugacccaguggugcugucgcucuugcacaaugccuccauugcgguuucucggagaggacggcuguugguacgggauggagauuagaccccuguccgaaaaggaggaaaauaugguuaaaucacaggccacggcaggacaaggcaccagugagacuuucagcaugggucuacugugccucacacuguuuguggaagagugucuuaggcgacgcgucacccggaagcauaugaucuugguagugguuauaacuuucugcgcgauuauccuaggcggguuaacauggauggaucuccugagagcccuuauuaugcugggggacaccaugucgggcaggaucgggggacagauacacuuggcuaucauggccguguuuaagauguccccggguuauguccucggcguguuccugcguaaacuaacgucucgcgagacugcacugaugguaauugggauggcuaugaccacaguguuuagcaucccucaugaccucauggaacugauugauggaaucucacuuggcuugauacuguuaaagauugucacccacuucgacaacacucagguugguacacucgcccugagucuuaccuuccugcgguccacaacuccccuggugauggcauggagaaccaucauggccguguuuuucgucgugacgcucaucccccuguguaggacaucuugcuugcagaaacaaagccacuggguugagauuaccgcucugaucuuaggggcgcaggcccucccuguauaccugaugacucuuaugaagggagcaucccgacggucauggccccugaaugaaggcauuauggcugugggcuuggucagccuccuggggagugcccuacugaaaaacgaugugccacuugccggaccuaugguugcugguggccuccuguuggcagccuaugugaugucuggguccagcgcggaccugucguuagagaaggcugccaauguccagugggaugaaauggcagacauaaccggaucaucucccaucauugaggugaagcaagaugaggacggcaguuuuuccauccgcgauguagaagagacaaacaugaugacucuccuggucaaacuugcccugauuaccgugagcgguuuguacccacucgcuaucccgguuacgauggcacugugguacauauggcaagugaagacacagagaucuggggcccuaugggacgucccuagccccgcggcuacccagaaagccacucuguccgaaggaguguauaggaucaugcaacggggccuuuucggcaagacacagguuggggugggcauucauauggagggugucuuucacaccauguggcaugugacucgaggcucaguaaucugucacgaaacagggagacucgagccaaguugggcagaugugcgcaaugacaugauuagcuacggaggcgguuggaggcugggggauaaaugggacaaggaggaagacguucaggucuuggccaucgagcccggaaagaacccuaaacaugugcagaccaagccaggcuuauucaaaacgcugacuggcgaaauaggggcugugacccucgauuuuaagcccggaacaucugguuccccuauuaucaauaaaaagggcaaagucaucgggcuguauggaaacggcguagugaccaagucaggugacuacguuagugccauuacacaagcagagcguauaggggagccggauuaugaaguggacgaggauaucuuccggaagaaaagacuuacuauuauggaccugcacccaggagcuggcaagaccaaaaggaucuugcccagcauuguccgcgaagcccuaaagcgaagacugcggacgcucauccuggcgccuacaagggugguugccgcagagauggaagaggcacuucgcggcuuaccaauacguuaccagacucccgccgugaaauccgagcacaccgggagagaaaucgucgaucugaugugccaugcuacauuuaccacucggcucuugucuucgaccagggugccuaauuauaaccugauuguaauggacgaggcacacuucacagauccgugcagcguggccgcccgcggauacaucucaacgcgaguugaaaugggugaggcugcggcaauuuuuaugacugccacaccaccaggcgcuacagacccuuucccccaguccaauaguccaaucgaagauauagagagagagauuccugaacggucuuggaacaccggguucgacuggaucacugacuaccagggaaagacagucugguuugugcccagcaucaaggccggcaaugauauugcaaacugucucaggaaauccgguaagcgcgugauccaacugucaagaaaaaccuucgacacggaguauccaaagacuaaacuuacagauugggacuuugucguuaccaccgauauaucugaaaugggggccaacuucagggcuggccgggugauugacccgcgucgcugccugaagccuguaaucuugacugauggacccgagcgagugauucuagcgggcccaauccccgucaccccugccagcgcagcucagagaagggggcggauaggacgcaauccagcccaggaagacgaucaauacguguuuaguggugacccccugaagaacgaugaggaccaugcacacuggaccgaggccaaaaugcucuuagauaauauuuauacaccugaaggcaucaucccgacucuguucgggccagagagagaaaagacgcaggcuauugacggagaguuuaggcuucggggcgagcagcgaaaaaccuucguugaacugaugaagagaggugaccuccccgugugguuguccuacaaagucgccagcgcggggaucucuuauaaggaucgcgagugguguuuuacaggcgaaaggaacaaucagauucuggaggaaaacauggagguagagauauggacuaaggaaggagagaaaaagaaacuccggccuaaguggcuggacgcacguguguacgccgaucccauggcucuuaaagacuucaaggaauuugccucaggcagaaaguccaucacccuagauauucugacagagaucgcuaguuugccaaccuauuuaagcucgaaagcaaagcuggcccucgacaauaucauuaugcugcacacuacggaaaaagggggaagggcuuaccaacaugcccuuaacgagcugccugagucucucgaaaccuugaugcugguugcacuacugggugcgaugacagccggcauauuccucuuuuucaugcaggggaagggaaucggcaaacuuuccaugggucugauugcuaucgccguggcaagcggguuauugugggucgcugagauucagccccaguggaucgccgcaucaauaauccuggaguucuuucucauggugcugcuuauuccagagccugaaaagcaacgcacuccgcaggauaaucagcugaucuacgucauucucaccaucuugacaauaauuggccugaucgccgcuaacgagaugggauuaauugagaaaaccaagacugacuucggcuuuuaucaggugaagacagaaacgaccauccuagauguugaccugcggcccgcgagugccuggacucucuacgcaguggcuacaaccauacuuaccccaaugcugcgacacacaaucgagaauacuucugccaacuugucccuggccgcaauugcuaaucaagccgcgguacucauggggcugggaaaaggcuggccucuucauagaauggaucucggugugccccuguuggcuaucgggugcuauagccaggucaacccaacgacccugacagccucauuaguuaugcuacuggugcacuacgcaauuaucggaccuggccuccaggccaaggcuacuagggaagcacagaaacgcaccgccgcggguauaaugaagaaucccacagucgacggcauuaccgugaucgaucuugagccgaucaguuaugacccaaaauucgagaagcaacuggggcagguaauguugcuggugcucugugcuggacagcugcuuuuaaugcggacuacgugggcccugugcgaaguucucacauuggcaaccggcccugccaugacucugugggaggggaaccccggaagauuuuggaacaccacaauugcugugagcacugccaauaucuuccguggcuccuaccuagcuggugcugggcuggccuuuucucucauaaagaacgcgcaaaccccaaggcggggaacaggcacgaccggugaaacucuuggcgagaaauggaagcgccagcugaauagcuuggaccgaaaagaguucgaggaguauaagagauccgggauucuggaagucgauaggacagaggccaaaucagcacucaaggacggaucuaagaucaaacaugcugugagucggggcucgagcaagauucgcuggaucgucgaaagagggauggugaaacccaagggaaaaguuguagaucugggcugugguagagggggaugguccuacuacauggccaccuuaaagaacgugacugaggucaagggcuauacaaaaggcgggccuggacacgaagaaccgauacccauggcaaccuacgguuggaaucuugugaagcugcacucuggcguugacguguuuuauaaaccaacggagcaggucgauacccuccuaugcgacaucggggaaucaagcuccaacccuacaauugaggaaggacgaacucugcggguguugaagaugguagagcccuggcugaguucuaaaccugaguucuguaucaaggugcucaauccauacaugcccaccguuauugaggagcuugaaaaacugcagcguagacauggcgguagcuugguccgcugcccucugucaaggaacuccacacacgagauguauugggugaguggggcuagcggaaauaucgugucuuccgucaacacuauuucaaagaugcucuuaaaucgguuuaccacaagacaucgcaagccaaccuacgaaaaagauguugaccugggcgccggcacuaggagcgugucgacggagacagagaagcccgauaugaccaucauagggcgacggcuucaaagacugagggaagaacacaaagaaacuuggcacuaugaccaggagaacccguaccgcaccugggccuaccauggaucuuaugaagcgccuaguacagguuccgcuagcucaaugguaaauggcguggucaagcuacucacgaaaccaugggaugugguucccauggugacccagcuggcaaugacugacacaaccccuuucgggcagcaacgugucuuuaaggagaagguggacacucggacaccacagcccaaaccgggaaccagaaugauuaugacaacuaccgccaacugguuguggacgcugcucggcaagaaaaaguccccuaggcuuuguacccgcgaggaguucaucucuaaaguacgaagcaaugcugccaucggugcaguuuuccaggaggaacagggguggacaagugccuccgaggcugugaacgauagccgguuuugggaacuggucgacaaggagagagcguuacaccaagagggaaagugcgaaucuugcguguacaauaugaugggcaaaagggagaagaaacugggcgaguucgggcgcgccaagggaucaagagcaaugugguauaugugguugggugcucgguuucucgaguucgaagcccugggcuuucuaaacgaggaucauugguucaguagggagaacuccuggagcgggguggaaggagagggccuucaccgucuggguuacauucucgaagacauagauaaaaaggacggggaucugaucuaugcagacgauacugccggaugggacacccgaauuacagaggaugacuugcugaaugaggaacucaucacugagcagauggcuccccaucacaagacccuugccaaagcgauuuuuaagcugacguaccagaacaaagucguuaagguguuacgcccaacaccuaaaggcgcaguaauggauaucauaucuagaaaggaccaacggggcucgggacaggugggaaccuauggucugaauacuuucacaaacauggaaguccaguugaucaggcagauggaggccgaaggcgugauuacccaagacgauaugcagaaucccaaagggcucaaggagcgcguugagaaguggcugacugaauguggaguggacagacuaaaacggauggcuaucucaggcgaugacugcgucgugaagccacuugaugagagguuuagcaccucccuacucuuccugaacgacauggguaaaguacgaaaggauauuccccagugggaaccuaguaaaggguggaagaauuggcaggagguuccauuuuguucucaccauuuccacaagaucuuuaugaaagacggacguagcuugguggucccgugcagaaaccaagaugaauuaauaggccgcgcccggauuucccagggcgcaggguggucacugagggagacagcuugucucggaaaggccuacgcucagauguggagucuuauguacuuccauagacgcgaccugcggcuagccucuauggcaaucugcagcgcggugcccacggagugguucccuaccuccaggacuacauggucaauccacgcccaccaucaguggaugaccacugaagauaugcugaaaguuuggaaucgaguguggauugaggacaacccaaauaugacagacaagacccccgucuauagcugggaagauauaccuuaccucgguaaaagagaggacuugugguguggcucucugaucgggcuuuccagucgggcuacgugggccaagaacauucacacagcaaucacccaagugaggaaucugauuggaaaggaagauuauguagacuacaugccaaucaugaaacgcuauagcgcucccucggaguccgagggcgugcucuga

SEQ ID NO: 15802 - RNA, 9867 nt, Artificial Sequence
  derived and/or modified CDS sequence (opt3) from DENV-4__HQ332175__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcacuuauuaguaauaucacaaccgccacgcgaugcccaacccaaggagagcccuaucugaaggaggaacaggaccagcaguacauuuguagaagggaugucguugaccggggcuggggcaacgggugcggauuguucgguaaaggcggggugguaacaugcgcuaaguuuuccuguucuggaaaaaucacuggcaaucucgugcaaauagagaaccuggaauauaccgucgugguuacagugcauaauggugauacucacgccgucgggaacgacaccagcaaucacggcgugacagcaaccauuacuccucguuccccaucaguagagguuaaguuaccggauuacggagaacugacgcucgacugcgagccccgcaguggcaucgacuucaacgagaugauucuuaugaagaugaaaaagaaaacauggcuggugcauaagcagugguuuuuggaucuaccucugccauggaccacuggggcugacaccagcgaaguccacuggaauuacaaagagagaauggugacauucaaggucccccaugccaaaaggcaggaugugaccguucucggaucucaggaaggugcgaugcacuccgcccuggcaggcgcuacugagguggacucaggggauggaaaccacauguuugccggccaucuuaaguguaagguacggauggaaaaacugcgaaucaaggguaugagcuauacaaugugcagugggaaauucucuaucgacaaggagauggcugagacgcaacacggcaccacugucgugaaaguuaaguacgaaggagccggcgcaccuuguaaggugccaauugagauacgcgaugucaauaaagaaaaggugguagggagagugaucuccgccacacccuuggcugagaacaccaacagcguuacaaauauugagcucgaaccgccuuucggagacucguauaucgucauaggugugggcaacucugcgcugacuuuacauugguuuaggaaaggguccucaauuggaaagauguucgagaguaccuaccggggcgcaaaacgcauggccauccugggugaaacggcuugggauuuugggagcgugggcggacuauucaccucccucggcaaggccguccaccagguuuuugggucuguguauacaacuauguucggaggcgugagcuggaugaucagaauucugaucgguuuucuuguauuguggauugggaccaauucaaggaacacaaguauggcaaugacuugcauagccgucggaggcaucacccuguuccucgguuuuacggugcaggcugacaugggcuguguuguguccuggagcgggcgugagcugaagugcggaucuggcauuuucgucguggauaauguucauacauggaccgaacaauacaaauuucagcccgagucaccagcccggcuugcaagugcgauccugaacgcucacaaggacgggguguguggaauccgaagcacuacaagauuggagaauguaauguggaaacagauuaccaacgaacucaauuauguccugugggagggcggucacgacuuaacugugguggccggggaugucaagggaguucugaccaaaggcaagagggcacuaacaccucccgccuccgaccucaaguacucuuggaaaacgugggguaaggcuaaaauauucaccccagaagcccgcaacucgacuuuucugaucgauggccccgacacaagcgagugcccuaaugaacggagagcauggaacuccuucgagguggaggauuacggguucggaauguuuaccacaaauauuuggaugaaguucagggaaggcucaagugagguaugugaccaucgccuuaugucugcugccaucaaagaucagaaggcggugcacgccgacaugggguauuggauugaaagcuccaaaaaccaaacuuggcagaucgagcgagcuucauugauagaagucaagaccugccuguggccaaagacgcauacacucuggagcaauggagugcuggagucucagauguuaaucccgaaauccuacgcaggccccuuuagucagcacaacuaucggcaagguuacgccacccagacuguugggccuuggcaccugggaaagcuugagauugauuucggcgaaugcccagguaccacagugacuauccaggagaacugugaccaucguggccccagcuugagaaccacaacggcuucugggaaacucgucacccaguggugcuguagguccugcacuaugccuccacugcgcuuucuaggagaagauggcuguugguaugggauggagauucggccccugucagagaaggaagagaauauggugaaaagucaaguuacagccggacagggcaccagcgaaacuuucucgaugggucuccugugccuuacauuguuuguggaggaaugucugagaaggcgagucacccgcaagcacaugaucuuagcaguagugauaacgcucugcgcgauuauccuggggggacuuacuuggauggaccuguugcgggcccucauuaugcugggcgauaccauguccggcagaaucgggggacagacacaucuagcuauaauggccguuuucaagaugucuccggguuacgugcugggcgucuuucucaggaaacugaccagccgugagacugcacuuauggugaucgggauggcuaugacaaccacauugucaauuccucacgaccugauggaguuaaucgacggaauuagucucggccugauccuucugaagauaguaacucaguucgauaacacccaaguggguacgcuagcccucucccugacauuuauucgcucuaccaugagcuuggucauggcauggcggacuaucauggccguucuguucguggugaccuuaaucccacucuguagaacauccugccugcagaaacagucacauugggucgaaauuacugcucuuauccugggggcgcaagccuugcccguguaucucaugacccugaugaagggagcaagcaggcgaaguuggccucuaaaugagggcauuauggcuguuggccugguaucucuucucggguccgcccuguugaaaaacgacgugccccuggccggaccaauggucgcugguggcuuacuccuggcagccuacgugaugagcgggucgucaguugaucuuucucuggaaaaggcggcuaaugugcagugggacgagauggccgauauaacgggaaguuccccuaucauugaagucaagcaggacgaggauggcagcuuuucuauccgggacguggaggaaacaaacaugauuaccuugcucguaaaacuggcacuaaucacugucagcggucuguacccccuugccauaccaaucacaaugacccucugguauauguggcaggugaagacucaacgcuccggggcucugugggauguuccgucaccugcagccacacagaaagcggcuuugagugagggaguguacagaauuaugcagaggggcuuauucggcaagacccaggucggggugggaauccacauggaagguguuuuccacacgauguggcaugugacucggggcagcgucauuugucacgagaccgggcgacuggaacccucuugggccgacgugagaaaugauaugaucuccuauggaggcgguuggcgccucggggacaaaugggauaaggaggaggacguacaagugcuggcaauagaaccaggaaagaaccccaaacauguucagacaaagccuggccuuuuuaaaacccugacaggcgagauuggggccgucacuuuggacuucaagccaggaaccucagguagucccaucaucaauaggaaaggcaaggugauugggcuauacggaaacggcguggucacgaaaagcggugauuauguauccgcuauaacacaggccgaacguaucggggagccugacuacgagguggaugaagacauuuuucggaagaagagacugacuaucauggaucuccacccgggagcaggcaaaaccaagaggauucugccaucuaucguucgcgaggcucuuaaacgaagauuacggacacugauacucgcccccaccaggguggucgcggccgaaauggaggaagcauugcgcggccugccuauccguuaucagacuccagcugugaagucggagcauaccgggagagagauuguugaccucaugugccacgccacauucacgacucggcugcuuagcucaaccagggugcccaauuacaaccugaucgucauggaugaagcucacuuuacagacccuuccaguguggcagcccgcggauacauuucuacccgaguagagaugggugaagccgcugcgaucuucaugacugcaacaccgcccggcgccaccgauccauuuccucaaagcaauucccccauagaggacauugaaagagagaucccagagcggucauggaacacgggguucgauuggaucacugacuaucagggaaaaacagugugguuuguuccuucuauuaaggcuggcaaugacaucgccaacugcuugaggaagagcgguaaaaaggucauacagcuaagucgcaaaaccuucgauaccgaauaccccaagacuaaacugacagacugggauuuuguggugaccacagacauuuccgagaugggggcaaacuucagagccggcagggucaucgauccacggcguugucucaagccgguuauuuuaacugacggaccugaacgcgugauccuggcuggccccauaccaguaacgcccgcgagcgccgcacaacgaagagggaggauuggacggaauccugcucaggaggaugaccaguauguguucucuggugauccacuuaagaacgacgaagaucaugcccacuggaccgaggcaaaaaugcugcucgacaauaucuacacacccgagggcaucauuccuacuuuguuugggccggaacgcgagaagacccaggccaucgauggagaauucagacugaggggcgagcaacggaaaacauuugucgagcucaugcgaagaggugaccugccaguguggcuuucauauaagguugcuuccgccgggauuaguuacaaagaccgcgaauggugcuucaccggcgagaggaacaaucagauacuagaagagaacauggaaguggagaucuggacucgggagggagaaaagaagaaacugcgucccaagugguuggaugcgagagucuaugcagacccuauggccuuaaaagauuuuaaggaguucgcuagcggcaggaaaucgauuacgcuggacauccucaccgaaaucgccucucugcccacauaccuuuccagccgcgcuaagcuggcacucgauaauauuguaauguugcauacuaccgagcgggggggacgagccuaccagcacgcucugaacgaacuaccagagucacuggagacacucaugcuuguggcccuguuaggugcaaugaccgcgggcauauuuuuguucuuuaugcaggggaagggaaucggcaaacugaguaugggucucauuacuaucgccguugcuucugggcugcuuuggguggccgaaauucaaccucaguggaucgcagcuuccauaauccuggaguucuuucucauggucuugcugauucccgaaccagagaagcagagaacaccucaggacaaucaauuaaucuaugugauucuaacgauccugaccauaauuggccucaucgccgcaaacgaaaugggacuuauugagaaaacuaagacagauuucggcuuuuaccaggucaaaaccgagaccacaauccuggacguggauuugaggccggccagcgcuuggacucuguaugcgguugccacgaccauacucacacccaugcugcgccacacuaucgaaaauaccucagcaaaccuuagucucgcugccauugccaaucaggcagcugugcugaugggguugggaaagggcuggccacugcaucggauggacuuagguguaccucuacuggccaugggguguuacagccaggugaaccccacaacccucacugcgucccuugucaugcuguugguucacuaugcuaucauuggaccaggccugcaagccaaagcaacgagagaggcccagaagcguacagcugcagguaucaugaagaauccuaccguggauggcauaacugucauugaccucgaacccaucucuuacgauccgaaauucgagaagcagcuggggcaagugaugcuuuuaguacugugcgccggacagcucuugcugaugaggaccacaugggcguucugugaggugcuaacucuggcuaccggcccaauccucacacuuugggaagggaacccuggacgguuuuggaacacgaccauugccguuagcacugcaaauaucuuccgcggcuccuaucuggccggugcuggguuggccuuuucacugauaaaaaacgcacagacaccccgaagaggaaccggcacuacaggugagacccucggcgaaaaguggaaaaggcagcugaauucuuuagaccggaaggaguucgaagaguacaagcgcagugggauucuugagguggacagaacggaagcuaaaucggcccugaaggauggaagcaaaaucaagcaugcggucuccaggggcucuucaaaaauucgauggaucguggagcgggggauggucaagccaaagggaaaagugguugaccucggcugcggucgugggggauggagcuacuauauggccacccuaaagaacguaacagaagugaaaggcuacacuaagggcgggcccggacacgaggaaccuauaccgauggcaaccuaugguuggaaucuggucaaauugcauuccggcguggauguuuuuuacaagcccacagagcaaguggacacucugcucugugauaucggggagaguucuagcaacccaaccauugaagagggaagaacacuucgcguccugaagaugguggaaccuugguugucauccaaacccgaguucugcaucaagguacugaauccuuauaugccaaccgugauugaagagcucgagaaauuacagaggaagcacggcgguaaccugguucgguguccccuuaguagaaauagcacucacgaaauguacugggucucuggggcuuccggaaacaucgugucaagcgugaauacgacaucgaaaaugcugcuaaaccgcuuuaccacuaggcaucgaaagccuaccuaugagaaagacgucgaucucggcgccggcacacggucuguuaguacggaaaccgagaagccagacaugacuauuaucgggagaaggcugcagcgcuugcaggaggaacacaaggagacauggcauuacgaucaagaaaaucccuaccguaccugggcauaucacggauccuacgaggcuccgagcacugguucagccuccucuauggugaacggcguagugaaacugcucacaaagccuugggacgucauaccaauggugacccagcuugccaugacagauacuacccccuucgggcagcagcggguuuuuaaagaaaagguggacacgagaaccccucaaccaaaacccggaacaaggauggucaugacuaccacagcgaauuggcugugggcuuuacugggcaagaagaaaaacccgcgcuugugcacucgagaggaguucauuagcaaggugcggaguaaugcagccaucggugcuguauuucaggaagagcagggguggaccuccgccagcgaagcaguuaacgacucuagauucugggagcucguggauaaagaaagggcccugcaccaagagggaaagugugagucaugcgucuauaacaugaugggcaaacgcgaaaagaagcuaggcgaguuugggagagcuaaaggaagucgggcgaucugguacauguggcuuggugccagguuccuggaauucgaggcacucggcuuucugaaugaagaccauugguucgggcgugagaacuccuggagcggaguggagggcgaagguuugcaccgacugggguauauucucgaggaaauagauaagaaagacggagaucuuauguacgcugacgauacggccggcugggacacacgcaucaccgaggaugaccugcagaaugaggaauuaauuacugagcagauggcaccucaucacaagauccuggccaaagcuauuuuuaaguugacauaucagaacaagguggucaaaguucucagacccaccccacggggcgccgugauggauaucauaucuaggaaggaccaacgcgggucgggacagguagguacuuacggccugaauaccuucacaaacauggaagugcagcuaaucagacagauggaggcggaaggggucauuacgcaagaugacaugcagaauccuaaaggacuuaaggagcggguggagaaauggcugagggaaugcggcguugaccgacucaagcguauggcaaucucaggugaugacuguguggucaaaccccuggaugagagauuugggaccagcuuguuauuccugaacgacaugggaaaggugcgcaaggauauuccacagugggaacccuccaaaggcuggaagaauuggcaggagguaccuuuuugcagucaucacuuccacaaaaucuuuaugaaggacggccggucucucguugugccauguaggaaccaagaugaacuuauagggagagcccgcauuagccagggagcugguuggucccugcgggagacugccugccuaggcaaagcauacgcucagauguggucacugauguauuuccauaggcgagaccucagauuggccaguauggcuaucuguucugccgucccgacagagugguuucccaccagccggacuacaugguccauccacgcacaucaccaguggaugaccacggaagauaugcugaagguguggaauaggguuuggauugaggacaacccuaauaugauagauaagacaccagugcacucaugggaagacauccccuaccuugggaaacgcgaggaccuguggugcggaagccucauuggcuuaucuucccgugcgaccugggccaagaacauccauacugcuauugcccaagucagaaaucugaucgguaaagaagaguauguggauuacaugccuguaaugaagcgauauagugcaccaagcgagucggaagggguguuguga

SEQ ID NO: 15803 - RNA, 9867 nt, Artificial Sequence
  derived and/or modified CDS sequence (opt3) from DENV-4__HQ332172__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucugccuggguaauguauggcacaugcacccagucaggggagcgccgacgugaaaagagaaguguggcguugacgccucacagcggaaugggccucgagacuagggcugaaaccuggauguccucugagggugccuggaaacaugcacaacgggucgagucguggauucugcgcaauccaggguucgcccugcucgcuggauuuauggcauacaugaucggccagacaggcauacagagaacuguguucuuuguuuuaaugaugcugguggcccccucauaugggaugaggugugucggaguggguaaccgggauuucguagaaggcguuagcgggggagcuuggguggaccuugucuuggagcacggcgguugcgugaccacaauggcccaggggaagccuacccuggauuuugaacuaacgaagacuacagcgaaagagguggcacuccugcgcaccuacuguaucgaagcccuuauuaguaauaucacuacagcuacccgaugcccaacgcaaggagagcccuaucugaaggaggaacaggaccagcaguacauuuguagaagggaugucguugaccggggcuggggcaacgggugcggauuguucgguaaaggcggggugguaaccugcgccaaguuuuccuguucuggaaaaaucacaggcaaucucgugcaaauagagaaccuggaauauacugucgugguuaccgugcauaauggugauacacacgcagucgggaacgacacuagcaaucacggcgugaccgcuacaauuaccccucguuccccaucaguagagguuaaguuaccggauuacggagaacugacucucgacugcgagccccgcaguggcaucgacuucaacgagaugauucuuaugaagaugaaaaagaaaacguggcuggugcauaagcagugguuuuuggaucuaccucugccauggacaaccggggccgacacuagcgaaguccacuggaauuacaaagagagaauggugaccuucaaggucccccaugcgaaaaggcaggaugugacaguucucggaucucaggaaggugccaugcacuccgcacuggcuggcgccaccgagguggacucaggggauggaaaccacauguuugcuggccaucuuaaguguaagguacggauggaaaaacugcgaaucaaggguaugagcuauacuaugugcagugggaaauucucuaucgacaaggagauggccgagacacaacacggcacgaccgucgugaaaguuaaguacgaaggagcaggcgccccuuguaaggugccaauugagauacgcgaugucaauaaagaaaaggugguagggagagugaucuccgcuacucccuuggcggagaacacaaacagcguuaccaauauugagcucgaaccgccuuucggagacucguauaucgucauaggugugggcaacucugcacugacauuacauugguuuaggaaaggguccucaauuggaaagauguucgagaguacuuaccggggcgccaaacgcauggcuauccugggugaaaccgccugggauuuugggagcgugggcggacuauucacgucccucggcaaggcaguccaccagguuuuugggucuguguauaccacaauguucggaggcgugagcuggaugaucagaauucugaucgguuuucuuguauuguggauugggacuaauucaaggaacaccaguauggccaugacaugcauagcugucggaggcaucacucuguuccucgguuuuaccgugcaggccgacaugggcuguguuguguccuggagcgggcgugagcugaagugcggaucuggcauuuucgucguggauaauguucauacguggacagaacaauacaaauuucagcccgagucaccagcacggcuugcgagugcuauccugaacgcccacaaggacgggguguguggaauccgaagcaccacuagauuggagaauguaauguggaaacagauuacaaacgaacucaauuauguccugugggagggcggucacgacuuaaccgugguggcaggggaugucaagggaguucugacuaaaggcaagagggcccuaaccccucccgcuuccgaccucaaguacucuuggaaaacaugggguaaggccaaaauauucacgccagaagcacgcaacucgaccuuucugaucgauggccccgacacuagcgagugcccuaaugaacggagagcuuggaacuccuucgagguggaggauuacggguucggaauguuuacaaccaauauuuggaugaaguucagggaaggcucaagugagguaugugaccaucgccuuaugucugccgcgaucaaagaucagaaggccgugcacgcugacaugggguauuggauugaaagcuccaaaaaccaaacauggcagaucgagcgagcaucauugauagaagucaagacuugccuguggccaaagacccauacgcucuggagcaauggagugcuggagucucagauguuaaucccgaaauccuacgccggccccuuuagucagcacaacuaucggcaagguuacgcuacacagaccguugggccuuggcaccugggaaagcuugagauugauuucggcgaaugcccagguacuaccgugacaauccaggagaacugugaccaucguggccccagcuugagaacuaccacagccucugggaaacucgucacgcaguggugcuguagguccugcaccaugccuccacugcgcuuucuaggagaagauggcuguugguaugggauggagauucggccccugucagagaaggaagagaauauggugaaaagucaaguuacugcaggacagggcacaagcgaaaccuucucgaugggucuccugugccuuacuuuguuuguggaggaaugucugagaaggcgagucacacgcaagcacaugaucuuagcgguagugauaacccucugcgccauuauccuggggggacuuacguggauggaccuguugcgggcucucauuaugcugggcgauacuauguccggcagaaucgggggacagacccaucuagccauaauggcaguuuucaagaugucuccggguuacgugcugggcgucuuucucaggaaacugacaagccgugagaccgcucuuauggugaucgggauggccaugacuacaaccuugucaauuccucacgaccugauggaguuaaucgacggaauuagucucggccugauccuucugaagauaguaacacaguucgauaacacucaaguggguacccuagcacucucccugacguuuauucgcucuacaaugagcuuggucauggccuggcggaccaucauggcuguucuguucguggugacuuuaaucccacucuguagaaccuccugccugcagaaacagucacauugggucgaaauuacagcgcuuauccugggggcccaagcauugcccguguaucucaugacucugaugaagggagcuagcaggcgaaguuggccucuaaaugagggcauuauggccguuggccugguaucucuucucggguccgcccuguugaaaaacgacgugccccuggcuggaccaauggucgcagguggcuuacuccuggccgcguacgugaugagcgggucgucagcugaucuuucucuggaaaaggccgcaaauguucagugggacgagauggccgauauaaccggaaguuccccuaucauugaagugaagcaggacgaggauggcagcuuuucuauccgggacgucgaggaaacgaacaugauuacauugcucgugaaacuggcucuaaucaccguaagcggucuguacccccuugcaauaccaaucacuaugacacucugguauauguggcaggucaagacccaacgcuccggggcccugugggaugugccgucaccuacugcgacacagaaagcugccuugagugagggaguuuacagaauuaugcagaggggcuuauucggcaagacccaggugggggucggaauccacauggaagguguguuccacacgauguggcauguuacucggggcagcgugauuugucacgagaccgggcgacuggaacccucuugggcagacgucagaaaugauaugaucuccuauggaggcgguuggcgccucggggacaaaugggauaaggaggaggacgugcaaguacuggccauagaaccaggaaagaaccccaaacaugugcagacaaagccuggccuuuuuaaaacccugacaggcgagauuggggcuguuacuuuggacuucaagccaggaaccucagguagucccaucaucaauaggaaaggcaaggucauugggcuauacggaaacggcguggugacgaaaagcggugauuaugucuccgccauaacacaggcagaacguaucggggagccugacuacgagguagaugaagacauuuuucggaagaagagacugacuaucauggaucuccacccgggagcuggcaaaaccaagaggauucugccaucuaucgugcgcgaggcccuuaaacgaagauuacggacacugauacucgcgcccaccaggguuguggccgcagaaauggaggaagcuuugcgcggccugccuauccguuaucagacuccagccgucaagucggagcauaccgggagagagauuguggaccucaugugccacgcuacauucacgacucggcugcuuagcucaaccaggguucccaauuacaaccugaucgugauggaugaagcacacuuuacagacccuuccagugucgccgcccgcggauacauuucuacccgaguggagaugggugaagcugcggcaaucuucaugacugccacaccgcccggcgcuaccgauccauuuccucaaagcaauucccccauagaggacauugaaagagagaucccagagcggucauggaacacgggguucgauuggaucacugacuaucagggaaaaacaguaugguuugugccuucuauuaaggccggcaaugacaucgcaaacugcuugaggaagagcgguaaaaagguuauacagcuaagucgcaaaaccuucgauaccgaauaccccaagacuaaacugacagacugggauuuugucgugaccacagacauuuccgagaugggggccaacuucagagcuggcagggugaucgauccacggcguugucucaagccggucauuuuaacugacggaccugaacgcguuauccuggcgggccccauaccagugacgcccgccagcgcagcucaacgaagagggaggauuggacggaauccugcccaggaggaugaccaguauguauucucuggugauccacuuaagaacgacgaagaucaugcacacuggaccgaggccaaaaugcugcucgacaauaucuacacacccgagggcaucauuccuacuuuguuugggccggaacgcgagaagacccaggcuaucgauggagaauucagacugaggggcgagcaacggaaaacauuuguggagcucaugcgaagaggugaccugccagucuggcuuucauauaagguggccuccgcggggauuaguuacaaagaccgcgaauggugcuucaccggcgagaggaacaaucagauacuagaagagaacauggaaguugagaucuggacucgggagggagaaaagaagaaacugcgucccaagugguuggaugcaagaguguaugccgacccuauggcuuuaaaagauuuuaaggaguucgccagcggcaggaaaucgauuacgcuggacauccucaccgaaaucgcuucucugcccacauaccuuuccagccgcgcaaagcuggcccucgauaauauugucauguugcauacuaccgagcgggggggacgagcuuaccagcacgcccugaacgaacuaccagagucacuggagacacucaugcuuguagcacuguuaggugcgaugaccgccggcauauuuuuguucuuuaugcaggggaagggaaucggcaaacugaguaugggucucauuacuaucgcuguggccucugggcugcuuuggguugcagaaauucaaccucaguggaucgcugccuccauaauccuggaguucuuucucaugguguugcugauucccgaaccagagaagcagagaacaccucaggacaaucaauuaaucuaugucauucuaacgauccugaccauaauuggccucaucgcagccaacgaaaugggacuuauugagaaaacuaagacagauuucggcuuuuaccaggugaaaaccgagaccacaauccuggacgucgauuugaggccggcuagcgcguggacucuguaugccguggcaacgaccauacucacacccaugcugcgccacacuaucgaaaauaccucagcuaaccuuagucucgccgccauugcaaaucaggcugccauccugaugggguugggaaagggcuggccacugcaucggauggacuuagguguuccucuacuggcgaugggguguuacagccaggugaaccccacaacccucacugcuucccuuguaaugcuguuggugcacuaugccauuaucggaccaggccugcaagcaaaagccacgagagaggcucagaagcguacagcagccgguauaaugaagaauccuaccgucgauggcauuacuguuaucgaccucgaacccaucucuuacgauccgaaauucgagaagcagcuggggcaagugaugcuuuuagcgcugugcgcuggacagcucuugcugaugaggaccacaugggccuucugugagguccuaacucuggcaaccggcccaauucucacacuuugggaagggaacccuggacgguuuuggaacacgaccaucgccgugagcacugcuaauauauuccgcggcuccuaucuggccggugcaggguuggcuuuuucacugauuaaaaacgcccagacaccccgaagaggaaccggcacuacaggugagacccucggcgaaaaguggaaaaggcagcugaauucuuuagaccggaaggaguucgaagaguacaagcgcagugggauccuugagguagacagaacggaagcgaaaucggcccugaaggauggaagcaaaauuaagcaugcaguguccaggggcucuucaaaaauccgauggauaguugagcgggggauggugaagccaaagggaaaagucguggaccucggcugcggucgugggggauggagcuacuauauggcuacccuaaagaacgucacagaagugaaaggcuacacuaagggcgggcccggacacgaggaaccuaucccgauggccaccuaugguuggaaucugguuaaauugcauuccggcguagauguguuuuacaagcccacagagcaagucgacacucugcucugugauauuggggagaguucuagcaacccaaccaucgaagagggaagaacacuucgcgugcugaagaugguugaaccuugguugucauccaaacccgaguucugcauuaaggugcugaauccuuauaugccaaccgucaucgaagagcucgagaaauuacagaggaagcacggcgguaaccuggugcgguguccccuuaguagaaauagcacucacgaaauguacuggguaucuggggcauccggaaacauugugucaagcguuaauacgacaucgaaaaugcugcuaaaccgcuuuaccacuaggcaucgaaagccuaccuaugagaaagacgucgaucucggcgcuggcacacggucugugaguacggaaaccgagaagccagacaugacuaucauagggagaaggcugcagcgcuugcaggaggaacacaaggagacauggcauuacgaucaagaaaaucccuaccguaccugggccuaucacggauccuacgaggccccgagcacugguucagcguccucuauggugaacggcgucguuaaacugcucacaaagccuugggacgugauuccaaugguaacccagcuugcuaugacagauacuacccccuucgggcagcagcggguguuuaaagaaaaggucgacacgagaaccccucaaccaaaacccggaacaaggauggugaugacuaccacagcaaauuggcugugggccuuacugggcaagaagaaaaacccgcgcuugugcacucgagaggaguucaucagcaagguucggaguaaugcugccaucggugcaguguuucaggaagagcagggguggaccuccgccagcgaagcugucaacgacucuagauucugggagcucguggauaaagaaagggcgcugcaccaagagggaaagugugagucaugcguauauaacaugaugggcaaacgcgaaaagaagcuaggcgaguuugggagagccaaaggaagucgggcaauuugguacauguggcuuggugcuagguuccuggaauucgaggcccucggcuuucugaaugaagaccauugguucgggcgugagaacuccuggagcggaguugagggcgaagguuugcaccgacugggguauauacucgaggaaaucgauaagaaagacggagaucuuauguacgcagacgauacggccggcugggacacacgcauuaccgaggaugaccugcagaaugaggaauuaaucacugagcagauggcuccucaucacaagauucuggccaaagcgaucuuuaaguugacauaucagaacaagguggucaaagugcucagacccaccccacggggcgcagugauggauauaaucucuaggaaggaccaacgcgggucgggacaggucgguacuuacggccugaauaccuucacaaacauggaaguucagcuaauuagacagauggaggccgaaggggugaucacgcaagaugacaugcagaauccuaaaggacuuaaggagcggguagagaaauggcugagggaaugcggcguggaccgacucaagcguauggcuauuucaggugaugacugugucgugaaaccccuggaugagagauuugggaccagcuuguuauuccugaacgacaugggaaagguucgcaaggauaucccacagugggaacccuccaaaggcuggaagaauuggcaggaggugccuuuuugcagucaucacuuccacaaaauauuuaugaaggacggccggucucucgucgugccauguaggaaccaagaugaacuuauugggagagcccgcaucagccagggagcagguuggucccugcgggagacugcuugccuaggcaaagccuacgcucagauguggucacugauguauuuccauaggcgagaccucagauuggccaguauggcaaucuguucugcgguaccgacagagugguuucccaccagccggacuacaugguccauucacgcccaucaccaguggaugaccacggaagauaugcugaagguuuggaauaggguguggauagaggacaacccuaauaugaucgauaagacaccaguccacucaugggaagacauucccuaccuugggaaacgcgaggaccuguggugcggaagccucaucggcuuaucuucccgugcuaccugggccaagaacauucauacugcaaucacccaagugagaaaucugauagguaaagaagaguauguugauuacaugccugugaugaagcgauauagugcuccaagcgagucggaaggggucuuguga

SEQ ID NO: 15804 - RNA, 9867 nt, Artificial Sequence
  derived and/or modified CDS sequence (opt3) from DENV-4__HQ332176__SS-prME
agcaccaucacacugcucugccuuauucccacugugauggccuuccaccuguccacgagagacggcgagccuuugaugauagucgcuaggcaugaacgggggcgcccauuacuguuuaagaccacagagggaaucaacaaauguacucuaauugcaauggaucucggugaaaugugcgaggacaccguuacauacaaguguccgcugcuugugaauaccgaacccgaggauaucgacugcugguguaaccugacuucuacauggguaauguauggcaccugcacgcagucaggggagcgacguagagaaaaaaggaguguggccuugacuccucacagcggaaugggccucgagacccgggcggaaacauggauguccucugagggugcuuggaagcaugcccaacgcgucgagucguggauucugagaaauccaggguucgcacugcucgccggauuuauggcuuacaugaucggccagacuggcauacagaggaccguguucuuuguuuuaaugaugcugguggcacccucauaugggaugcggugugucggaguggguaaccgcgauuucguagaaggcguuagcgggggagccuggguggaccuugucuuggagcacggcgguugcgugacaaccauggcucaggggaaaccuacgcuggauuuugaacuaacuaagacaaccgccaaggagguggcgcuccugcgaacuuacuguaucgaagcacuuauuaguaauaucacaaccgccacgagaugcccaacccaaggagagcccuaucugaaagaggaacaggaccagcaguacauuuguaggcgggaugucguugaccguggcuggggcaacgggugcggauuguucgguaagggcggggugguaacaugcgcuaaauuuuccuguucuggaaagaucacuggcaaucucgugcaaauagagaaccuggaauauaccgucgugguuacagugcauaauggugauacucacgccgucgggaacgacaccagcaaucacggcgugacagcaaccauuacuccucgcuccccaucaguagagguuaaauuaccggauuacggagaacugacgcucgacugcgagcccagaaguggcaucgacuucaacgagaugauucuuaugaagaugaagaaaaagacauggcuggugcauaaacagugguuuuuggaucuaccucugccauggaccacuggggcugacaccagcgaaguccacuggaauuacaaggagaggauggugacauucaaagucccccaugccaagcggcaggaugugaccguucucggaucucaggaaggugcgaugcacuccgcccuggcaggcgcuacugagguggacucaggggauggaaaccacauguuugccggccaucuuaaauguaagguacgaauggaaaagcugcgcaucaaagguaugagcuauacaaugugcagugggaaguucucuaucgacaaagagauggcugagacgcaacacggcaccacugucgugaagguuaaauacgaaggagccggcgcaccuuguaaggugccaauugagauaagagaugucaauaaggaaaaagugguagggagggugaucuccgccacacccuuggcugagaacaccaacagcguuacaaauauugagcucgaaccgccuuucggagacucguauaucgucauaggugugggcaacucugcgcugacuuuacauugguuucggaagggguccucaauuggaaaaauguucgagaguaccuaccgcggcgcaaagagaauggccauccugggugaaacggcuugggauuuugggagcgugggcggacuauucaccucccucggcaaagccguccaccagguuuuugggucuguguauacaacuauguucggaggcgugagcuggaugaucaggauucugaucgguuuucuuguauuguggauugggaccaauucacguaacacaaguauggcaaugacuugcauagccgucggaggcaucacccuguuccucgguuuuacggugcaggcugacaugggcuguguuguguccuggagcgggcgggagcugaagugcggaucuggcauuuucgucguggauaauguucauacauggaccgaacaauacaaguuucagcccgagucaccagcccgacuugcaagugcgauccugaacgcucacaaagacgggguguguggaaucagaagcacuacaagguuggagaauguaauguggaagcagauuaccaacgaacucaauuauguccugugggagggcggucacgacuuaacugugguggccggggaugucaaaggaguucugaccaagggcaaacgcgcacuaacaccucccgccuccgaccucaaguacucuuggaagacgugggguaaagcuaagauauucaccccagaagcccggaacucgacuuuucugaucgauggccccgacacaagcgagugcccuaaugaaagaagggcauggaacuccuucgagguggaggauuacggguucggaauguuuaccacaaauauuuggaugaaauuccgcgaaggcucaagugagguaugugaccaucgacuuaugucugcugccaucaaggaucagaaagcggugcacgccgacaugggguauuggauugaaagcuccaagaaccaaacuuggcagaucgagcgggcuucauugauagaagucaaaaccugccuguggccaaagacgcauacacucuggagcaauggagugcuggagucucagauguuaaucccgaaguccuacgcaggccccuuuagucagcacaacuaucgucaagguuacgccacccagacuguugggccuuggcaccugggaaaacuugagauugauuucggcgaaugcccagguaccacagugacuauccaggagaacugugaccauagaggccccagcuugaggaccacaacggcuucugggaagcucgucacccaguggugcugucgcuccugcacuaugccuccacugcgguuucuaggagaagauggcuguugguaugggauggagauuagaccccugucagagaaagaagagaauauggugaagagucaaguuacagccggacagggcaccagcgaaacuuucucgaugggucuccugugccuuacauuguuuguggaggaaugucugaggcgacgcgucacccggaaacacaugaucuuagcaguagugauaacgcucugcgcgauuauccuggggggacuuacuuggauggaccuguugagagcccucauuaugcugggcgauaccauguccggcaggaucgggggacagacacaucuagcuauaauggccguuuucaagaugucuccggguuacgugcugggcgucuuucuccguaagcugaccagccgcgagacugcacuuauggugaucgggauggcuaugacaaccacauugucaauuccucacgaccugauggaguuaaucgacggaauuagucucggccugauccuucugaaaauaguaacucaguucgauaacacccaaguggguacgcuagcccucucccugacauuuauucggucuaccaugagcuuggucauggcauggagaacuaucauggccguucuguucguggugaccuuaaucccacucuguaggacauccugccugcagaagcagucacauugggucgaaauuacugcucuuauccugggggcgcaagccuugcccguguaucucaugacccugaugaaaggagcaagccgacggaguuggccucuaaaugagggcauuauggcuguuggccugguaucucuucucggguccgcccuguugaagaacgacgugccccuggccggaccaauggucgcugguggcuuacuccuggcagccuacgugaugagcgggucgucagcggaucuuucucuggaaaaagcugccaauguucagugggacgagauggcagauauaacgggaaguuccccuaucauugaagugaagcaggacgaggauggcagcuuuucuauccgcgacgucgaggaaacaaacaugauuaccuugcucgugaagcuggcccuaaucacuguaagcggucuguacccccuugcuauaccaaucacaaugacccucugguauauguggcaggucaaaacucaaagauccggggcacugugggaugugccgucaccugccgcgacacagaaggcugccuugagugagggaguuuacaggauuaugcagcggggcuuauucggcaaaacccaggugggggucggaauccacauggaagguguguuccacacgauguggcauguuacucgaggcagcgugauuugucacgagaccgggagacuggaacccucuugggcagacguccgcaaugauaugaucuccuauggaggcgguuggaggcucggggacaagugggauaaagaggaggacgugcaaguacuggccauagaaccaggaaagaaccccaagcaugugcagacaaaaccuggccuuuuuaagacccugacaggcgagauuggggcuguuacuuuggacuucaaaccaggaaccucagguagucccaucaucaaucguaagggcaaagucauugggcuauacggaaacggcguggugacgaagagcggugauuaugucuccgccauaacacaggcagaacggaucggggagccugacuacgagguagaugaagacauuuuuagaaaaaagaggcugacuaucauggaucuccacccgggagcuggcaagaccaaacgcauucugccaucuaucgugcgagaggcccuuaagagacgguuaaggacacugauacucgcgcccacccgcguuguggccgcagaaauggaggaagcuuugcguggccugccuaucagauaucagacuccagccgucaaaucggagcauaccgggcgggagauuguggaccucaugugccacgcuacauucacgacuaggcugcuuagcucaacccgcguucccaauuacaaccugaucgugauggaugaagcacacuuuacagacccuuccagugucgccgcccgaggauacauuucuaccagaguggagaugggugaagcugcggcaaucuucaugacugccacaccgcccggcgcuaccgauccauuuccucaaagcaauucccccauagaggacauugaacgggagaucccagagaggucauggaacacgggguucgauuggaucacugacuaucagggaaagacaguaugguuugugccuucuauuaaagccggcaaugacaucgcaaacugcuugcgcaagagcgguaagaaaguuauacagcuaaguagaaagaccuucgauaccgaauaccccaaaacuaagcugacagacugggauuuugucgugaccacagacauuuccgagaugggggccaacuucagggcuggccgggugaucgauccacgucgcugucucaaaccggucauuuuaacugacggaccugaacgaguuauccuggcgggccccauaccagugacgcccgccagcgcagcucaaagaagggggcggauuggacgcaauccugcccaggaggaugaccaguauguauucucuggugauccacuuaagaacgacgaagaucaugcacacuggaccgaggccaagaugcugcucgacaauaucuacacacccgagggcaucauuccuacuuuguuugggccggaaagagagaaaacccaggcuaucgauggagaauucaggcugcggggcgagcaacgaaagacauuuguggagcucaugagacgcggugaccugccagucuggcuuucauauaaaguggccuccgcggggauuaguuacaaggacagggaauggugcuucaccggcgagcggaacaaucagauacuagaagagaacauggaaguugagaucuggacucgugagggagaaaaaaagaagcugagacccaaaugguuggaugcaaggguguaugccgacccuauggcuuuaaaggauuuuaaagaguucgccagcggccgcaagucgauuacgcuggacauccucaccgaaaucgcuucucugcccacauaccuuuccagccgggcaaaacuggcccucgauaauauugucauguugcauacuaccgagcgagggggaagagcuuaccagcacgcccugaacgaacuaccagagucacuggagacacucaugcuuguagcacuguuaggugcgaugaccgccggcauauuuuuguucuuuaugcaggggaagggaaucggcaagcugaguaugggucucauuacuaucgcuguggccucugggcugcuuuggguugcagaaauucaaccucaguggaucgcugccuccauaauccuggaguucuuucucaugguguugcugauucccgaaccagagaaacagaggacaccucaggacaaucaauuaaucuaugucauucuaacgauccugaccauaauuggccucaucgcagccaacgaaaugggacuuauugagaagacuaaaacagauuucggcuuuuaccaggugaagaccgagaccacaauccuggacgucgauuugcgcccggcuagcgcguggacucuguaugccguggcaacgaccauacucacacccaugcugcggcacacuaucgaaaauaccucagcuaaccuuagucucgccgccauugcaaaucaggcugccguucugaugggguugggaaaaggcuggccacugcauagaauggacuuaggugugccucuacuggcgaugggguguuacagccagguaaaccccacaacccucacugcuucccuugugaugcuguugguccacuaugccaucauuggaccaggccugcaagcaaaggccacgcgugaggcucagaaaaggacagcagccgguaucaugaagaauccuaccguugauggcauaacugugauugaccucgaacccaucucuuacgauccgaaguucgagaaacagcuggggcaagucaugcuuuuagugcugugcgcgggacagcucuugcugaugcggaccacaugggcuuucugugagguacuaacucuggccaccggcccaauccucacacuuugggaagggaacccuggacgcuuuuggaacacgaccauugcagugagcacugccaauaucuuccgaggcuccuaucuggcuggugccggguuggcauuuucacugauaaagaacgcucagacacccagaaggggaaccggcacuacaggugagacccucggcgaaaaauggaagcggcagcugaauucuuuagaccgcaaagaguucgaagaguacaagagaagugggauucuugagguugacaggacggaagccaagucggcgcugaaagauggaagcaagaucaaacaugccgugucccgaggcucuucaaagauucgguggaucgucgagcgugggauggugaaaccaaagggaaaggucguggaccucggcugcgguagagggggauggagcuacuauauggcaacccuaaaaaacguuacagaaguaaagggcuacacuaaaggcgggcccggacacgaggaaccuauaccgauggcuaccuaugguuggaaucuggugaaguugcauuccggcgucgauguguuuuacaaacccacagagcaaguugacacucugcucugugauaucggggagaguucuagcaacccaaccauugaagagggacgcacacuuagggugcugaagauggucgaaccuugguugucauccaagcccgaguucugcaucaaagugcugaauccuuauaugccaaccguaauugaagagcucgagaaguuacagcggaaacacggcgguaaccuggugagauguccccuuagucgcaauagcacucacgaaauguacuggguuucuggggccuccggaaacaucgucucaagcgugaauacgacaucgaagaugcugcuaaacagguuuaccacucgacaucggaaaccuucuuaugagaaggacguggaucucggcgcaggcaccagaagugucuccacagaaacggagaaaccagacaugaccauuaucgggaggcgccugcagcguuugcaggaggaacacaaggagacuuggcauuacgaucaagaaaaucccuaccggacaugggcuuaucacggaagcuacgaggccccgucaaccgguuccgccucuagcaugguuaacggcgugguaaagcugcucacuaaaccuugggacgugauaccaauggucacacagcuugcgaugaccgauacaacucccuucgggcagcagagaguguuuaaggaaaaaguugacaccaggacgccucaaccaaagcccggaacccgcauggugaugacaacuaccgcuaauuggcugugggcauuacugggcaaaaagaagaacccgcgauugugcacacgggaggaguucauuaguaaagucagauccaaugccgcuaucggugccguguuucaggaagagcagggguggacuagcgcaucugaagccguaaacgacucaagguucugggagcucguugauaaggaacgcgcucugcaccaagagggaaaaugugagaguugcguguauaacaugaugggcaagagagaaaaaaagcuaggcgaguuugggcgggcgaagggauccagggccaucugguacauguggcuuggugcacguuuccuggaauucgaggcucucggcuuucugaaugaagaccauugguucgggcgagagaacagcuggucuggagucgagggcgaagguuugcaccgccugggguauauucucgaggaaauagauaaaaaggacggagaucuuauguacgccgacgauaccgcaggcugggacacgagaaucacagaggaugaccugcagaaugaggaauuaauuaccgagcagauggccccucaucacaaaauccuggcuaaggccauuuuuaaauugacuuaucagaacaagguggugaagguccuccggcccacaccaaggggcgcgguuauggauaucauaucgcgcaaagaccaaagagggucaggacagguggguaccuacggccugaauacuuucaccaacauggaaguacagcuaauccggcagauggaggcagaaggggugauuacacaagaugacaugcagaauccuaagggacuuaaagagagggucgagaaguggcugcgagaaugcggcguggaccgucucaaaagaauggccaucagcggugaugacuguguugugaagccccuggaugagcgcuuugggacguccuuguuauuccugaacgacaugggaaaaguccggaaggauauuccacagugggaacccaguaagggcuggaaaaauuggcaggaggugccuuuuugcucucaucacuuccacaagaucuuuaugaaagacggcaggagccucguaguuccauguagaaaccaagaugaacuuauagggcgcgcucggauuucccagggagccgguuggucacugagggagaccgcaugccuaggcaaggcuuacgcccagauguggagucugauguauuuccaucgaagagaccuccgguuggcuucuauggccaucuguagcgcagugccgacugagugguuucccacauccaggaccacuuggucaauccacgcgcaucaccaguggaugacaaccgaagauaugcugaaagucuggaaucgcguguggauugaggacaacccuaauaugauagauaagacgccaguucacagcugggaagacauccccuaccuugggaagcgugaggaccuguggugcggaucucucauuggcuuauccaguagagccacaugggcuaaaaacauccauaccgccauuacucaagugcgaaaucugaucgguaaggaagaguaugucgauuacaugccugugaugaaaagguauagcgcaccaucggaguccgaagggguauuguga

SEQ ID NO: 15805 - RNA, 9867 nt, Artificial Sequence
  derived and/or modified CDS sequence (opt3) from DENV-4__HQ332174__SS-prME
agcaccaucacacugcucugccuuauucccacugccauggcuuuccaccuguccacgagagacggcgagccuuugaugauaguggcaaagcaugaaagggggcggccauuacuguuuaaaaccacagagggaaucaacaaguguacucuaauugccauggaucucggugaaaugugcgaggacaccgucacauacaaauguccgcugcuuguuaauaccgaacccgaggauaucgacugcugguguaaccugacuucuacaugggugauguauggcaccugcacgcagucaggggagcgccgacgugaaaagagaaguguagcguugacuccucacagcggaaugggccucgagaccagggcugaaacauggauguccucugagggugccuggaaacaugcacaacggguggagucguggauucugcgcaauccaggguucgcccugcucgcuggauuuauggcauacaugaucggccagacuggcauacagagaaccgucuucuuuguguuaaugaugcugguugcccccucauaugggaugaggugugugggagucgguaaccgggauuucguggaaggcguaagcgggggagcuuggguugaccuuguguuggagcacggcgguugcgucacaaccauggcccaggggaagccuacgcuggauuuugaacuaacuaagacaaccgcgaaagagguggcacuccugcgcacuuacuguaucgaagcccuuauuaguaauaucacaaccgcuacgcgaugcccaacccaaggagagcccuaucugaaggaggaacaggaccagcaguacauuuguagaagggauguggucgaccggggcuggggcaacgggugcggauuguucgguaaaggcgggguugugacaugcgccaaguuuuccuguucuggaaaaaucacuggcaaucucguacaaauagagaaccuggaauauaccguggucgugacaguucauaauggugauacucacgcaguggggaacgacaccagcaaucacggcgucacagcuaccauuacuccucguuccccaucaguggagguaaaguuaccggauuacggagaacugacgcucgacugcgagccccgcaguggcaucgacuucaacgagaugauucuuaugaagaugaaaaagaaaacauggcugguucauaagcagugguuuuuggaucuaccucugccauggaccacuggggccgacaccagcgaagugcacuggaauuacaaagagagaauggucacauucaaggugccccaugcgaaaaggcaggaugucaccgugcucggaucucaggaaggugccaugcacuccgcacuggcuggcgccacugagguugacucaggggauggaaaccacauguuugcuggccaucuuaaguguaaggugcggauggaaaaacugcgaaucaaggguaugagcuauacaaugugcagugggaaauucucuaucgacaaggagauggccgagacgcaacacggcaccacuguagucaaagugaaguacgaaggagcaggcgccccuuguaagguuccaauugagauacgcgaugugaauaaagaaaaggucguggggagaguaaucuccgcuacacccuuggcggagaacaccaacagcgugacaaauauugagcucgaaccgccuuucggagacucguauaucguuauaggugucggcaacucugcacugacuuuacauugguuuaggaaaggguccucaauuggaaagauguucgagaguaccuaccggggcgccaaacgcauggcuauccugggugaaacggccugggauuuugggagcgugggcggacuauucaccucccucggcaaggcagugcaccaggucuuugggucuguuuauacaacuauguucggaggcgugagcuggaugaucagaauucugaucgguuuucuuguguuguggauugggaccaauucaaggaacacaaguauggccaugacuugcauagcuguaggaggcaucacccuguuccucgguuuuacgguccaggccgacaugggcugugugguuuccuggagcgggcgugagcugaagugcggaucuggcauuuucguggucgauaaugugcauacauggaccgaacaauacaaauuucagcccgagucaccagcacggcuugcgagugcuauccugaacgcccacaaggacgggguuuguggaauccgaagcacuacaagauuggagaaugugauguggaaacagauuaccaacgaacucaauuauguacugugggagggcggucacgacuuaacugucguggcaggggaugugaagggaguccugaccaaaggcaagagggcccuaacaccucccgcuuccgaccucaaguacucuuggaaaacgugggguaaggccaaaauauucaccccagaagcacgcaacucgacuuuucugaucgauggccccgacacaagcgagugcccuaaugaacggagagcuuggaacuccuucgagguugaggauuacggguucggaauguuuaccacaaauauuuggaugaaguucagggaaggcucaagugaggugugugaccaucgccuuaugucugccgcgaucaaagaucagaaggccguacacgcugacaugggguauuggauugaaagcuccaaaaaccaaacuuggcagaucgagcgagcaucauugauagaagugaagaccugccuguggccaaagacgcauacacucuggagcaauggaguccuggagucucagauguuaaucccgaaauccuacgccggccccuuuagucagcacaacuaucggcaagguuacgcuacccagacuauggggccuuggcaccugggaaagcuugagauugauuucggcgaaugcccagguaccacagugacuauccaggagaacugugaccaucguggccccagcuugagaaccacaacggccucugggaaacucguuacccaguggugcuguagguccugcacuaugccuccacugcgcuuucuaggagaagauggcuguugguaugggauggagauucggccccugucagagaaggaagagaauauggugaaaagucaagucacagcaggacagggcgcgagcgaaaccuucucgaugggucuccugugccuuacuuuguuuguggaggaaugucugagaaggcgaguuacacgcaagcacaugaucuuagccguggucauaacccucugcgcuauuauccuggggggacuuacguggauggaccuguugcgggcccucauuaugcugggcgauacuauguccggcagaaucgggggacagacccaucuagcaauaauggcuguauucaagaugucuccggguuacgugcugggcguuuuucucaggaaacugacaagccgugagaccgcccuuauggugaucgggauggcaaugacuacaaccuugucaauuccucacgaccugauggaguuaaucgacggaauuagucucggccugauccuucugaagauagucacacaguucgauaacacucaaguggguacccuagcccucucccugacguuuauucgcucuacaaugagcuugguaauggcuuggcggaccaucauggcggugcuguucgucguuacuuuaaucccacucuguagaaccuccugccugcagaaacagucacauuggguggaaauuacagcccuuauccugggggcacaagcuuugcccguguaucucaugacucugaugaagggagccagcaggcgaaguuggccucuaaaugagggcauuauggccgucggccuggugucucuucucggguccgcucuguugaaaaacgacguuccccuggcaggaccaaugguagccgguggcuuacuccuggcggcuuacgugaugagcgggucgucagccgaucuuucucuggaaaaggcagccaauguccagugggacgagauggcugauauaaccggaaguuccccuaucauugaagugaagcaggacgaggauggcagcuuuucuauccgggacguugaggaaacgaacaugauuacauugcucgugaaacuggcacuaaucaccgucagcggucuguacccccuugccauaccaaucacuaugacacucugguauauguggcaggugaagacccaacgcuccggggcgcugugggauguaccgucaccugcugccacucagaaagcagccuugagugagggagucuacagaauuaugcagaggggcuuauucggcaagacacagguggggguuggaauccacauggaagguguguuccacaccauguggcaugucacgcggggcagcgugauuugucacgagacugggcgacuggaacccucuugggcugacguuagaaaugauaugaucuccuauggaggcgguuggcgccucggggacaaaugggauaaggaggaggacgugcaaguccuggccauagaaccaggaaagaaccccaaacaugugcagaccaagccuggccuuuuuaaaacacugaccggcgagauuggggcaguaacauuggacuucaagccaggaacuucagguagucccaucaucaauaggaaaggcaaggugauugggcuauacggaaacggcguugucaccaaaagcggugauuauguguccgcuauaacgcaggccgaacguaucggggagccugacuacgagguggaugaagacauuuuucggaagaagagacugacaaucauggaucuccacccgggagcgggcaaaacuaagaggauucugccaucuaucguccgcgaggcccuuaaacgaagauuacggacccugauacucgcacccacaaggguaguggcugccgaaauggaggaagcuuugcgcggccugccuauccguuaucagaccccagcaguuaagucggagcauacugggagagagauuguggaccucaugugccacgccaccuucacaacgcggcugcuuagcucaacuaggguccccaauuacaaccugaucgugauggaugaagcccacuuuaccgacccuuccaguguugcugcgcgcggauacauuucuacacgaguggagaugggugaagcagccgcuaucuucaugaccgccacuccgcccggcgcaacagauccauuuccucaaagcaauucccccauagaggacauugaaagagagaucccagagcggucauggaacaccggguucgauuggaucacggacuaucagggaaaaacugucugguuugugccuucuauuaaggccggcaaugacaucgcuaacugcuugaggaagagcgguaaaaagguaauacagcuaagucgcaaaacauucgauaccgaauaccccaagaccaaacugacugacugggauuuugugguuacaaccgacauuuccgagaugggggcgaacuucagagccggcagggucaucgauccacggcguugucucaagccggugauuuuaacagacggaccugaacgcgugauccuggcaggccccauaccagucacucccgcuagcgccgcacaacgaagagggaggauuggacggaauccugcccaggaggaugaccaguauguuuucucuggugauccacuuaagaacgacgaagaucaugcucacuggacggaggccaaaaugcugcucgacaauaucuacacccccgagggcaucauuccuacauuguuugggccggaacgcgagaagacucaggcgaucgauggagaauucagacugaggggcgagcaacggaaaaccuuuguggagcucaugcgaagaggugaccugccaguauggcuuucauauaagguggcauccgccgggauuaguuacaaagaccgcgaauggugcuucacaggcgagaggaacaaucagauacuagaagagaacauggaagucgagaucuggacccgggagggagaaaagaagaaacugcgucccaagugguuggaugcuagaguguaugccgacccuauggcuuuaaaagauuuuaaggaguucgcaagcggcaggaaaucgauuacucuggacauccucacggaaaucgccucucugcccaccuaccuuuccagccgcgcuaagcuggcccucgauaauauuguuauguugcauacaacugagcgggggggacgagcauaccagcacgcgcugaacgaacuaccagagucacuggagacccucaugcuuguggcccuguuaggugcuaugacagccggcauauuuuuguucuuuaugcaggggaagggaaucggcaaacugaguaugggucucauuaccaucgcagucgcuucugggcugcuuuggguagccgaaauucaaccucaguggaucgcagccuccauaauccuggaguucuuucucaugguguugcugauucccgaaccagagaagcagagaacuccucaggacaaucaauuaaucuauguuauucuaacaauccugacgauaauuggccucaucgcugcgaacgaaaugggacuuauugagaaaaccaagacugauuucggcuuuuaccaggccaaaacagagaccaccauccuggacguggauuugaggccggcaagcgcuuggacacuguaugccgucgccacuacgauacucacccccaugcugcgccacacaaucgaaaauacuucagcaaaccuuagucucgcugccauugcgaaucaggcugccgugcugaugggguugggaaagggcuggccacugcaucggauggacuuaggugucccucuacuggcaaugggguguuacagccaggugaaccccaccacacucaccgccucccuuguuaugcuguuggugcacuaugcuaucauuggaccaggccugcaagcaaaagccacuagagaggcgcagaagcguacggcugccgguaucaugaagaauccuacaguagauggcauaaccgugauugaccucgaacccaucucuuacgauccgaaauucgagaagcagcuggggcaagucaugcuuuuaguucugugcgcaggacagcucuugcugaugaggacuaccugggccuucugugaggugcuaacacuggcuacuggcccaauccucacccuuugggaagggaacccuggacgguuuuggaacacaacgauugccgucagcaccgcaaauaucuuccgcggcuccuaucuggcuggugccggguuggcguuuucacugauaaaaaacgcccagacuccccgaagaggaacaggcaccacuggugagacacucggcgaaaaguggaaaaggcagcugaauucuuuagaccggaaggaguucgaagaguacaagcgcagugggauucuugagguggacagaaccgaagcaaaaucggcucugaaggauggaagcaaaaucaagcaugccguauccaggggcucuucaaaaauucgauggaucguggagcgggggaugguuaagccaaagggaaaaguggucgaccucggcugcggucgugggggauggagcuacuauauggcaacgcuaaagaacgugaccgaagucaaaggcuacacaaagggcgggcccggacacgaggaaccuauaccgauggcuacuuaugguuggaaucuggugaaauugcauuccggcguugauguauuuuacaagcccaccgagcaaguggacacacugcucugugauaucggggagaguucuagcaacccaacuauugaagagggaagaacccuucgcguccugaagaugguggaaccuugguugucauccaaacccgaguucugcaucaagguucugaauccuuauaugccaacagugauugaagagcucgagaaauuacagaggaagcacggcgguaaccugguccgguguccccuuaguagaaauagcacccacgaaauguacugggugucuggggccuccggaaacaucguaucaagcgugaauacuacgucgaaaaugcugcuaaaccgcuuuacaaccaggcaucgaaagccuacuuaugagaaagacguugaucucggcgccggcacccggucugucaguacagaaacggagaagccagacaugaccauuaucgggagaaggcugcagcgcuugcaggaggaacacaaggagacuuggcauuacgaucaagaaaaucccuaccguacaugggcguaucacggauccuacgaggcuccgagcaccgguucagcauccucuauggugaacggcguggucaaacugcucacuaagccuugggacguuauaccaauggugacacagcuugccaugaccgauacaacucccuucgggcagcagcggguauuuaaagaaaagguggacaccagaacgccucaaccaaaacccggaaccaggacagucaugacuaccacagcuaauuggcugugggccuuacugggcaagaagaaaaacccgcgcuugugcacucgagaggaguucauuagcaaggugcggaguaaugcagccaucggugcuguuuuucaggaagagcagggguggaccuccgcgagcgaagccgugaacgacucuagauucugggagcucgucgauaaagaaagggcacugcaccaagagggaaagugugagucaugcguguauaacaugaugggcaaacgcgaaaagaagcuaggcgaguuugggagagcuaaaggaagucgggccaucugguacauguggcuuggugcaagguuccuggaauucgaggcccucggcuuucugaaugaagaccauugguucgggcgugagaacuccuggagcggaguagagggcgaagguuugcaccgacugggguauauucucgaggaaauagauaagaaagacggagaucuuauguacgcugacgauacggccggcugggacacacgcaucaccgaggaugaccugcagaaugaggaauuaauuacugagcagauggcgccucaucacaagauccuggcaaaagccauuuuuaaguugacauaucagaacaagguugugaaaguccucagacccaccccacggggcgcugugauggauaucauaucuaggaaggaccaacgcgggucgggacagguggguacuuacggccugaauaccuucacaaacauggaaguccagcuaaucagacagauggaggccgaagggguuauuacgcaagaugacaugcagaauccuaaaggacuuaaggagcggguggagaaauggcugagggaaugcggcguagaccgacucaagcguauggcaaucucaggugaugacuguguggucaaaccccuggaugagagauuugggaccagcuuguuauuccugaacgacaugggaaaggugcgcaaggauauuccacagugggaacccuccaaaggcuggaagaauuggcaggagguuccuuuuugcagucaucacuuccacaaaaucuuuaugaaggacggccggucucucguggucccauguaggaaccaagaugaacuuauagggagagcucgcauuagccagggagccgguuggucccugcgggagacugcuugccuaggcaaagccuacgcacagauguggucacugauguauuuccauaggcgagaccucagauuggcgaguauggccaucuguucugcugugccgacagagugguuucccaccagccggacuacaugguccauccacgcccaucaccaguggaugaccacggaagauaugcugaagguauggaauaggguuuggauugaggacaacccuaauaugauagauaagacaccagugcacucaugggaagacauccccuaccuugggaaacgcgaggaccuguggugcggaagccucauuggcuuaucuucccgugcaaccugggcuaagaacauccauacugccauuacccaagucagaaaucugaucgguaaagaagaguauguggauuacaugccuguuaugaagcgauauagugcaccaagcgagucggaagggguguuguga

SEQ ID NO: 15806 - RNA, 9867 nt, Artificial Sequence
  derived and/or modified CDS sequence (opt3) from DENV-4__KT026308__SS-prME
agcaccaucacucugcucugccuuauucccacugugauggccuuccaccuguccacgagagacggcgaaccuuugaugauagucgcuaagcaugaaagagggcggccauuacuguuuaaaaccacugaggggaucaacaaguguacucuaauugcaauggaucucggugaaaugugcgaggacaccguuaccuacaaauguccgcugcuugugaauaccgaacccgaggauaucgacugcugguguaaccugacuucuaccugggugauguauggaaccugcacgcagucaggggagcgccgacgugaaaagagaaguguggccuugacuccucacagcggaaugggccucgagaccagagcggaaacauggauguccucugagggugcuuggaaacaugcccagcgggucgagucguggauucugcgcaauccaggguucgcacugcucgccggauuuauggcuuacaugaucggccagacuggcauucagagaaccguguucuuuaucuuaaugaugcugguugcacccucauaugggaugaggugugugggagucgguaaccgggauuucguggaaggcguaagcgggggagccuggguugaccuuguguuggagcacggcgguugcgucacaaccauggcucaggggaagccuacgcuggauuuugaacuaauuaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauauguagaagggauaugguggaccggggcuggggcaacgggugcggacuguucgguaaaggcggggucguuaccugcgcuaaguuuucuuguuugggaaaaauuacaggcaaucucgugcaaaucgagaaccuggaauauacuguaguggucaccgugcauaauggugauacacacgccguugggaacgacacuagcaaucacggcgugaccgcaacaauuaccccucguuccccaucagucgaggugcaguuaccggauuacggagaacugacucucgacugcgagccccgcaguggcaucgacuucaacgagaugauccuuaugaagaugaagacgaaaacauggcugguacauaagcagugguuuuuggaucuaccucugccauggaccacuggggcugacacccucgaaguucacuggaaucauaaagagagaauggugacauucaaggucccccacgccaaaaggcaggaugugaccguccugggaagccaagaaggugcgaugcacucugcccuugcaggcgcuacugagguggacuccggggauggaaaccauauguuugccggccaccugaaguguaaaguucggauggaaaaguugcgaauuaaggguaugucauacacaaugugcagcgggaaauucaguauagacaaggagauggcugagacgcagcauggcaccacugugguaaaagucaaguaugaaggaacaggcgccccuuguaaagugccaaucgagauucgcgauguuaauaaggaaaagguggucgggagaaucauaucuuccacccccuucgcagagaacacaaacagcgugacuaauauugagcucgaaccgccuuuuggagacucguacaucguaaucggugugggcgauucugcccugaccuuacacugguucaggaaaggguccucaauuggaaagauguuugagaguacguaucggggcgcuaaacgcauggcgauccugggugaaaccgcaugggacuucgggagcguuggcggacuacucacaucccugggcaaggccguccaucagguguuugggucuguguacacuaccauguucggaggcgucagcuggaugguuaggauucuuauagguuugcuggugcucuggaucgggacaaacucaaggaauacaaguauggcuauguccugcauugccgugggaggcaucacccuguuucuugguuucacgguacacgcagauaugggcugugucgugagcuggucugggaaagagcugaagugcggaucaggcaucuuuguuauugacaacgugcacacauggaccgaacaauauaaguuccagcccgagaguccagcccguuuggcuagcgccauacucaaugcacauaaagagggggucuguggaauccgguccacuacacgacuggaaaacgugauguggaagcagauuaccaaugaguuaaacuacguucugugggaaggcggucacgaccuaacugugguagcgggggaugucaaaggagugcucucuaagggcaaaagagcucuggccccucccgugaaugaccuuaaguauucguggaagaccugggguaaagcaaagaucuuuacaccagagacgaggaacagcaccuucuuggucgauggccccgacacuuccgaaugcccuaaugagcgccgggccuggaacuuucuggagguugaagauuacggguucggaauguucacaaccaauauuuggaugaaauuuagagagggcucaagugaagugugugaccauaggcucaugucugcugccaucaaggaucagaaagcaguacacgcugacaugggguacuggauagagagcuccaagaaccaaacauggcagaucgaaaaagccucacugauugaggugaagacuugcuuauggccaaagacccacacgcuguggagcaauggaguccuugagucucagauguugaucccgaaagcguaugccggccccauuucccagcauaacuaccgccaagguuaugcuacacagaccgcagggccuuggcaccucggaaagcuggaaaucgauuucggcgagugcccagguacuaccgugacaguucaggaagacugugaucaucgaggccccagucuacggacuaccacagccagcgggaaacuggugacgcaguggugcugucguucuugcaccaugccuccacucagauuucugggagaggacggcuguugguacgggauggagauaaggccccuuaacgaaaaggaggaaaauauggucaaaucccaagugucagcuggacacggcacaagugagacauucagcauggguuugcugugcuuaacccucuuuguugaagagugucugcgccggagagugacuaggaagcauaugauucuugucguagugacaacccugugcgccaucauucuaggcgggcucacguggauggaucugcuacgagcacugaucaugcucggggacacuaugucgggccgcaugggaggccagauacaccuggcgaucauggccguuuucaagauguccccggguuaugugcuuggcauauuuuugcggaaacugaccucuagagagacagcuuuaauggucaucgggauggccaugaccacugugcucagcauuccucacgaccugauggaguucaucgauggaauaucacuuggccugauucuacucaagaugguaacacauuuugacaacacccagguggguacacuggcauuggcucugacuuucaucaaaaguaccaugccauuagucauggccuggaggacgaucauggcaguucucuuuguggugacacugauuccccuuugucguaccuccugccugcagaagcaaucucacugggucgagaucacugccuugauucucggggcucaggcgcugccuguguaccuaaugacccugaugaaaggagccagcaagcgcuccuggccccuuaaugaaggcauaauggcaguuggccucguaucacuguuggggagcgcucuguuaaagaacgaugugccacucgccggaccuauggucgccgguggccugcuucuggcugcauaugugaugagugggucuuccgccgacuugagccucgagaaagcggcuaauguucagugggaugaaauggccgacaucacaggaucgucacccauuaucgaggugaagcaagaugaggacggcucuuucaguauucgggaugucgaagagacuaacaugaucacccugcuagugaaacuggcacuuauaacgguauccggucucuacccacuggccaucccggucacaaugaccuugugguacauguggcaagugaagacucagagaagcggggcuuuaugggacguuccuucucccgcagccgcgcagaaagcuacacugaccgaaggaguguauaggauuaugcaacgaggccucuuuggcaagacucaggucggggugggaauccauacagaggguguuuuccacaccauguggcaugugacgcggggcagcgucauuugucacgaauccgggcgccuggagccaucaugggccgaugugagaaaugacaugaucaguuacggaggcgguuggaggcuuggggauaagugggacaaagaggaagacguacaggugcuggcaauagagcccggaaagaacccuaaacacguucagacuaagccaggcuuguucaaaacccuaacaggcgaaauuggggccgucacccuggauuuuaagcccggaacaagcgguucuccuaucaucaaucggaaaggcaaggugauugggcucuauggaaacggcguggucacuaaguccggugacuacguaucagcuauaacccaagccgagcgaaucggggagccggauuaugaaguggacgaggauauuuucaggaagaagcgccugacgaucauggaccuucauccaggagcaggcaaaacaaagaggauuuuacccaguaucguucgugaagcucugaaacggagacucaggacuuugauacuggccccuacccgcguggucgcggccgagauggaagaggcacuccgaggccugccaaucagauaccagacacccgcuguaaagagcgagcacaccgggcgggaaauuguugaucuuaugugccaugccacuuuuaccacaaggcuguuguccucuacgcgcgugccuaauuauaaccuaaucgucauggacgaggcucacuucacugauccgucgagcguggcagcccguggauacauuucaaccagaguagaaaugggugaggccgcugcgguguuuaugacagcaacacccccaggcacuacagacccuuucccccaguccaauaguccaaucgaagauauagagcgggagauuccugaaaggucuuggaacaccggguuugacuggaucacggacuaccagggaaagacuguuugguucguccccagcaucaaagccggcaaugauauugcuaacugccugcgcaaguccgguaaaaaggugauccaacucucacgaaaaacauuugacaccgaguauccaaagaccaaguuaacugauugggacuucgugauaacaaccgauauuucugaaaugggggccaacuuuagagcaggccgggucaucgacccgaggcgcugucugaaaccuguuauucuuacagauggacccgagagagugauccuggccggcccaauacccguaacuccugcuagcgcggcccagaggcgggggcguauuggacgcaauccagcacaggaagacgaucaauacguguucaguggugacccccuccgaaacgaugaggaccacgcucauuggacggaggccaagauguugcuggauaauaucuauaccccugaaggcaucauuccgacacucuucgggccagagagagagaaaacucaggcaaucgacggagaguuuaggcugcggggcgagcagcgcaagaccuucgucgaacuuaugagaaggggugaccuacccguguggcugucccacaaaguugccagcgcugggauuucuuacaaggaucgggaguggugcuuuacaggcgaacgaaacaaucagauauuggaggaaaacauggagguggagaucuggaccagagaaggagagaagaaaaaguuacgcccuaaauggcuggacgccagggucuaugcggaucccauggcacucaaggacuucaaagaauuugccucaggccggaaguccauuacucuggauauccuuacggagaucgcuagucugccaaccuaccucagcucgcgugccaaguuggcucuggacaauauuguaaugcuacauacaacugaaagagggggaaaagcauaucaacacgcccugaacgagcucccugagucucuugaaacccugauguuaguggcuuugcugggugccaugacagcaggcauauuccucuuuuucaugcaggggaagggaaugggcaaacuguccaugggucuuaucgcgauugccguugcuagcgggcugcucuggguggccgagauccagccccaguggauugcagcuucaaucauauuggaauuuuuccugaugguccuauuagugccagagccugaaaagcaaaggaccccgcaggauaaucagcugaucuacgucauucucacuauccuuacaauuaucgcccugguggcagccaacgagaugggcuugauagagaaaacgaagaccgacuuuggauucuaccagguuaaagcugaaacuacaauucuggauguggaccuccgccccgcgagugccuggacccuguaugcaguagcuaccacaauccuuacuccaaugcuccggcauacgauugagaauaccucugccaaccuguccuuggccgcaaucgcuaaucaagccgcggugcugaugggcuuagggaagggauggccucuacaccgaauggaucugggcgucccccuccuugcuauggguuguuacagccagguuaacccaacaacucugaccgccucauuggugaugcugcucguccacuaugcaauaaucgggccuggacugcaggccaaggcuacaagagaagcacagaaaaggaccgccgcgggcauuaugaagaaucccacuguggacgguaucacgguaauugaucuugagccgaucaguuacgacccaaaauuugagaagcaauuaggccaggugaugcugcucguuuugugcguggggcagcugcuacugaugcgcacaaccugggcuuucugugaaguccucacucuugccaccggaccuauacugacauugugggagggcaaccccgggcgguucuggaacacuaccauugcagugagcacagccaauaucuuuagaggauccuaucuggcuggcgccggucucgcauucucucugaucaaaaacgcucaaacgccacguagggggaccggaacuaugggcgaaacauuaggugagaaguggaagcggcagcuuaauagccuggaccgcaaagaauuugaggaguacaagcgauccggcauucucgaagucgauagaaccgaggccaggucagcgcuaaaagacgggucuaagaucaaauaugccgugagucggggaacuucgaagauacgcuggauuguugaaagaggcaugguaaagcccaaagggaagguggucgaucugggaugcggcagggguggguggagcuacuacauggcaacauugaaaaacgugaccgagguuaagggauauacgaaaggcggcccugggcaugaagaaccgauccccauggcuaccuacggauggaaucuggugaagcuccacuccggugucgacguguucuauaagccaacagagcagguagauacucuucugugugacauuggcgaaucuucaagcaacccuaccaucgaggaagggcgaacauugcgggugcugaaaaugguugagcccuggcucuccaguaagccugaauuuugcauaaaagucuuaaauccauacaugcccacugugaucgaggagcuggaaaaacuucagcguagacauggaggcucucuggugcgcuguccucuaagcaggaacucaacccacgagauguauugggucuccgguguuagugggaauauugugagcucuguaaacacaaccuccaaaaugcuccugaaucgguucacuacgagacaccgcaagccaacauacgaaaaagaugccgacuugggagcaggcaccaggucagugagcacugagaccgagaagcccgauaugacaaucauuggccgacggcugcaaagacuccaggaagaacauaaggaaacguggcacuaugaccaugagaacccguacaggaccugggcuuaccacgggucguaugaagccccuucuacuggaagugccuccagcauggucaauggugugguuaaacuucugacaaagccaugggaugugguccccauggugacccaguuagcgaugacugacacaaccccuuuuggccagcaacgcguauucaaagagaagguugacacacguacuccacagcccaaaccggggacccagguggucaugacgaccacagcuaacuggcuguggacuuugcucggacggaagaagaauccuagacugugcaccagggaggaauuuaucucaaaagugcgcuccaacgcagccauuggcgcuguguuccaggaggaacaagguuggacaucugccagcgaggcagucaaugauagucgauuuugggaguugguugacaaggagcgggcccuucaucaggaggggaaaugugaauccugcguguacaacaugaugggaaagagagagaaaaagcugggcgaguucggcagggcuaaggggagccgcgcgaucugguauauguggcucggagccagauuucuggaguucgaagcauuggguuuccugaacgaggaucacugguuuggccgggaaaauucuuggucagggguagaaggagagggccuccacaggcuugguuacauacuggaagacauugauaaaaaggacggggauuuaaucuaugcugacgauacugccggaugggacacccguaucacggaggaugaccuguugaacgaggaacucauuacagagcagaugacaccccaucacaaaauacuggcaaaggccaucuucaaacuaacuuaccaaaauaagguggucaaggugcuucgaccaacaccuaaaggcgcuguuauggauauuaucagucgcaaggaccagagaggcuccggacaggugggaaccuauggucugaacacuuuuaccaauauggaaguccagcucauucggcaaauggaggccgaaggcgugaucacaagggacgauaugcauaaccccaaagggcugaaggagcgcguagagaaaugguugaaggaaugcggaguugacagauuaaaacggauggcgauaagcggcgaugacuguguggucaagccacuggaugagagguucucuacgucgcuccuuuuucugaaugacauggguaaggugcgaaaagauaucccccagugggaaccuucaaagggguggaaaaacuggcaggagguuccauucugcagccaccacuuucauaagauuuucaugaaagacggacguucccuaguggucccguguagaaaucaggaugaacugaucggccgcgcacggauuagucaaggcgccggguggucucucagggagaccgcuugcuugggaaaggccuacgcacagauguggagccugauguacuuucacagacgcgaccuucggcuggcuuccauggccaucuguucagcugugcccacugagugguucccuacaaguaggaccacuuggucuauacaugcccaccaucaguggaugacaaccgaagauaugcucaagguauggaaccgaguguggauugaggacaauccaaacaugaucgacaaaacgcccguccacagcugggaagauaucccuuauuuagguaagagagaggaccuguggugcggcuccuugauugggcugucaagccgggcaacaugggcgaaaaauauacacaccgccaucacucagguuaggaaccucauuggaaaggaagaguacguggauuauaugccagcuaugcgccguuacucugcccauuuugaguccgaaggcguccuuuga

SEQ ID NO: 15807 - RNA, 9867 nt, Artificial Sequence
  derived and/or modified CDS sequence (opt3) from DENV-4__KT026309__SS-prME
agcaccaucacucugcucugccuuauucccacugugauggccuuccaccuguccacgagagacggcgaaccuuugaugauagucgcuaagcaugaaagagggcggccauuacuguuuaaaaccacugaggggaucaacaaguguacucuaauugcaauggaucucggugaaaugugcgaggacaccguuaccuacaaauguccgcugcuugugaauaccgaacccgaggauaucgacugcugguguaaccugacuucuaccugggugauguauggaaccugcacgcagucaggggagcgccgacgugaaaagagaaguguggccuugacuccucacagcggaaugggccucgagaccagagcggaaacauggauguccucugagggugcuuggaaacaugcccagcgggucgagucguggauucugcgcaauccaggguucgcacugcucgccggauuuauggcuuacaugaucggccagacuggcauucagagaaccguguucuuuaucuuaaugaugcugguugcacccucauaugggaugaggugugugggagucgguaaccgggauuucguggaaggcguaagcgggggagccuggguugaccuuguguuggagcacggcgguugcgucacaaccauggcucaggggaagccuacgcuggauuuugaacuaauuaagacuacagccaaagagguggcgcuccugcgcaccuacuguaucgaagcaaguauuuccaauaucacuacagccacccgaugcccaacgcaaggagagcccuaucuuaaggaggaacaggaccagcaguacauauguagaagggauaugguggaccggggcuggggcaacgggugcggacuguucgguaaaggcggggucguuaccugcgcuaaguuuucuuguuugggaaaaauuacaggcaaucucgugcaaaucgagaaccuggaauauacuguaguggucaccgugcauaauggugauacacacgccguugggaacgacacuagcaaucacggcgugaccgcaacaauuaccccucguuccccaucagucgaggugcaguuaccggauuacggagaacugacucucgacugcgagccccgcaguggcaucgacuucaacgagaugauccuuaugaagaugaagacgaaaacauggcugguacauaagcagugguuuuuggaucuaccucugccauggaccacuggggcugacacccucgaaguucacuggaaucauaaagagagaauggugacauucaaggucccccacgccaaaaggcaggaugugaccguccugggaagccaagaaggugcgaugcacucugcccuugcaggcgcuacugagguggacuccggggauggaaaccauauguuugccggccaccugaaguguaaaguucggauggaaaaguugcgaauuaaggguaugucauacacaaugugcagcgggaaauucaguauagacaaggagauggcugagacgcagcauggcaccacugugguaaaagucaaguaugaaggaacaggcgccccuuguaaagugccaaucgagauucgcgauguuaauaaggaaaagguggucgggagaaucauaucuuccacccccuucgcagagaacacaaacagcgugacuaauauugagcucgaaccgccuuuuggagacucguacaucguaaucggugugggcgauucugcccugaccuuacacugguucaggaaaggguccucaauuggaaagauguuugagaguacguaucggggcgcuaaacgcauggcgauccugggugaaaccgcaugggacuucgggagcguuggcggacuacucacaucccugggcaaggccguccaucagguguuugggucuguguacacuaccauguucggaggcgucagcuggaugguuaggauucuuauagguuugcuggugcucuggaucgggacaaacucaaggaauacaaguauggcuauguccugcauugccgugggaggcaucacccuguuucuugguuucacgguacacgcagauaugggcugugucgugagcuggucugggaaagagcugaagugcggaucaggcaucuuuguuauugacaacgugcacacauggaccgaacaauauaaguuccagcccgagaguccagcccguuuggcuagcgccauacucaaugcacauaaagagggggucuguggaauccgguccacuacacgacuggaaaacgugauguggaagcagauuaccaaugaguuaaacuacguucugugggaaggcggucacgaccuaacugugguagcgggggaugucaaaggagugcucucuaagggcaaaagagcucuggccccucccgugaaugaccuuaaguauucguggaagaccugggguaaagcaaagaucuuuacaccagagacgaggaacagcaccuucuuggucgauggccccgacacuuccgaaugcccuaaugagcgccgggccuggaacuuucuggagguugaagauuacggguucggaauguucacaaccaauauuuggaugaaauuuagagagggcucaagugaagugugugaccauaggcucaugucugcugccaucaaggaucagaaagcaguacacgcugacaugggguacuggauagagagcuccaagaaccaaacauggcagaucgaaaaagccucacugauugaggugaagacuugcuuauggccaaagacccacacgcuguggagcaauggaguccuugagucucagauguugaucccgaaagcguaugccggccccauuucccagcauaacuaccgccaagguuaugcuacacagaccgcagggccuuggcaccucggaaagcuggaaaucgauuucggcgagugcccagguacuaccgugacaguucaggaagacugugaucaucgaggccccagucuacggacuaccacagccagcgggaaacuggugacgcaguggugcugucguucuugcaccaugccuccacucagauuucugggagaggacggcuguugguacgggauggagauaaggccccuuaacgaaaaggaggaaaauauggucaaaucccaagugucagcuggacacggcacaagugagacauucagcauggguuugcugugcuuaacccucuuuguugaagagugucugcgccggagagugacuaggaagcauaugauucuugucguagugacaacccugugcgccaucauucuaggcgggcucacguggauggaucugcuacgagcacugaucaugcucggggacacuaugucgggccgcaugggaggccagauacaccuggcgaucauggccguuuucaagauguccccggguuaugugcuuggcauauuuuugcggaaacugaccucuagagagacagcuuuaauggucaucgggauggccaugaccacugugcucagcauuccucacgaccugauggaguucaucgauggaauaucacuuggccugauucuacucaagaugguaacacauuuugacaacacccagguggguacacuggcauuggcucugacuuucaucaaaaguaccaugccauuagucauggccuggaggacgaucauggcaguucucuuuguggugacacugauuccccuuugucguaccuccugccugcagaagcaaucucacugggucgagaucacugccuugauucucggggcucaggcgcugccuguguaccuaaugacccugaugaaaggagccagcaagcgcuccuggccccuuaaugaaggcauaauggcaguuggccucguaucacuguuggggagcgcucuguuaaagaacgaugugccacucgccggaccuauggucgccgguggccugcuucuggcugcauaugugaugagugggucuuccgccgacuugagccucgagaaagcggcuaauguucagugggaugaaauggccgacaucacaggaucgucacccauuaucgaggugaagcaagaugaggacggcucuuucaguauucgggaugucgaagagacuaacaugaucacccugcuagugaaacuggcacuuauaacgguauccggucucuacccacuggccaucccggucacaaugaccuugugguacauguggcaagugaagacucagagaagcggggcuuuaugggacguuccuucucccgcagccgcgcagaaagcuacacugaccgaaggaguguauaggauuaugcaacgaggccucuuuggcaagacucaggucggggugggaauccauacagaggguguuuuccacaccauguggcaugugacgcggggcagcgucauuugucacgaauccgggcgccuggagccaucaugggccgaugugagaaaugacaugaucaguuacggaggcgguuggaggcuuggggauaagugggacaaagaggaagacguacaggugcuggcaauagagcccggaaagaacccuaaacacguucagacuaagccaggcuuguucaaaacccuaacaggcgaaauuggggccgucacccuggauuuuaagcccggaacaagcgguucuccuaucaucaaucggaaaggcaaggugauugggcucuauggaaacggcguggucacuaaguccggugacuacguaucagcuauaacccaagccgagcgaaucggggagccggauuaugaaguggacgaggauauuuucaggaagaagcgccugacgaucauggaccuucauccaggagcaggcaaaacaaagaggauuuuacccaguaucguucgugaagcucugaaacggagacucaggacuuugauacuggccccuacccgcguggucgcggccgagauggaagaggcacuccgaggccugccaaucagauaccagacacccgcuguaaagagcgagcacaccgggcgggaaauuguugaucuuaugugccaugccacuuuuaccacaaggcuguuguccucuacgcgcgugccuaauuauaaccuaaucgucauggacgaggcucacuucacugauccgucgagcguggcagcccguggauacauuucaaccagaguagaaaugggugaggccgcugcgguguuuaugacagcaacacccccaggcacuacagacccuuucccccaguccaauaguccaaucgaagauauagagcgggagauuccugaaaggucuuggaacaccggguuugacuggaucacggacuaccagggaaagacuguuugguucguccccagcaucaaagccggcaaugauauugcuaacugccugcgcaaguccgguaaaaaggugauccaacucucacgaaaaacauuugacaccgaguauccaaagaccaaguuaacugauugggacuucgugauaacaaccgauauuucugaaaugggggccaacuuuagagcaggccgggucaucgacccgaggcgcugucugaaaccuguuauucuuacagauggacccgagagagugauccuggccggcccaauacccguaacuccugcuagcgcggcccagaggcgggggcguauuggacgcaauccagcacaggaagacgaucaauacguguucaguggugacccccuccgaaacgaugaggaccacgcucauuggacggaggccaagauguugcuggauaauaucuauaccccugaaggcaucauuccgacacucuucgggccagagagagagaaaacucaggcaaucgacggagaguuuaggcugcggggcgagcagcgcaagaccuucgucgaacuuaugagaaggggugaccuacccguguggcugucccacaaaguugccagcgcugggauuucuuacaaggaucgggaguggugcuuuacaggcgaacgaaacaaucagauauuggaggaaaacaucgagguggagauuuggaccagagaaggagagaagaaaaaguuacgcccuaaauggcuggacgccagggucuaugcggaucccauggcacucaaggacuucaaagaauuugccucaggccggaaguccaucacucuggauauccuuacggagauugcuagucugccaaccuaccucagcucgcgugccaaguuggcucuggacaauauaguaaugcuacauacaacugaaagagggggaaaagcauaucaacacgcccugaacgagcucccugagucucuugaaacccugauguuaguggcuuugcugggugccaugacagcaggcaucuuccucuuuuucaugcaggggaagggaaugggcaaacuguccaugggucuuauugcgaucgccguugcuagcgggcugcucuggguggccgagauucagccccaguggaucgcagcuucaauaaucuuggaauuuuuccugaugguccuauuagugccagagccugaaaagcaaaggaccccgcaggauaaucagcugauuuacgucauccucacuauucuuacaaucauagcccugguggcagccaacgagaugggcuugauugagaaaacgaagaccgacuuuggauucuaccagguuaaagcugaaacuacaauccuggauguggaccuccgccccgcgagugccuggacccuguaugcaguagcuaccacaauucuuacuccaaugcuccggcauacgaucgagaauaccucugccaaccuguccuuggccgcaauagcuaaucaagccgcggugcugaugggcuuagggaagggauggccucuacaccgaauggaucugggcgucccccuccuugcuauggguuguuacagccagguuaacccaacaacucugaccgccucauuggugaugcugcucguccacuaugcaaucauugggccuggacugcaggccaaggcuacaagagaagcacagaaaaggaccgccgcgggcaucaugaagaaucccacuguggacgguauuacgguaaucgaucuugagccgauaaguuacgacccaaaauuugagaagcaauuaggccaggugaugcugcucguuuugugcguggggcagcugcuacugaugcgcacaaccugggcuuucugugaaguccucacucuugccaccggaccuauucugacauugugggagggcaaccccgggcgguucuggaacacuaccaucgcagugagcacagccaauaucuuuagaggauccuaucuggcuggcgccggucucgcauucucucugauuaaaaacgcucaaacgccacguagggggaccggaacuaugggcgaaacauuaggugagaaguggaagcggcagcuuaauagccuggaccgcaaagaauuugaggaguacaagcgauccggcauccucgaagucgauagaaccgaggccaggucagcgcuaaaagacgggucuaagauaaaauaugccgugagucggggaacuucgaagauucgcuggaucguugaaagaggcaugguaaagcccaaagggaagguggucgaucugggaugcggcagggguggguggagcuacuacauggcaacauugaaaaacgugaccgagguuaagggauauacgaaaggcggcccugggcaugaagaaccgauucccauggcuaccuacggauggaaucuggugaagcuccacuccggugucgacguguucuauaagccaacagagcagguagauacucuucugugugacaucggcgaaucuucaagcaacccuaccauagaggaagggcgaacauugcgggugcugaaaaugguugagcccuggcucuccaguaagccugaauuuugcaucaaagucuuaaauccauacaugcccacugugauugaggagcuggaaaaacuucagcguagacauggaggcucucuggugcgcuguccucuaagcaggaacucaacccacgagauguauugggucuccgguguuagugggaauaucgugagcucuguaaacacaaccuccaaaaugcuccugaaucgguucacuacgagacaccgcaagccaacauacgaaaaagaugccgacuugggagcaggcaccaggucagugagcacugagaccgagaagcccgauaugacaauuaucggccgacggcugcaaagacuccaggaagaacauaaggaaacguggcacuaugaccaugagaacccguacaggaccugggcuuaccacgggucguaugaagccccuucuacuggaagugccuccagcauggucaauggugugguuaaacuucugacaaagccaugggaugugguccccauggugacccaguuagcgaugacugacacaaccccuuuuggccagcaacgcguauucaaagagaagguugacacacguacuccacagcccaaaccggggacccagguggucaugacgaccacagcuaacuggcuguggacuuugcucggacggaagaagaauccuagacugugcaccagggaggaauuuauuucaaaagugcgcuccaacgcagccaucggcgcuguguuccaggaggaacaagguuggacaucugccagcgaggcagucaaugauagucgauuuugggaguugguugacaaggagcgggcccuucaucaggaggggaaaugugaauccugcguguacaacaugaugggaaagagagagaaaaagcugggcgaguucggcagggcuaaggggagccgcgcgauaugguauauguggcucggagccagauuucuggaguucgaagcauuggguuuccugaacgaggaucacugguuuggccgggaaaauucuuggucagggguagaaggagagggccuccacaggcuugguuacauucuggaagacaucgauaaaaaggacggggauuuaaucuaugcugacgauacugccggaugggacacccguauuacggaggaugaccuguugaacgaggaacucauaacagagcagaugacaccccaucacaaaauccuggcaaaggccauuuucaaacuaacuuaccaaaauaagguggucaaggugcuucgaccaacaccuaaaggcgcuguuauggauaucauuagucgcaaggaccagagaggcuccggacaggugggaaccuauggucugaacacuuuuaccaauauggaaguccagcucauccggcaaauggaggccgaaggcgugauaacaagggacgauaugcauaaccccaaagggcugaaggagcgcguagagaaaugguugaaggaaugcggaguugacagauuaaaacggauggcgaucagcggcgaugacuguguggucaagccacuggaugagagguucucuacgucgcuccuuuuucugaaugacauggguaaggugcgaaaagauauuccccagugggaaccuucaaagggguggaaaaacuggcaggagguuccauucugcagccaccacuuucauaagaucuucaugaaagacggacguucccuaguggucccguguagaaaucaggaugaacugauuggccgcgcacggaucagucaaggcgccggguggucucucagggagaccgcuugcuugggaaaggccuacgcacagauguggagccugauguacuuucacagacgcgaccuucggcuggcuuccauggccauauguucagcugugcccacugagugguucccuacaaguaggaccacuuggucuauucaugcccaccaucaguggaugacaaccgaagauaugcucaagguauggaaccgaguguggaucgaggacaauccaaacaugaucgacaaaacgcccguccacagcugggaagauauuccuuauuuagguaagagagaggaccuguggugcggcuccuugauagggcugucaagccgggcaacaugggcgaaaaauauccacaccgccauuacucagguuaggaaccucaucggaaaggaagaguacguggauuauaugccagcuaugcgccguuacucugcccauuuugaguccgaaggcguccuuuga

SEQ ID NO: 15808 - RNA, 9867 nt, Artificial Sequence
  derived and/or modified CDS sequence (opt3) from DENV-4__KF907503__SS-prME
agcaccaucacacugcucugccuuauucccacugugauggccuuccaccuguccacgagagacggcgagccuuugaugauagucgcuaagcaugaaagggggcggccauuacuguuuaaaaccacagagggaaucaacaaguguacucuaauugcaauggaucucggugaaaugugcgaggacaccguuacauacaaauguccgcugcuugugaauaccgaacccgaggauaucgacugcugguguaaccugacuucuacauggguaauguauggcaccugcacgcagucaggggagcgccgacgugaaaagagaaguguggccuugacuccucacagcggaaugggccucgagaccagggcggaaacauggauguccucugagggugcuuggaaacaugcccaacgggucgagucguggauucugcgcaauccaggguucgcacugcucgccggauuuauggcuuacaugaucggccagacuggcauacagagaaccguguucuuuguuuuaaugaugcugguggcacccucauaugggaugaggugugucggaguggguaaccgggauuucguagaaggcguuagcgggggagccuggguggaccuugucuuggagcacggcgguugcgugacaaccauggcucaggggaagccuacgcuggauuuugaacuaacuaagacaaccgccaaagagguggcgcuccugcgcacuuacuguaucgaagcaaguauuuccaauaucacaaccgccacgcgaugcccaacccaaggagagcccuaucuuaaggaggaacaggaccagcaguacauuuguagaagggaugucguugaccggggcuggggcaacgggugcggacuguucgguaaaggcggggugguaacaugcgcuaaguuuucuuguagcggaaaaaucacuggcaauuuggugcaaauagagaaccucgaauauaccgucgugguuacagugcauaauggugauacucacgccgucgggaacgacaccuccaaucacggcgugacagcaaugauuaccccucguucaccaaguguagagguuaagcugccggauuacggagaauuaacucuggacugcgagccccgcagcggcaucgacuucaacgagaugauucucaugaagaugaaaaagaaaacguggcuugugcauaagcagugguuucuggauuugccucuaccauggacagcuggggccgacaccucugaaguccacuggaauuacaaagagagaauggugacuuucaaggucccccaugcgaaaaggcaggaugugaccguucugggaucccaggaaggugccaugcacucagcacucgcuggcgccacagagguggacagcggggauggaaaccacauguuugcuggccaucugaaguguaagguacggauggaaaaacuucgaaucaaggguaugaguuauaccaugugcucugggaaauucuccaucgacaaggagauggccgagacucaacacggcacaacggucgugaaaguuaaguacgaaggagcaggcgccccuuguaaggugccaauugagauacgcgaugucaauaaagaaaaggugguagggagaaucauuagcucgaccccccuggcugagaacacuaacucugugacaaauaucgaguuggaaccgccuuucggagacuccuauauaguuauuggugucggcaacucagcgcucacccugcauugguuuaggaaagggaguagcaucggaaagauguucgaguccacauaccggggcgcaaaacgcauggccaucuuaggugaaacugcuugggauuuugggucugugggcggacuguucaccagccuaggcaaggccgugcaccaggucuuugggucaguuuauacgaccauguucggaggcgugaguuggaugauuagaauccucauugguuuucuggugcuuuggauagggacaaauuccaggaacacuagcauggcaaugaccugcaucgccguaggaggcauuacauuguuccuggguuuuacuguccaggcugacaugggcugugugguuucuuggucagggaaggagcucaaaugcggaaguggcaucuucguggucgauaaugugcauaccuggacggaacaauacaaguuucagcccgagagcccagcccgucuggcauccgcgauccuuaacgcucacaaagacgggguuuguggaauucggucuacaacccgacuggagaaugugauguggaagcagauaacuaacgaauugaauuauguacucugggagggcggucacgaccugacagucguggccggggaugugaaaggagucuuaaccaagggcaagagagcacugacuccucccguuucggaccuaaaauacagcuggaagaccugggguaaagccaagaucuucacaccagaagcuaggaacuccacguuucucauugauggccccgacaccucagagugcccuaaugaacgccgggccuggaacagucuggagguggaggauuacggguucggaauguucacuacaaauaucuggaugaaauuuagagaaggcucuagcgagguaugugaccauaggcuuauguccgcagcuauuaaggaucagaaagccgugcacgcggacaugggguauuggaucgaaucaagcaagaaccaaaccuggcagauagagaaggccucuuugaucgaagucaaaacaugccuguggccaaagacucauacccucugguccaauggagugcuggagagucagauguuaauuccgaaaagcuacgcuggccccuucucucagcacaacuaucgccaagguuacgcaacgcagacaguugggccuuggcaccugggaaagcuugagaucgauuuuggcgaaugcccagguaccacugugaccauucaggaggacugugaucaucgaggccccuccuugcggacaucaacugccagugggaaacucgucacccaguggugcugucguagcugcacaaugccuccacugagauuccuaggagaagacggcuguugguaugggauggagaucaggccccugucggagaaggaagagaacauggugaagucccaaguuacggcuggacagggcaccucugaaacuuuuagcaugggucuccugugccuuacauuguucguggaggaaugucugcgccggagagucaccaggaaacacaugauauuaguagugguuauuacucucugcgccaucauucuggggggacuuacauggauggaucuguugcgagcacucaucaugcugggcgacaccaugucaggccgcauagggggacagauccaucuagcgauuauggccguguuuaagaugaguccggguuacguccugggcguguuccuccggaaacugacguccagagagacugcucuuaugguaaucgggauggccaugaccacaguguugucuauuccucacgaccugauggaguuaaucgauggaauaagccucggccugauucuucugaagaucgucacccaguuugacaauacucaaguugguacacuagcacucucccugaccuucaucaggucaacaaugccauugauuauggcuuggcguacuaucauggccgugcuguuuguggucaccuuaauuccccucugucgcacgagcugccugcagaaacagagucauuggguggaaauaacagcacuuauccugggggcccaagcuuugccuguuuaucucaugacccugaugaagggagcgucucggagauccuggccccuaaacgagggcauuauggccguaggccuggugagccuucucgggucggcacuguugaagaaugaugucccacuggcuggaccuaugguggccgguggcuuacuccuggccgcuuacguuaugucagggucuagugcagaccuuucccuggaaaaagccgcgaacgugcagugggaugagauggcugacaucacuggaagcucucccauuaucgaagucaagcaggaugaggacggcagcuucuccauaagggauguggaggaaaccaauaugaucacauugcucguaaaacuggcccuaauuacugucucaggucuguacccacuugcaaucccggugaccaugacgcucugguauauguggcagguuaagacacaacgaaguggggcccugugggacgugccuagccccgcugcaacccagaaagccgcguugucugagggagucuaccggauuaugcagcgcggcuuauuuggcaagacucagguggggguuggaauccacauggaagguguguuccacacaauguggcaugucaccagaggcuccgugauaugucacgagacugggaggcuggaaccaucaugggcugauguacggaacgacaugauuaguuauggaggcgguuggcgacucggggauaagugggacaaagaggaggacgugcaaguucuggccaucgaacccggaaagaauccuaaacauguccagacaaagccaggccuuuucaaaacccugacgggcgagaucggggcagugacuuuggauuuuaagcccggaaccagcgguuccccuauuauaaacagaaaaggcaaggugaucgggcuauacggaaauggcgucguaacaaagucuggugacuaugugucggccauuacccaggcugaacgcaucggggagccggauuacgagguugacgaagauauuuucaggaaaaagcgucugacaaucauggaccuccacccaggagccggcaaaacuaagcggauacugcccagcaucgugagagaggcacuuaaaaggcgcuuacgaacccugauucucgcuccuacgagagucguggccgcggaaauggaggaagccuugcggggccugccaaucagguaucagacacccgcaguuaagucagagcauacugggcgcgagauuguggaucucaugugccacgcuaccuccacaacccgucugcuuaguucuacuagagucccuaacuacaaucugaucgugauggacgaagcccacuuuaccgauccgagcuccguagcugcacggggauacauaucaacaaggguggagaugggugaagccgccgcuauuuucaugacggcgacucccccaggcgcaaccgacccuuuuccccaaucuaacagcccaaucgaggauaucgaacgcgagauuccugagcgaaguuggaauacaggguucgacuggaucaccgacuaucagggaaagacuguuugguuuguccccuccauaaaagccggcaacgauauugcuaauugcuugagaaagagcgguaaaaaggugauccagcuaucucggaaaacauucgacaccgaauacccaaagacgaagcugacugauugggacuuuguggucacaaccgauauuucagagaugggggccaacuucagggcaggccgcguuaucgacccgagaaggugucucaaaccugugauauuaaccgauggacccgaacggguaauucuggccggcccaauccccgugacuccugcuuccgcggcccaacgucgcgggcgaaucggaagaaacccagcacaggaggacgaucaguaugucuuuaguggugacccccuuaagaaugaugaagaccaugcucacuggacagaggccaaaaugcugcucgauaacauuuacaccccugagggcaucauuccgacauuguucgggccagaaagggagaagacucaggcaauagacggagaauuccggcugcgcggcgagcaaagaaaaacguuuguggagcucaugaggcggggugaccugcccguuuggcuuagcuauaagguggccucggcugggaucucuuacaaggaucgagaauggugcuucaccggcgagagaaauaaccagauucuagaagagaauauggaagucgagaucuggacacgcgagggagaaaaaaagaaacugaggccucggugguuggacgcccguguauaugcggaucccauggcauuaaaggacuuuaaagaguucgccuccggcagaaagagcaucacucuggauauucucaccgaaauagcuucacugccaacauaccuuaguucuagggccaagcuggcucucgacaacaucgugauguugcauaccacugagcgcgggggacgggcauaccagcacgcccugaaugaacuaccugagucccuggagacgcucaugcuuguugcucuguuaggugccaugaccgcaggcauuuuuuuguucuuuaugcaggggaaaggaaucggcaagcugagcaugggucucauuaucauagcgguggccucagggcugcuuugggucgcugaaauccaaccccaguggauugccgcaaguaucauucuggaguucuuucucaugguguugcugaucccagaaccugagaaacagcgaacaccgcaggauaaccaauuaauauaugucauucuaacuauccugaccauuaucggccucauagcugccaaugaaaugggacuuaucgagaagacaaaaaccgacuucggcuuuuaccaggugaagacugagacaacgauucuggauguugacuugagacccgcaagcgccuggacccuguaugcuguggcgacuacaauccucaccccaaugcugaggcacaccauugaaaacacauccgccaaucuuucucucgcagcuaucgccaaccaggccgcaguacugaugggguugggaaaaggcuggccucugcaucgcauggauuuaggugugccccuacuggcuaugggguguuacagccaggucaauccaacuacgcucaccgccucccuuguuaugcugucagugcacuaugcgauaauuggaccuggcuugcaagcuaaggccacacgggaggcacagaagagaacugccgcugguaucaugaaaaaccccaccgucgacggcaucacagugauugaucuggaaccgaucucuuacgacccaaaguucgagaaacagcucgggcaaguaaugcugcuuguguuaugcgcaggacagcugcucuugaugcguaccacuugggccuuuugugagguucugacgcuagcgacaggcccuauacugacccucugggaagggaaucccggaagguucuggaacacuaccauugcugugaguacagccaacaucuuccggggcucguaucuugcaggugccgggcuggcuuuuagcuugauuaagaaugcccagacuccacgccgaggaaccggcacaacgggugagacccugggcgaaaaauggaagagacagcucaacucccuggacaggaaggaguucgaagaguacaaacggucugggaucuuagaggucgaucgcacugaagcaaagucagcucuuaaagacggaagcaagauaaaacaugccguguccagaggcaguucuaagaucagguggauugucgagcgagggauggugaagcccaaaggaaagguuguagaucugggcugcggucgggggggauggagcuacuauauggcgacacucaaaaaugugaccgaagucaagggcuacacuaaaggcgggccuggacacgaggaaccgauccccauggccacauaugguuggaaccuagugaagcugcauucaggcguugacguguuuuacaagccaaccgagcaagucgauacguugcugugugacauuggggaguccaguagcaauccuaccaucgaagagggacguacacucagagugcuuaaaaugguagaacccuggcugucuuccaagccugaguucugcauuaaaguguugaacccauauaugcccacuguuaucgaagagcuggagaagcuccagcgcaaacacggcgguaauuuagucagguguccucugucacggaacagcacccacgaaauguacugggugucgggggcaucuggaaauauagugaguuccgucaacacaacuagcaagaugcuucugaauagauuuaccacacgccauaggaaaccaaccuaugagaaggauguugaccuaggcgcuggcacucgaucaguguccacggaaacagagaagcccgauaugaccauuaucgggcggagacuccagaggcugcaggaggaacacaaagagacuuggcauuacgaccaagaaaacccguaccgcaccugggccuaucacggaucuuacgaggcaccuagcacagguagugcuuccagcaugguaaauggcguggucaaguugcugacgaaaccaugggaugugauccccaugguuacccagcucgccaugacugacacaaccccuuucgggcagcagcguguguuuaaggaaaaagucgacacucggacaccacaacccaagccgggaaccagaauggugaugacaacuaccgccaacuggcuuugggcgcuguuaggcaagaaaaagaauccuaggcugugcacgcgcgaggaguucauuucuaaaguacgaucaaacgcugcaauaggugccguuuuucaggaagagcagggguggaccagugcuuccgaagccgugaaugauagccgguucugggaguuggucgacaaggaaagagcacuccaccaagagggaaaaugugagucuugcguguauaacaugaugggcaagagggaaaagaaacugggcgaguuugggcgcgccaagggaucgagagcuaucugguacauguggcuaggugcgcgguuccuugaauuugaggcccugggcuuccucaacgaagaucauugguucgggagggagaauucauggagcggaguggagggcgaaggucugcaccguuugggguauauucuggaggaaaucgacaaaaaggauggagaccucauguacgcagaugacacagcuggcugggauacucgaauuaccgaggacgaucuucagaacgaggaacugaucacagagcagauggccccccaucacaaaauauuagcaaaggccaucuuuaagcugacuuaucagaauaaagucguuaagguguugcgcccaaccccuagaggcgcuguaauggacauuaucucccggaaagaucaaagggggaguggacagguggguacguacggccucaacacauucaccaauauggaaguccagcugauucgccagauggaggccgaaggggugaucacucaagacgacaugcagaaccccaagggacuaaaagagagaguugagaaguggcuuaaagaaugcggcguggaucggcugaagaggauggcgauaucuggugacgauugugucgugaagccacucgacgagcgauuugggacaagccuguuguucuuaaaugauaugggaaaaguacguaaggacauuccccagugggaaccuuccaaaggcuggaagaacuggcaggagguuccauuuugcucacaucacuuccacaaaaucuuuaugaaggauggcagaagucugguggucccgugucgcaaucaagacgaacucaucgggcgggcaaggauuucucagggagccgguuggagccuuagagagaccgcuugccugggcaaggccuacgcacagauguggucccuaauguauuuccaucgccgggaucugaggcucgcuucaauggccauauguagcgcugugcccacugagugguuuccuaccucucgaacaacgugguccauccacgcccaucaccaguggaugaccacugaagacauguugaaaguuuggaacagaguguggauugaggauaauccaaacaugacagacaagacccccguccacaguugggaagacaucccuuaccuggggaaacgggaggaucuuuggugcggaagccugauuggccucucguccagggcaacuugggcgaagaauauccauacagccauaacccaagugcgcaacuuaaucgguaaagaagaguauguagacuacaugccagugaugaagcguuauucugcucccucagagagcgaagggguccuguga

SEQ ID NO: 15809 - RNA, 9867 nt, Artificial Sequence
  derived and/or modified CDS sequence (opt3) from DENV-4__AY947539__SS-prME
agcaccaugacacugcucugccuuauccccacugccauggcuuuccaccuguccacgagagacggcgagccuuugaugauuguggcaaggcaugaacgggggcgcccauuacuguuuaagaccacagagggaauaaacaaauguacucuaaucgccauggaucucggugaaaugugcgaggacaccgucacauacgaauguccgcugcuuguuaauaccgagcccgaggauauugacugcugguguaaccugacuucugcgugggugauguauggcacaugcacccagucaggggaacgacguagagagaagaggaguguagcuuugacgccucacagcggaaugggccucgaaacucgggccgagaccuggauguccucugagggugcauggaaacaugcccaacgcguggaaucguggauccugagaaauccaggguucgcucugcucgcaggauuuauggccuacaugauuggccagacaggcauccagaggacugucuucuuuguguuaaugaugcugguugcucccucauaugggaugcggugugugggagucgguaaccgcgauuucguggagggcguaagcgggggagccuggguugaccuuguguuggaacacggcgguugcgucaccacaauggcgcaggggaagccuacccuggauuuugagcuaauaaaaacgacugcaaaggaaguggcccuccugcgaacauacuguaucgaggcuaguauuuccaauaucaccacugccacaagaugcccaacccaaggagagcccuaucuuaaggaagagcaggaccagcaguacauuuguaggcgggauguggucgaccguggcuggggcaacgggugcggacuguucgguaaaggcgggguugugacgugcgcaaaguuuucuuguagcggaaaaaucaccggcaauuugguacaaauagaaaaccucgaguauacaguggucgugacuguucauaauggugauacccacgcuguggggaacgacauuccuaaucacggcgucacagccacuaucaccccacgcuccccgucaguggaaguaaagcugcccgauuacggagaguuaacacuggacugcgagccuagaaguggcauugacuucaacgaaaugauccucaugaaaaugaagaagaaaaccuggcuuguucauaagcagugguuucuggauuugccacuacccugggcggccggggcagacacuagcgaggugcacuggaauuacaaagaaaggauggucacguucaaggugccucaugcuaaacggcaggaugucacagugcugggaucucaggagggugccaugcacuccgcucucaccggcgccacugaaguugacucaggggauggaaaccacauguuugcaggccaucugaaguguaaagugcgaauggagaagcuucgcaucaaggguaugagcuauaccaugugcagugggaaauucucuauugacaaggagauggccgaaacacaacacggcaccacuguagucaaagugaaguacgagggagcuggcgcgccauguaaaguucccauagaaaucagagaugugaauaaggagaaggucguggggaggauuaucuccagcacaccguucgcagaguauacgaacucgguaaccaacauagaacuggagccucccuuuggagacucuuacauugugaucgguguuggcgauuccgccuugacucuccauugguuccggaaagggucaaguaucggaaagaugcuggaaagcacauaucgcggcgcuaaaagaauggccauuuuaggugagaccgcaugggacuuuggguccgucggcggacugcuaacaucucucggcaaggccgugcaccagguguucgggagcgucuacacuaccauguuuggaggcguuucauggauggugaggauccugauugguuuccuuguguuguggauagggacgaauagucguaacaccuccauggcuaugacaugcaucgccguaggaggcauuacucuguuucucgguuucaccguccaugcagauacaggcugugcggugagcuggucugggaaagaacugaagugcggaucaggcaucuuuguuaucgacaaugugcacacuuggaccgagcaguauaaguuccaaccagagaguccugcucggcuugccagcgcaauucugaacgcccacgaagacggggucuguggaauacgauccacgacaagauuggagaauaucauguggaaacagauuaccaacgaacucaauuacgugcugugggagggcggucaugauuuaacuguuguggcuggggacguaaagggaguccugucuaaaggcaagagggcccuagcacccccagugaacgaucucaaauacucguggaagacaugggguaaggcuaaaaucuuuacccccgaagccaagaauagcacuuuccugauugacggcccugauaccuccgagugcccaaacgagcgccgggcguggaauuuucuugaaguggaggacuauggguucggaauguucacaacgaacaucuggaugaaauuuagagaaggcucaagugaggucugugaucacagguugaugucugccgcuauaaaggaccagaaagcaguucaugccgauaugggguacuggaucgaaagcuccaagaaucagaccuggcaaauugagaaagcuucacugaucgaggugaagacuugccucuggccgaagacacacacccuguggagcaacggaguauuagaaucucagaugcugauucccaaagccuaugcaggcccuuucucccagcacaauuaccgccaggguuaugcgacacaaacuguggggccauggcaucuuggaaaguuggagaucgacuuuggcgaaugccccgguaccacggucacaauacaggaggauugugaccaccgaggcccuagucuccggaccacuaccgccagcgggaaacuggugacacaguggugcugucguucuugcacuaugccaccccuaagauuccugggagaggauggcuguugguacgggauggaaauuaggccgcucuccgagaaggaagagaacaugguuaaaucacaggugagugcuggacaaggcaccagcgaaacauuuucgaugggucugcuuugcuugacgcuguucgucgaggaguguuuacgccggagagugaccaggaagcauaugauccucguuguggucacuacacugugcgccauuauccuugggggacugaccuggauggacuugcuccgagcacugauaaugcuaggcgacacuauguccggccgcauggggggacagauccaccuggcuauuauggccguauuuaagaugucuccugguuaugugcucggcaucuuccugcggaaacuuacaagcagagaaaccgcauugaugguuauugggauggccaugacgacugugcugucaaucccacaugauuuaauggaguuuauagacggaauuagucucggccugauccuucugaagauggucacccacuucgauaacacacagguggguacccuagcucucucccugacuuuuaucaggucuacaaugcccuugguaauggcguggcguaccauuauggccgugcuguucgucguuacauuaaucccucucugucgcacuagcugccugcagaaacaaucccacuggguggaaauuaccgcacuuauacugggggcucaggccuugcccguguaccucaugacgcugaugaagggagccucaaaacggagcuggccacuaaaugagggcaucauggcugucggccuggugagucuucucgggucugcacuguugaagaacgacguuccucuggccggacccaugguagcggguggcuuacuccuggcugccuacgugauguccgggagcucggcagaucuuucacuggaaaaggccgcuaauguccagugggacgagauggcagauauuacaggaucuaguccaaucauugaggugaaacaagacgaagauggcuccuuuagcaucagagacauagaggaaaccaacaugaucacuuugcucguuaagcuggcccuaauuaccgugucuggucuguauccgcuugcgaucccugucacaaugacucucugguacauguggcaggugaaaacccagaggagcggggcucugugggauguacccuccccagccgcagcccagaaggcuacguugacagagggagucuaucgaauuaugcaacggggcuuauucggcaaaacccagguggggguuggaauccauauggaagguguguuccacacuauguggcaugucacacgcggcucagugauaugucacgagaccgggagacuggagcccaguugggccgacguuaggaaugauaugauuagcuacggaggcgguuggcggcucggggacaagugggacaaggaagaggaugugcagguccuggcaaucgaaccuggaaaaaacccaaagcaugugcagacuaaacccggccuuuuuaagacacugaccggcgagaucggggcuguaacguuggacuucaaaccuggaacuucugguuccccgauuauaaaucgaaagggcaaagugaucgggcuauauggaaacggcguugucaccaagucaggugauuacgugagugccauuacacaagcggagagaaccggggaaccagacuaugagguggaugaagacaucuuucgcaagaaaaggcugacaauuauggaucuccaccccggagccggcaagacuaaacguauccugccuagcauaguccgggaggcacuuaagagaagguuacgcacccugauccucgcuccaacgcgaguaguggccgcugaaauggaggaggcauugagaggccugcccauucgguaccagacaccugccguuaaauccgaacacacugggagggagaucguggaccucaugugccaugccaccuucacaacccgccugcuuucuucgacucgugucccgaauuacaaccugauugugauggaugaagcucacuuuaccgaccccagcucaguugcggcaagaggauauaucuccacacggguggagaugggugaagccgcugccauauucaugacggcaacuccaccuggcgccaccgaucccuuuccacagaguaauucuccuauugaggacaucgagagggaaauccccgagcgcagcuggaacacaggguucgacuggauuaccgauuaccagggaaagacugucugguuugugccauccaucaaggcuggcaaugacauagcgaacugcuugcgaaaaucagguaagaaaguaauucaacuaucuagaaagacauucgauaccgaauauccgaaaacgaagcugacugacugggauuuugugguuacaaccgacaucagcgagaugggggccaauuuccgggcaggcagggucauugauccucgcagaugucucaagcccgugaucaguaccgacggaccagaaagggugauauuagcuggccccauuccugucacuccagccuccgcagcccagcggcgugggcgcaucggacgaaaccccgcucaggaggaugaccaauacguuuucagcggugauccucugaaaaacgacgaggaucaugcccacuggacagaagcgaagaugcuucuggacaauaucuauaccccggagggcauuaucccaacacucuuugggcccgaaagagagaaaaaccaggcaauugacggagaguucagguugcggggcgaacagcgcaagacuuuuguggagcugaugagaaggggugaucucccuguauggcugucuuacaaaguggccucagcugggauauccuauaaggaccgggaauggugcuucacgggcgagcgaaauaaccagauccuugaagagaauauggaggucgaaauuuggaccagagagggagaaaagaaaaagcuacgccccaaauggcuggaugccaggguguacgcugacccaauggcauugaaggauuuuaaagaguucgccaguggccggaagagcaucacauuagacauccugacugaaauugcuucgcucccuaccuaccugucuucccgugccaagcuugcacuggauaacauaguuaugcuccacacaaccgagagagggggaaaagcguaucaacaugccuugaaugagcugcccgaaagccuagagacucugaugcucguggcucuucugggugccaugacggcaggcaucuuuuuauucuuuaugcaggggaagggaauuggcaaauugucaaugggucugaucgcuauugccgucgcaagugggcuccuguggguagccgaaauccagccacaguggauagcugcgucuaucauucuugaguucuuucugauggugcucuugaucccugaaccggagaagcaaaggaccccccaggacaaccagcugauuuacguuaucuuaacaauacuaacuauuaucggccugauugccgcaaaugagaugggacucaucgaaaaaaccaagacagauuucggcuuuuaucaggugaaaaccgagacuacaauacuugacgucgaucugcgcccagcuuccgccuggacguuguacgccguggcaaccacuauccugacaccuaugcuccggcacaccauugaaaacaccagcgcuaaucugucacuugccgcgaucgcuaaccaagccgcaguccucauggggcugggaaagggcuggcccuugcaucgaauggaccugggugugccauuacuagccaugggguguuauagucagguuaauccuacaacucugauugcuagccucgugaugcuucugguacacuacgcaaucauaggacccggcuugcaggccaaggcgacgagagaggcucagaaaaggaccgccgcagguauuaugaagaacccgacaguggauggcaucacugucaucgaccuggagccaauuuccuaugacccuaaauucgaaaagcaacucgggcagguuaugcugcuuguguuaugcgccggacagcugcucuugaugcgcaccacaugggcuuucugugagguccugacccuagccacuggccccgugcugacgcucugggaagggaauccaggacgguuuuggaacacaaccaucgcaguaucuacugcuaacauauucagaggcagcuaccuugccggugcggggcuggccuuuuccuugauuaaaaaugcacaaaccccccguaggggaacaggcacuaccggugagacacugggcgaaaaguggaagcggcagcucaacucacuggaucgcaaagaguucgaggaauacaagcgaucugggaucuuagagguggacagaacggaagcuaaaagugcccuuaaggauggaucgaaaauuaagcaugcaguuagcaggggcuccucuaagauccgguggauaguggagcgcgggauggucaaaccuaagggaaaaguggucgaccugggcugcgguagagggggauggucauauuacauggcuacccucaagaaugugacugaaguuaaaggcuauacaaagggcgggccgggacacgaggagcccaucccaauggccaccuacgguuggaaccuaguaaagcugcacagcggcguggaugucuuuuauaaaccuacugaacagguggacacauugcugugugauauuggggaguccaguucuaaucccaccaucgaagagggaaggacgcuccgaguucuuaagaugguggaaccuuggcugagcucaaaaccagaguucugcauuaaggucuugaaccccuacaugccuaccgugaucgaggaacuggagaaacuccagcggaagcauggcgguuccuuaguacguuguccacugaguagaaauagcacacacgaaauguauugggugucugggguuuccggaaacauugucucaagcgugaauacuaccucgaaaaugcuucugaaccgcuuuacaacuaggcaucggaagcccaccuacgagaaggacguggaucuaggcgccggcacaagaucugucaguaccgagacugaaaaaccggacaugacgaucauagggcgcaggcuccaacgacugcaggaggaacacaaggagacauggcacuacgaucaggaaaauccuuaucggaccugggcguaccauggauccuaugaggcuccaagcacugguucagcauccucuaugguuaacggcgugguaaaauugcugaccaagcccugggacgugauuccuauggucacacagcucgccaugacggacaccacuccauucgggcaacagagaguguuuaaagagaagguugauacaaggaccccccagccgaagccuggaacucgcauggugaugacaaccacagcuaauuggcuuugggcccuguuaggcaaaaagaaaaacccccgucugugcacucgggaagaguucaucagcaaggucagaaguaaugcagccaucggugcuguguuucaggaagagcaaggguggaccuccgcgagcgaagccguaaacgacucuagguucugggaguugguugauaaagagcgcgcacuccaccaggaaggaaagugugagucaugcguguacaauaugaugggcaagcgagaaaaaaagcugggcgaguuugggcgggcuaaaggaaguagagccauuugguauauguggcuaggugcaagguuccuugaauucgaggcccugggcuuucucaacgaggaccauugguucgggcgcgaaaacuccuggagcggagucgagggcgaaggucugcacagauugggguacauacuggaggauaucgacaagaaagauggagaccucauuuaugcugaugacacggccggcugggauacccggaucacagaggacgaucuucugaaugaagaguuaauuacugaacagauggcgccacaucacaagauccuggcaaaggccauauuuaaauugaccuaccaaaacaagguggugaaaguccucaggccuacacccaagggcgcuguuauggacaucauuucucguaaagaccagcgagggucgggacagguggguacuuacggccugaauaccuucacgaacauggagguacagcuaauccgccaaauggaagccgagggggugauuacacaggaugacaugcacaauccaaagggacuuaaagagagagucgaaaaguggcugaaggagugcggcguggaucggcucaaaaggauggcaaucucaggugacgauuguguugugaagccccuggacgaacgcuuuagcaccuccuuguuauuccugaacgauauggggaaagucagaaaggacauaccucagugggagccaaguaaaggauggaagaauuggcaggaagugccguuuugcucucaucacuuccauaagauuuuuaugaaagauggccggagccucguaguucccuguaggaaccaagacgagcuuaucggccgagcucguaucucccagggggccggauggucacugagagagacugcuugccuagguaaggccuaugcacagauguggagucugauguacuuccaccgccgggaucucagguuggcgucuauggccauuuguagcgcugugccuacagaaugguuuccaaccuccagaacuaccuggucaauacacgcccaucaccaguggaugacaacggaggacaugcugaaagucuggaaucgcguguggaucgaagacaaccccaauaugaccgauaagacuccuguucauagcugggaggacauuccauaucuuggcaaacgggaagaucuguggugcgggucucucaucggauuauccaguagggcaacaugggcuaagaacauucacaccgccaucacucaagugcgaaaucugauaggcaaggaggaguacgucgacuauaugcccgugaugaaaagauacagcgcaccuuucgaaucggaggguguauuguga

SEQ ID NO: 15810 - RNA, 9879 nt, Artificial Sequence
  derived and/or modified CDS sequence (opt4) from DENV-1__AB608789__SS-prME
agcgugaccaugcugcugaugcugaugcccaccgcccuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacaucgacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggugggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccgugagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgagggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggcgugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggcccccgagagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagcagcagcgagcuggagacccccaaccuggccgagagagugcuggacuggcugggcaaguacggcguggagagacugaagagaauggccaucagcggcgacgacugcguggugaagcccaucgacgacagauucgccaccgcccugaccgcccugaacgacgugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15811 - RNA, 9879 nt, Artificial Sequence
  derived and/or modified CDS sequence (opt4) from DENV-1__AB608788__SS-prME
agcgugaccaugcugcugaugcugcugcccaccgugcuggccuuccaccugaccaccagaggcggcgagccccacaugaucgugaccaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccaccaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagagugaucaccgccaaccccaucgugaccgacaaggagaagcccgugaacaucgaggccgagccccccuucggcgagagcuacaucguggugggcgccggcgagaaggcccugaagcugagcugguucaagaagggcagcaccaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcuacgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccagcggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccgcccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggcgccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagcagggcaccgcccaggugauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacagacugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgagaacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgacagcgaccccgagggcgcccugugguga

SEQ ID NO: 15812 - RNA, 9879 nt, Artificial Sequence
  derived and/or modified CDS sequence (opt4) from DENV-1__AB608786__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgugaucggcaccagcaucacccagaagggcaucaucuucauccugcugaugcuggugacccccagccuggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucaucaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagggcagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcuggggcgacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15813 - RNA, 9879 nt, Artificial Sequence
  derived and/or modified CDS sequence (opt4) from DENV-1__AB608787__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacagcaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucgugcacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaucaucgaggaggugaugagaagcagauggaucagaaagaugcugaugaccggcacccugggcguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagggcagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugaagggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggagcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagacccaccugggccaccaacauccagguggccaucaaccaggugagaagacugaucggcaacgagaacuaccuggacuacaugaccagcaugaagagauucaagaacgagagcgagcccgagggcgcccugugguga

SEQ ID NO: 15814 - RNA, 9879 nt, Artificial Sequence
  derived and/or modified CDS sequence (opt4) from DENV-1__HE795086__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgaguucugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccagcaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagaaaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcgugagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggacggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaaguacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15815 - RNA, 9879 nt, Artificial Sequence
  derived and/or modified CDS sequence (opt4) from DENV-1__AB189120__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggccguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaccaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcguguggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggugguguuccugcugcugacccugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagagccaccagcugugggccacccugcugagccugaccuucgugaagaccacccugagccugcacuacgccuggaagaccauggccaugauccugagcaucgugagccugcugccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccaaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucgugugguacuucuggcagaagaagaagcagagaagcggcgugcugugggacacccccagcccccccgagguggagaaggccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagaccaucaugcugcuggcccugaucgccgugcugaccggcggcgugacccuguucuuccugagcggcagaggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaccgagagacugagaagaauggccaucagcggcgacgacugcguggugaagcccaucgacgacagauucgccaccgcccugaccgcccugaacgacaugggcaagaucagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15816 - RNA, 9879 nt, Artificial Sequence
  derived and/or modified CDS sequence (opt4) from DENV-1__AB189121__SS-prME
agcgugaccaugcuguucaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugauggcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaucaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugauccagaacggcagacugaucaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaucaccuucaucaucgacggccccaacaccagcgagugccccgacaaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccgugagccagcacaacuacagacccggcuacuucacccagaccgccggccccuggcaccugggcaagcuggagcuggacuucgaccugugcgagggcaccaccguggugguggacgagaacugcggcaacagaggccccagccugagaaccaccaccgugaccggcaagaccauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaugaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcugugggccacccugcugagccugaccuucgugaagaccaccuucagccugcacuacgccuggaagaccauggccaugauccugagcaucgugagccugcugccccugugccugagcaccaccagccagaagaccaccuggcugcccgugcugcugggcagccugggcugcaagccccugaccaugcugcugaucaccgagaacaagaucuggggcagaagaagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggacgaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacaacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagagagaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccccaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucaucgagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagaagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagaguguucgacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15817 - RNA, 9879 nt, Artificial Sequence
  derived and/or modified CDS sequence (opt4) from DENV-1__AB195673__SS-prME
agcgugaccaugcugcugaugcugcugcccaccgcccugaccuuccaccugaccaccagaggcggcgagccccacaugaucgugggcaagcaggagagaggcaagagccugcuguucaagaccagcgccggcgugaacaugugcacccugaucgccauggaccugggcgagcugugcgacgacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgugaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaucagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacuggugaccgccaaccccaucgugaccgacaaggagaagcccgugaacaucgaggccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggccugaucacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagagcaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaacaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugauccugaagcugcugaccgacuuccagagccaccagcugugggccacccugcugagccugaccuucgugaagaccaccuucagccugcacuacgccuggaagaccauggccaugauccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggagauccaggacgacggcaccaugaagaucaaggacgaggagagagacgacaccaucaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaucuacaagagaagcggcaucguggagguggacagaagcgaggccaaggagggccugaagagaggcgagaccaucaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugagaagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacaugggcgcccagcugaucagacagauggagagcgagggcaucuucagccccagcgagcuggagacccccaaccuggccggcagagugcuggacuggcuggagaagcacggcaucgagagacugagaagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15818 - RNA, 9879 nt, Artificial Sequence
  derived and/or modified CDS sequence (opt4) from DENV-1__AB204803__SS-prME
agcgugaccaugcugcugaugcugcugcccaccgugcugaccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgugaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggccccuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccaucaacaucgaggccgagccccccuucggcgagagcuacaucguggugggcgugggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcaugggcaagcuggugcaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugagcggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugcagcgacgaccagagagccuggaacaucugggagguggaggacuacggcuucggcaucuucaccaccaacaucuggcugaagcugagagacagcuacacccaggugugcgaccacagacugaugagcgccgccaucaaggacagcagagccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcagugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaccaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaggccugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccacccugcugagccugaccuucgugaagaccaccuucagccugcacuacgccuggaagaccauggccaugacccugagcaucgugagccuguucccccugugccugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacaccaucaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagaccagcgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagaaggacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagaaggcccagaccgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaugagcagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacgccgccgccgagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugagacccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccggcagagugcuggacuggcuggagaagcacggcaucgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaagccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15819 - RNA, 9879 nt, Artificial Sequence
  derived and/or modified CDS sequence (opt4) from DENV-1__LC016760__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccaucgccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggaugaaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15820 - RNA, 9879 nt, Artificial Sequence
  derived and/or modified CDS sequence (opt4) from DENV-1__LC128301__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgagaccgagcccgacgacguggacugcuggugcaacgccaccgagaccugggugaccuacggcaccugcagccagaccggcgagcacagaagagacaagagaagcguggcccuggccccccacgugggccugggccuggagaccagaaccgagaccuggaugagcagcgagggcgccuggagacagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacaccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaccgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcgugagcuacgugaugugcaccggcagcuucaagcuggagaaggagguggccgagacccagcacggcaccgugcuggugcaggugaaguacgagggcaccgacgcccccugcaagauccccuucagcagccaggacgagaagggcgugacccagaacggcagacugaucaccgccaaccccaucgugaccgacaaggagaagcccgugaacaucgaggccgagccccccuucggcgagagcuaccugguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcugauccaccagaucuucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgugaacggcauccuggcccagggcaagaagaugaucagaccccagcccauggagcacaaguacagcuggaagagcuggggcaaggccaaggugaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcugaccagagccagcuucaucgaggugaagaccugcaucuggcccaagagccacacccuguggagcaacggcgugcuggagagcgagaugaucauccccaagaccuacggcggccccaucagccagcacaacuacagacccggcuacuucacccagaccgccggccccuggcaccugggcaagcuggagcuggacuucggccugugcgagggcaccaccguggugguggacgagcacugcggcaacagaggccccagccugagaaccaccaccgugaccggcaagaucauccacgaguggugcugcagaagcugcacccugcccccccugagauucaagggcgaggacggcugcugguacggcauggagaucagacccgugaaggagaaggaggagaaccuggugagaagcauggugagcgccggcagcggcgagguggacagcuucagccugggccugcugugcaucagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucagaaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagagccaccagcugugggccgcccugcugagccugaccuucgugaagaccaccuucagccugcacuacgccuggaagaccauggccaugauccugagcaucaucagccuguucccccugugcaugagcaccaccagccagaagaccaccuggcugcccgugcugcugggcagccugggcugcaagccccugaccauguuccugaucaccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccaucagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcaagagccaggugggcgugggcguguuccaggagggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccuggugcuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcauggaggccuucccccagagcaacgccgccauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagaguggugcagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagagccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaaggugcugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccaugacccacagaaagcccaccuacgagaaggacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaagcacggcaccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15821 - RNA, 9879 nt, Artificial Sequence
  derived and/or modified CDS sequence (opt4) from DENV-1__LC011945__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggagcacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauacagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccaucgccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggcagcgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccgugcccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccaucaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagugcgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagaucagcggcggcaacauguacgccgacgacaccgccggcugggacaccagaaucaccgaggacgaccugcagaacgaggccaagaucaccgagaucauggagcccgagcacgcccagcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggaugaaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15822 - RNA, 9879 nt, Artificial Sequence
  derived and/or modified CDS sequence (opt4) from DENV-1__LC011949__SS-prME
agcgugaccaugcugcugaugcuggugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacaccggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcaucagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuuccugcccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15823 - RNA, 9879 nt, Artificial Sequence
  derived and/or modified CDS sequence (opt4) from DENV-1__HM469966__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaugaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccgagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagaguggugcuggccggccccaugcccgugaccguggccagcgccgcccagagaagaggcagaaucggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggaucgccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccauccuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccuguggaagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcuguacagcggcaaggacguguucuucaucccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaaggccaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15824 - RNA, 9879 nt, Artificial Sequence
  derived and/or modified CDS sequence (opt4) from DENV-1__JX669462__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccacccugaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15825 - RNA, 9879 nt, Artificial Sequence
  derived and/or modified CDS sequence (opt4) from DENV-1__JX669463__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccacccugaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15826 - RNA, 9879 nt, Artificial Sequence
  derived and/or modified CDS sequence (opt4) from DENV-1__JX669464__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagauccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15827 - RNA, 9879 nt, Artificial Sequence
  derived and/or modified CDS sequence (opt4) from DENV-1__JX669465__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgugggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcaggugaaguacgagggcaccgacgcccccugcaagauccccuuccugacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggccuguucaccagcgugggcaagcugauccaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaacuacauccugcuggagaacgacaugaaguucaccgugguggugggcgacgugaacggcauccuggcccagggcaagaagaugaucagaccccagcccauggagcacaaguacagcuggaagagcuggggcaaggccaagaucaucggcgccgacacccagaacaccaccuucaucaucgacggccccgacacccccgagugccccgacgaccagagagccuggaacaucugggagguggaggacuacggcuucggcaucuucaccaccaacaucuggcugaagcugagagacagccacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagauggugauccccaagaccuacggcggccccaucagccagcacaacuacagacccggcuacuucacccagaccgccggccccuggcaccugggcaagcuggagcuggacuucgaccugugcgagggcaccaccguggugguggacgagcacugcggcuacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagauggacagcuucagccugggcauccugugcgugagcauccugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccgugggccugagccugguggccagcguggagcugcccaacagccuggaggagcugggcgacggccuggccaugggcaucaugaugcugaagcugcugaccgacuuccagccccaccagcuguggaccacccugcugagccugaccuucaucagaaccagccugagccuggacuacgccuggaagaccauggccauggcccugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggcccaucaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccacccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggagggccccgagagagugauccuggccggccccaugcccgugaccguggccagcgccgcccagagaagaggcagaaucggcagaaaccagaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugauggccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccaccaugcuggacguggaccugagacccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucgugaccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagaagagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaccccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagagcggcaccgugauggacgugaucagcagaagagaccagagaggcagcggccaggugggcaccuacggccugaacaccuucaccaacauggaggugcagcugaucagacagauggagagcgagggcaucuucagccccagcgagcuggagacccccaaccuggccaagaaggugcuggacuggcuggagaagcacggcgccgagagacugaagagaauggccaucagcggcgacgacugcguggugaagcccaucgacgacagauucgccaccgcccugaccgcccugaacgacaugggcaagaucagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15828 - RNA, 9879 nt, Artificial Sequence
  derived and/or modified CDS sequence (opt4) from DENV-1__JX669466__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagagaagagaagcguggcccuggccccccacgugggccugggccuggagaccagaaccgagaccuggaugagcagcgagggcgccuggagacagauccagagaguggagaccugggcccugagacaccccggcuucaccgugaucgccuucuuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccauccuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagagaggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgaccugggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacggccagagagccuggaacaucugggagguggaggacuacggcuucggcguguucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaccuggcccaagagccacacccuguggagcaacggcgugcuggagagcgagaugaucauccccaagaucuucggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucgugaagaccacccugagccuggacuacgccuggaagaccaccgccauggugcugagcaucgugagccuguucccccugugccugagcaccaccagccagaagaccaccuggcugcccgugcugcugggcagcuucggcugcaagccccugaccauguuccugaucaccgagaacaagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggagcaggaggccgagcacagcggcgccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggcuacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccacccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuuccugcccagcgagcuggagacccccaaccuggccgagagagcccuggacuggcuggagaagcacggcgccgagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccgccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15829 - RNA, 9879 nt, Artificial Sequence
  derived and/or modified CDS sequence (opt4) from DENV-1__JX669467__SS-prME
agcgugaccaugcugcugaugcugcugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagaagguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcaacagagacuucguggagggccugagcggcgccaccuggguggacguggugcuggagcacggcagcugcgugaccaccauggccaagaacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugcugaccugcgccaaguucaagugcgugaccaagcuggagggcaagaucgugcaguacgagaaccugaaguacagcgugaucgugaccgugcacaccggcgaccagcaccaggugggcaacgagaccaccgagcacggcaccaucgccaccaucaccccccaggcccccaccagcgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaccagcuacgugaugugcaccggcagcuucaagcuggagaaggagguggccgagacccagcacggcaccgugcuggugcaggugaaguacgagggcaccgacgcccccugcaagauccccuucagcacccaggacgagaagggcgugacccagaacggcagacugaucaccgccaaccccaucgugaccgacaaggagaagcccgugaacaucgagaccgagccccccuucggcgagagcuacaucguggugggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagguguucggcaccgccuacggcgugcuguucagcggcgugagcuggaccaugaagaucggcaucggcauccugcugaccuggcugggccugaacagcagaagcaccagccugagcaugaccugcaucgccgugggcauggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcagagccugggaggagggcgugugcggcaucagaagcgccaccagacuggagaacaucauguggaagcagaucagcaacgagcugaaccacauccugcuggagaacgacaucaaguucaccgugguggugggcaacgccaacggcauccuggcccagggcaagaagaugaucagaccccagcccauggagcacaaguacagcuggaagagcuggggcaaggccaagaucaucggcgccgacauccagaacaccaccuucaucaucgacggccccgacacccccgagugccccgacgagcagagagccuggaacaucugggagguggaggacuacggcuucggcaucuucaccaccaacaucuggcugaagcugagagacagcuacacccagaugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagauguacggcggccccaucagccagcacaacuacagacccggcuacuucacccagaccgccggccccuggcaccugggcaagcuggagcuggacuucgaccugugcgagggcaccaccguggugguggacgagcacugcggcagcagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugagaagcauggugagcgccggcagcggcgagguggacagcuucagccugggcauccugugcgugagcaucaugaucgaggaggugaugagaagcagauggagcagaaagaugcugaugaccggcacccuggccguguuccugcugcugaucaugggccagcugaccuggaacgaccugaucagacugugcaucauggugggcgccaacgccagcgacaagaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugaugcugaagcugcugaccgaguuccagccccaccagcuguggaccacccugcugagccugaccuucaucaagaccacccugagccuggacuacgccuggaagaccaccgccaccgugcugagcaucgugagccuguucccccugugccugagcaccaccagccagaagaccaccuggcugcccgugcugcugggcagcuucggcugcaagccccugaccauguuccugaucaccgagaacgagaucuggggcagaaagagcuggccccugaacgagggcaucauggccaucggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcaccagccacaacauccugguggaggugcaggacgacggcaccaugaagaucaaggacgaggagagagacgacacccugaccauccugcugaaggccacccugcuggccgugagcggcguguaccccaugagcauccccgccacccuguucgugugguacuucuggcagaagaagaagcagagaagcggcgugcugugggacacccccagcccccccgagguggagagagccgugcuggacgacggcaucuacagaauccugcagagaggccugcugggcagaagccaggugggcgugggcguguuccaggacggcguguuccacaccauguggcacgugaccagaggcgccgugcugauguaccagggcaagagacuggagcccagcugggccagcgugaagaaggaccugaucagcuacggcggcggcuggagauuccagggcagcuggaacaccggcgaggaggugcaggugaucgccguggagcccggcaagaaccccaagaacgugcagaccacccccggcaccuucaagacccccgagggcgaggugggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucaagaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcagagagaucguggaccugaugugccacgccaccuucaccaugagacugcugagccccgugagagugcccaacuacaacaugaucaucauggacgaggcccacuucaccgaccccgccagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgacuggaucaccgacuuccccggcaagaccgugugguucgugcccagcaucaagagcggcaacgacaucgccaacugccugagaaagaacggcaagagagugauccagcugagcagaaagaccuucgacaccgaguaccagaagaccaagaacaacgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagaaucggcagaaaccagaacaaggagggcgaccaguacguguacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccugagagcccagaacgcccuggacaaccuggugaugcugcacaacagcgagcagggcggcaaggccuacagacacgccauggaggagcugcccgacaccaucgagacccugaugcugcuggcccugaucgccgugcugaccggcggcgugacccuguucuuccugagcggcaagggccugggcaagaccagcaucggccugcugugcgugaccgccagcagcgcccugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccgccgagaaccaccagcacgccaccaugcuggacguggaccugcaccccgccagcgccuggacccuguacgccguggccaccaccgugaucacccccaugaugagacacaccaucgagaacaccaccgccaacaucagccugaccgccaucgccaaccaggccgccauccugaugggccuggacaagggcuggcccaucagcaagauggaccugggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccugugggagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugagaugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaugccccccgagaagugcgacacccugcugugcgacaucggcgagagcagccccaaccccaccaucgaggagggcagaacccugagagugcugaagaugguggagcccuggcugagaggcaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagaacgagcacaagagcaccuggcacuacgacgaggacaaccccuacaagaccugggccuaccacggcagcuacgaggugaagcccagcggcagcgccagcagcauggugaacggcguggugagacugcugaccaagcccugggacgugauccccauggugacccagaucgccaugaccgacaccacccccuucggccagcagagaguguucaaggagaagguggacaccagaacccccagagccaagagaggcaccgcccagaucauggaggugaccgccaaguggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaccagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggugcagcugaucagacagauggagagcgagggcaucuucuuccccagcgagcuggagagccccaaccuggccgagagagugcuggacuggcuggagaagcacggcgccgagagacugaagagaauggccaucagcggcgacgacugcguggugaagcccaucgacgacagauucgccaccgcccugaucgcccugaacgacaugggcaaggugagaaaggacaucccccagugggagcccagcaagggcuggaacgacuggcagcaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacgugagcagcugggaggaggugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga

SEQ ID NO: 15830 - RNA, 9879 nt, Artificial Sequence
  derived and/or modified CDS sequence (opt4) from DENV-1__HM469967__SS-prME
agcgugaccaugcugcugaugcugaugcccaccgcccuggccuuccaccugaccaccagaggcggcgagccccacaugaucgugagcaagcaggagagaggcaagagccugcuguucaagaccagcgccggcgugaacaugugcacccugaucgccauggaccugggcgagcugugcgaggacaccaugaccuacaagugccccagaaucaccgaggccgagcccgacgacguggacugcuggugcaacgccaccgacaccugggugaccuacggcaccugcagccagaccggcgagcacagaagagacaagagaagcguggcccuggccccccacgugggccugggccuggagaccagaaccgagaccuggaugagcagcgagggcgccuggaagcagauccagagaguggagaccugggcccugagacaccccggcuucaccgugaucgcccuguuccuggcccacgccaucggcaccagcaucacccagaagggcaucaucuucauccugcugaugcuggugacccccagcauggccaugagaugcgugggcaucggcagcagagacuucguggagggccugagcggcgccaccuggguggacguggugcuggagcacggcagcugcgugaccaccauggccaaggacaagcccacccuggacaucgagcugcugaagaccgaggugaccaaccccgccgugcugagaaagcugugcaucgaggccaagaucagcaacaccaccaccgacagcagaugccccacccagggcgaggccacccugguggaggagcaggacgccaacuucgugugcagaagaaccuucguggacagaggcuggggcaacggcugcggccuguucggcaagggcagccugaucaccugcgccaaguucaagugcgugaccaagcuggagggcaagaucgugcaguacgagaaccugaaguacagcgugaucgugaccgugcacaccggcgaccagcaccaggugggcaacgagagcaccgagcacggcaccaccgccaccaucaccccccaggcccccaccaccgagauccagcugaccgacuacggcgcccugacccuggacugcagccccagaaccggccuggacuucaacgagauggugcugcugaccaugaaggagaagagcuggcuggugcacaagcagugguuccuggaccugccccugcccuggaccagcggcgccagcaccagccaggagaccuggaacagacaggaccugcuggugaccuucaagaccgcccacgccaagaagcaggaggugguggugcugggcagccaggagggcgccaugcacaccgcccugaccggcgccaccgagauccagaccagcggcaccaccaccaucuucgccggccaccugaagugcagacugaagauggacaagcugacccugaagggcaugagcuacgugaugugcaccggcagcuucaagcuggagaaggagguggccgagacccagcacggcaccgugcuggugcagaucaaguacgagggcaccgacgcccccugcaagauccccuucagcacccaggacgagaagggcgugacccagaacggcagacugaucaccgccaaccccaucgugaccgacaaggagaagcccgugaacaucgaggccgagccccccuucggcgagagcuacaucgugaucggcgccggcgagaaggcccugaagcugagcugguucaagaagggcagcagcaucggcaagauguucgaggccaccgccagaggcgccagaagaauggccauccugggcgacaccgccugggacuucggcagcaucggcggcguguucaccagcgugggcaagcuggugcaccagaucuucggcaccgccuacggcgugcuguucagcggcgugagcuggaccaugaagaucggcaucggcgugcugcugaccuggcugggccugaacagcagaagcaccagccugagcaugaccugcaucgccgugggccuggugacccuguaccugggcgugauggugcaggccgacagcggcugcgugaucaacuggaagggcagagagcugaagugcggcagcggcaucuucgugaccaacgaggugcacaccuggaccgagcaguacaaguuccaggccgacagccccaagagacugagcgccgccaucggcaaggccugggaggagggcgugugcggcaucagaagcgccaccagacuggagaacaucauguggaagcagaucagcaacgagcugaaccacauccugcuggagaacgacaugaaguucaccgugguggugggcgacguggccggcauccuggcccagggcaagaagaugaucagaccccagcccauggaguacaaguacagcuggaagagcuggggcaaggccaagaucaucggcgccgacgugcagaacaccaccuucaucaucgacggccccaacacccccgagugccccgacgaccagagagccuggaacaucugggagguggaggacuacggcuucggcaucuucaccaccaacaucuggcugaagcugagagacagcuacacccaggugugcgaccacagacugaugagcgccgccaucaaggacagcaaggccgugcacgccgacaugggcuacuggaucgagagcgagaagaacgagaccuggaagcuggccagagccagcuucaucgaggugaagaccugcaucuggcccaagagccacacccuguggagcaacggcgugcuggagagcgagaugaucauccccaagaucuacggcggccccaucagccagcacaacuacagacccggcuacuucacccagaccgccggccccuggcaccugggcaagcuggagcuggacuucgaccugugcgagggcaccaccguggugguggacgagcacugcggcaacagaggccccagccugagaaccaccaccgugaccggcaagaucauccacgaguggugcugcagaagcugcacccugcccccccugagauucagaggcgaggacggcugcugguacggcauggagaucagacccgugaaggagaaggaggagaaccuggugaagagcauggugagcgccggcagcggcgagguggacagcuucagccugggccugcugugcaucagcaucaugaucgaggaggugaugagaagcagauggagcagaaagaugcugaugaccggcacccuggccguguucuuccugcugaucaugggccagcugaccuggaacgaccugaucagacugugcaucauggugggcgccaacgccagcgacagaaugggcaugggcaccaccuaccuggcccugauggccaccuucaagaugagacccauguucgccgugggccugcuguucagaagacugaccagcagagaggugcugcugcugaccaucggccugagccugguggccagcguggagcugcccaacagccuggaggagcugggcgacggccuggccaugggcaucaugauccugaagcugcugaccgacuuccagagccaccagcugugggccacccugcugagccugaccuucaucaagaccaccuucagccugcacuacgccuggaagaccauggccauggugcugagcaucgugagccuguucccccugugccugagcaccaccagccagaagaccaccuggcugcccgugcugcugggcagccugggcugcaagccccugaccauguuccugaucgccgagaacaagaucuggggcagaaagagcuggccccugaacgagggcaucauggccgugggcaucgugagcauccugcugagcagccugcugaagaacgacgugccccuggccggcccccugaucgccggcggcaugcugaucgccugcuacgugaucagcggcagcagcgccgaccugagccuggagaaggccgccgaggugagcugggaggaggaggccgagcacagcggcgccagccacaacauccugguggaggugcaggacgacggcaccaugaagaucaaggacgaggagagagacgacacccugaccauccugcugaaggccacccugcuggccgugagcggcguguacccccugagcauccccgccacccuguucgugugguacuucuggcagaagaagaagcagagaagcggcgugcugugggacacccccagcccccccaagguggagagagccgugcuggacgacggcaucuacagaaucaugcagagaggccugcugggcagaagccaggugggcgugggcguguuccaggagaacguguuccacaccauguggcacgugaccagaggcgccgugcugauguaccagggcaagagacuggagcccagcugggccagcgugaagaaggaccugaucagcuacggcggcggcuggagacugcagggcagcuggaacaccggcgaggaggugcaggugaucgccguggagcccggcaagaaccccaagaacgugcagaccgcccccggcaccuucaagacccccgagggcgagaucggcgccaucgcccuggacuucaagcccggcaccagcggcagccccaucgugaacagagagggcaagaucgugggccuguacggcaacggcguggugaccaccagcggcaccuacgugagcgccaucgcccaggccaaggccagccaggagggcccccugcccgagaucgaggacgagguguucagaaagagaaaccugaccaucauggaccugcaccccggcagcggcaagaccagaagauaccugcccgccaucgugagagaggccaucaagagaaagcugagaacccugauccuggcccccaccagagugguggccagcgagauggccgaggcccugaagggcaugcccaucagauaccagaccaccgccgugaagagcgagcacaccggcaaggagaucguggaccugaugugccacgccaccuucaccaugagacugcugagccccgugagagugcccaacuacaacaugaucaucauggacgaggcccacuucaccgaccccagcagcaucgccgccagaggcuacaucagcaccagagugggcaugggcgaggccgccgccaucuucaugaccgccaccccccccggcagcguggaggccuucccccagagcaacgccgugauccaggacgaggagagagacauccccgagagaagcuggaacagcggcuacgaguggaucaccgacuuccccggcaagaccgugugguucgugcccagcaucaaggccggcaacgacaucgccaacugccugagaaagaacggcaagagagugauccagcugagcagaaagaccuucgacaccgaguaccagaagaccaagaacagcgacugggacuacguggugaccaccgacaucagcgagaugggcgccaacuucagagccgacagagugaucgaccccagaagaugccugaagcccgugauccugaaggacggccccgagagagugauccuggccggccccaugcccgugaccguggccagcgccgcccagagaagaggcagagugggcagaaaccacaacaaggagggcgaccaguacaucuacaugggccagccccugaacaacgacgaggaccacgcccacuggaccgaggccaagaugcugcuggacaacaucaacacccccgagggcaucauccccgcccuguucgagcccgagagagagaagagcgccgccaucgacggcgaguacagacugagaggcgaggccagaaagaccuucguggagcugaugagaagaggcgaccugcccguguggcugagcuacaagguggccagcgagggcuuccaguacagcgacagaagauggugcuucgacggcgagagaaacaaccaggugcuggaggagaacauggacguggagaucuggaccaaggagggcgagagaaagaagcugagacccagauggcuggacgccagaaccuacagcgacccccuggcccugagagaguucaaggaguucgccgccggcagaagaagcgugagcggcgaccugauccuggagaucggcaagcugccccagcaccugacccagagagcccagaacgcccuggacaaccuggugaugcugcacaacagcgagcagggcggcagagccuacagacacgccauggaggagcugcccgacaccaucgagacccugaugcugcuggcccugaucgccgugcugaccggcggcgugacccuguucuuccugagcggcagaggccugggcaagaccagcaucggccugcugugcgugauggccagcagcgugcugcuguggauggccagcguggagccccacuggaucgccgccagcaucauccuggaguucuuccugauggugcugcugauccccgagcccgacagacagagaaccccccaggacaaccagcuggccuacguggugaucggccugcuguucaugauccugaccguggccgccaacgagaugggccugcuggagaccaccaagaaggaccugggcaucggccacguggccguggagaaccaccaccacgccgccaugcuggacguggaccugcaccccgccagcgccuggacccuguacgccguggccaccaccaucaucacccccaugaugagacacaccaucgagaacaccaccgccaacaucagccugaccgccaucgccaaccaggccgccauccugaugggccuggacaagggcuggcccaucagcaagauggacaucggcgugccccugcuggcccugggcugcuacagccaggugaacccccugacccugaccgccgccgugcugaugcugguggcccacuacgccaucaucggccccggccugcaggccaaggccaccagagaggcccagaagagaaccgccgccggcaucaugaagaaccccaccguggacggcaucguggccaucgaccuggaccccgugguguacgacgccaaguucgagaagcagcugggccagaucaugcugcugauccugugcaccagccagauccugcugaugagaaccaccugggcccugugcgagagcaucacccuggccaccggcccccugaccacccuguggaagggcagccccggcaaguucuggaacaccaccaucgccgugagcauggccaacaucuucagaggcagcuaccuggccggcgccggccuggccuucagccugaugaagagccugggcggcggcagaagaggcaccggcgcccagggcgagacccugggcgagaaguggaagagacagcugaaccagcugagcaagagcgaguucaacaccuacaagagaagcggcaucauggagguggacagaagcgaggccaaggagggccugaagagaggcgagaccaccaagcacgccgugagcagaggcaccgccaagcugaagugguucguggagagaaaccuggugaagcccgagggcaaggugaucgaccugggcugcggcagaggcggcuggagcuacuacugcgccggccugaagaaggugaccgaggugaagggcuacaccaagggcggccccggccacgaggagcccauccccauggccaccuacggcuggaaccuggugaagcugcacagcggcaaggacguguucuucaucccccccgagaagugcgacacccugcugugcgacaucggcgagagcagccccaaccccaccaucgaggagggcagaacccugagagugcugaagaugguggagcccuggcugagaaagaaccaguucugcaucaagauccugaaccccuacaugcccagcgugguggagacccuggagcagaugcagagaaagcacggcggcaugcuggugagaaacccccugagcagaaacagcacccacgagauguacugggugagcugcggcaccggcaacaucgugagcgccgugaacaugaccagcagaaugcugcugaacagauucaccauggcccacagaaagcccaccuacgagagagacguggaccugggcgccggcaccagacacguggccguggagcccgagguggccaaccuggacaucaucggccagagaaucgagaacaucaagcacgagcacaagagcaccuggcacuacgacgaggacaaccccuacaagaccugggccuaccacggcagcuacgaggugaagcccagcggcagcgccagcagcauggugaacggcguggugaagcugcugaccaagcccugggacgugauccccauggugacccagaucgccaugaccgacaccacccccuucggccagcagagaguguucaaggagaagguggacaccagaacccccaaggccaagagaggcaccgcccagaucauggaggugaccgccagauggcuguggggcuuccugagcagaaacaagaagcccagaaucugcaccagagaggaguucaccagaaaggugagaagcaacgccgccaucggcgccguguucguggacgagaaccaguggaacagcgccaaggaggccguggaggacgagagauucugggaccuggugcacagagagagagagcugcacaagcagggcaagugcgccaccugcguguacaacaugaugggcaagagagagaagaagcugggcgaguucggcaaggccaagggcagcagagccaucugguacauguggcugggcgccagauuccuggaguucgaggcccugggcuucaugaacgaggaccacugguucagcagagagaacagccugagcggcguggagggcgagggccugcacaagcugggcuacauccugagagacaucagcaagauccccggcggcaacauguacgccgacgacaccgccggcugggacaccagaaucaccgaggacgaccugcagaacgaggccaagaucaccgacaucauggagcccgagcacgcccugcuggccaagagcaucuucaagcugaccuaccagaacaagguggugagagugcagagacccgccaagaacggcaccgugauggacgugaucagcagaagagaccagagaggcagcggccaggugggcaccuacggccugaacaccuucaccaacauggaggcccagcugaucagacagauggagagcgagggcaucuucagccccagcgagcuggagacccccaaccuggccgagagagugcuggacuggcuggagaaguacggcguggagagacugaagagaauggccaucagcggcgacgacugcguggugaagcccaucgacgacagauucgccaccgcccugaccgcccugaacgacaugggcaaggugagaaaggacaucccccagugggagcccagcaagggcuggaacgacuggcagaaggugcccuucugcagccaccacuuccaccagcugaucaugaaggacggcagagagaucguggugcccugcagaaaccaggacgagcuggugggcagagccagagugagccagggcgccggcuggagccugagagagaccgccugccugggcaagagcuacgcccagauguggcagcugauguacuuccacagaagagaccugagacuggccgccaacgccaucugcagcgccgugcccguggacugggugcccaccagcagaaccaccuggagcauccacgcccaccaccaguggaugaccaccgaggacaugcugagcguguggaacagaguguggaucgaggagaaccccuggauggaggacaagacccacaucagcagcugggaggacgugcccuaccugggcaagagagaggaccaguggugcggcagccugaucggccugaccgccagagccaccugggccaccaacauccagguggccaucaaccaggugagaagacugaucggcaacgagaacuaccuggacuacaugaccagcaugaagagauucaagaacgagagcgaccccgagggcgcccugugguga
